United States Patent 11,439,712 (METHODS AND COMPOSITIONS FOR RNA-DIRECTED REPRESSION OF TRANSCRIPTION USING CRISPR-ASSOCIATED GENES) - sequence listing, part 2

SEQ ID NO: 9060 - protein, 325 aa, Halomonas titanicae BH1
MMTMSEVKNLLVLPRLRVQNANAISSPMTWGFPAMSAFVGLMHALERKLAEASLPVSLGRVGVICHDFEAQATEGGYIRGFHLTRNPVDKTGGTAAIVEEGRIHLDITLIFAIDTGTAESEHEDIAHQISETVSGMRIAGGSVVPNRNVPSHKQRPQWVMLDDNEDERYKQFARLKRRWLPGFALTLRDDYLTEHLTTLQKHNPEASLLDAWLDLSRLNHVCTLENEGEPNKKPVWQAQRPYRGWLVPIPVGYGAISDLFQPGEVANARDTMTQFRFVESLYSIGEWVSPHRMKQPEDLLWYVDNDEEAGLYRLNNDYHLRASAQ

SEQ ID NO: 9061 - protein, 294 aa, Acinetobacter baumannii MSP4-16; identical to SEQ ID NO: 8815

SEQ ID NO: 9062 - protein, 310 aa, Rhodopirellula maiorica SM1
MGTMILIERLEVQNANAISSPLTMGVPSITAFMGFAHQLQRLVHKANPSSDLLVRQVGVVIHDIDLQTRQFPRSRSLLKLTANTRGGRNESKKSDRASFIEEGRCHLTVSLLLDCETEFLGGTSETIERMQHLVMGRMRLAGGTIINTDLPRIQTVSNDRRTLARLIPGWVLIERRDLMIEAMGEGLDAIDALHRALAIHHQRHVQLDSDANSENLGSHATVTWSSGRHQPGYIVPIATGYQALTPVVPSNNARDRDTPHRLAESVLTLGEFVLPLRLEKPSEMLWQYQRDGDLYVCQQQTCSLFEEPLS

SEQ ID NO: 9063 - protein, 273 aa, Morganella morganii SC01
MSINYLLLKNILIRNANALSGALIAGFPAVTAWLGFIHALERKVRKQGFPSVRFNHAGIICHYCHLQLYAEPGGVMYSALNRRKPPDKKGKNPSLVEEVYCHLNVSLLICGGNIQDKNKEFLTVVSETIKMLKIAGGDITDSGKQETGSFPDSKPRWCELRQCIAPGYALLERRDVMVNAMNSGMDAMEALLKYTTAPGSVLIPVVTGYQGLSPPGIVKNARTEGIPHRFAESVITLGEFRPVDKLRDPSDMLWRYHYLPDENLYLCQQGKHD

SEQ ID NO: 9064 - protein, 294 aa, Acinetobacter baumannii ABNIH6; identical to SEQ ID NO: 8656

SEQ ID NO: 9065 - protein, 294 aa, Acinetobacter baumannii ABNIH7; identical to SEQ ID NO: 8656

SEQ ID NO: 9066 - protein, 294 aa, Acinetobacter baumannii ABNIH11; identical to SEQ ID NO: 8656

SEQ ID NO: 9067 - protein, 64 aa, Acinetobacter baumannii ABNIH10
MTAWLGAVHALQRKLQTKDCDVALTKVAVSCHEFNLQTYKGQGDFVHSIIGTANPLDKDGSRPA

SEQ ID NO: 9068 - protein, 174 aa, Acinetobacter baumannii ABNIH10
MKIVPDFVSSMKFASGDVLSVQKCQIIDFDEDESHDKELRPILNKLMLGHVLIERRDLVVESMNQGRDALDAVLDYLKVTHSSAVDENGKVTWNSKRQTHGWLVPIAIGFQGISELGQAKNQRDANTPHRFAESVLTLGEFVMPYRIEHIDQLLWQYHVDLENNLYLCKNISTI

SEQ ID NO: 9069 - protein, 294 aa, Acinetobacter baumannii ABNIH19; identical to SEQ ID NO: 8656

SEQ ID NO: 9070 - protein, 307 aa, Escherichia coli BCE034_MS-14
MSYLLLLPHIRIENANAVSGLTWGFPSMTHFLGYVHALSRKVVDEFGVSFDGCAVVSHEQHIQAYSSGRDFQFALTRNPLTREGKTASFNEEGRMHLTVSLLIDCNGEITNGEYGRKALCDHLKMLCQSHKLAGGSIVDMREPQLFHAPEDEKQLRKIIWRLMPGYALYDRSEWLAERHQQHPDISLLDAWLDFAAVKYQAESPAEDNSAKWTYQPKPMPGFLVPLMCGYQRISPVYAPGEVENARDTVTPFAFAEAVYGIGEWRGLHRITDLQPLMWHYRTTDTGYYCSATPVVDDFTFNEYDDLE

SEQ ID NO: 9071 - protein, 307 aa, Escherichia coli 2875000; identical to SEQ ID NO: 8800

SEQ ID NO: 9072 - protein, 307 aa, Escherichia coli 2872800; identical to SEQ ID NO: 8800

SEQ ID NO: 9073 - protein, 307 aa, Escherichia coli 2867750; identical to SEQ ID NO: 8800

SEQ ID NO: 9074 - protein, 307 aa, Escherichia coli 2866550; identical to SEQ ID NO: 8800

SEQ ID NO: 9075 - protein, 307 aa, Escherichia coli 2866450; identical to SEQ ID NO: 8800

SEQ ID NO: 9076 - protein, 307 aa, Escherichia coli 2866750; identical to SEQ ID NO: 8800

SEQ ID NO: 9077 - protein, 307 aa, Escherichia coli 2851500; identical to SEQ ID NO: 8800

SEQ ID NO: 9078 - protein, 307 aa, Escherichia coli 2853500
MSYLLLLPHIRIENANAVSGLTWGFPSMTHFLGYVHALSRKVVDEFGVSFDGCAVVSHEQHIQAYSSGRDFQFALTRNPLTREGKTSSFNEEGRMHLTVSLLIECNGEITNGEYGRKALCDHLKMLCQSHKLAGGSIVDMREPQLFHAPEDEKQLRKIIWRLMPGYALYDRSEWLAERHQQHPDISLLDAWLDFAAVKYQAESPAEDNSAKWTYQPKPMPGFLVPLMCGYQRISPVYAPGEVENARDTVTPFAFAEAVYGIGEWRGLHRITDLQPLMWHYRTTDTGYYCSATPVVDDFTFNEYDDLE

SEQ ID NO: 9079 - protein, 307 aa, Escherichia coli 2850750; identical to SEQ ID NO: 8800

SEQ ID NO: 9080 - protein, 307 aa, Escherichia coli 2850400; identical to SEQ ID NO: 8800

SEQ ID NO: 9081 - protein, 307 aa, Escherichia coli 2848050; identical to SEQ ID NO: 8800

SEQ ID NO: 9082 - protein, 307 aa, Escherichia coli 2756500; identical to SEQ ID NO: 8800

SEQ ID NO: 9083 - protein, 307 aa, Escherichia coli Jurua 20/10; identical to SEQ ID NO: 8800

SEQ ID NO: 9084 - protein, 307 aa, Escherichia coli 2720900; identical to SEQ ID NO: 9070

SEQ ID NO: 9085 - protein, 327 aa, Pseudomonas sp. P179; identical to SEQ ID NO: 8627

SEQ ID NO: 9086 - protein, 307 aa, Escherichia coli 2735000; identical to SEQ ID NO: 8800

SEQ ID NO: 9087 - protein, 307 aa, Escherichia coli 179550
MSYLLLLPHIRIENANAVSGLTWGFPSMTHFLGYVHALSRKVVDEFGVSFDGCAVVSHEQHIQAYSSGRDFQFALTRNPLTREGKTASFNEEGRMHLTVSLLIECNGEITNGEYGRKALCDHLKMLCQSHKLAGGSIVDMREPQLFHAPEDEKQLRKIIWRLMPGYALYDRSEWLAERHQQHPDISLLDAWLDFAAVKYQAESPAEDNSAKWTYQPKPMPGFLVPLMCGYQRISPVYAPGEVENARDTVTPFSFAEAVYGIGEWRGLHRITDLQPLMWHYRTTDTGYYCSATPVVDDFTFNEYDDLE

SEQ ID NO: 9088 - protein, 307 aa, Escherichia coli 180200; identical to SEQ ID NO: 8800

SEQ ID NO: 9089 - protein, 328 aa, Thauera sp. 28
MNTLPHSDGLLILPRLRVQNANAISSPLTHGFPSMTAFLGLMWALARKLEPHDLPLAFDSVGVICHDFDEQVTEGGYVKAFRLTRNPVGKDGGSAAIVEEGRMHMEITLIFGISGGFVELDERAHDAIAQTVAHELAGMRIAGGSVLPSSDWRSRPAVLRFGDDAEDVRRRFRHLRRHWLPGFALVCRDDLLHARLDQLRAAAPETTALDALLDLSRFNWRPVRPDTESDGASATTVKVEWKPEPRPGWIVPIPVGFGALSELLPAGEVQSARDHDTPFRFVESLYSIGQWVSPHRLDNAEQLLWYASTDPAAGLYRCHNDFASLQSA

SEQ ID NO: 9090 - protein, 296 aa, Acinetobacter bohemicus ANC 3994
MRNFLLIPHLKIQNANAMSSPYTIGFPAMTAWLGAIHALQRTLQAQGYTNIVLDKVAISCHHFDLQTYKGRGDFVHSIVGTANPLDKDGNRPAFIEEARCHLEVSLLIECQNLDPDEEKQLLADIQKLILSMKFASGDVLSARHCEFIRFDEDAHLEAELPKITKRLMLGHVLIERRDLVIESMNEGKDGLDAVLDYLKITHRSTQDEDGKVTWSSKRKTTGWLVPIAVGFQGISELGQAKNQRDANTPHRFAESVITLGEFIMPYRIESMDQLLWQYHVDLENNLYLCQNLTTTI

SEQ ID NO: 9091 - protein, 294 aa, Acinetobacter proteolyticus
MRHFLLISHLKLHNANAMSSPYTIGFPAMTAWLGAVHALQRKLQAKACDVTLTKVAVSCHEFNLQTYKGQGDFVHSIIGTANPLDKDGSRPAFIEEARCHLEVSLLVEIEDLNNKKREQLLELASDLVCSMKFASGDVLTVKNCQILDFDDDEDHDRELKPILNKLMLGHVLIERRDLVIDSMNQGKDALDAVLEYLHVTHSSNVDEDNKVTWTSKRKGQGWLVPVAVGFQGISELGFAKNQRDANTPHRFAESVLTLGEFLMPYRIEHLDQMLWQYHFDSENNLYLCQNATTN

SEQ ID NO: 9092 - protein, 294 aa, Acinetobacter sp. NIPH 236
MSRYVVIPRIRVQNANMQTNGFLLGGVPLFAANMFAHHLARQLGTQEQGIIYIHHDQQRLGGQAYGRFTPAQRRGAVFIGKKDYSSKNKYALSLQPTASCHLEFSLVIKFSSSRISPEKLTNILKRSRFAGGQIIEFLDITTHAENELEAALKKIKTGFAILDRQDLLIEYQQRKQINRVQAFTQLLALKADALRAFFNDQNLSWISATNLGYALLEPLTDQRAGIRQAQDQETTAHAYAESLTGIVQYFSLGEILRKNTEAEDDTWHNLQKLLWTYHWPQDDIFLLKQNCVNA

SEQ ID NO: 9093 - protein, 294 aa, Acinetobacter parvus DSM 16617 = CIP 108168
MRQFLLIPHLKLHNANAMSSPYTIGFPAMTAWLGAVHALQRKLQSKGCEVSLTKVGVSCHEFNLQTYKGQGDFVHSIIGTANPLDKGGSRPAFIEEARCHLEVSLLIECQNIDPDEKEQFLEDAQQLICSMKFASGDVLAVKKCQILQFDEDADQDRELKPILNKLMLGHVLVERRDLVIESMKQGKDALDAVLDYLKVTHSSSVDENGKVIWTSKRNAQGWLVPIAVGFQGISELGIAKNQRDADTPHRFAEAVLTLGEFIMPYRIESIDQLLWQYHVDLENNLYLCQNSTTI

SEQ ID NO: 9094 - protein, 329 aa, Acinetobacter lwoffii NIPH 715
MTSYILLEKVSVEDANCIAGFTYGFPAITGFLGFTHAISRKFNAEFGIEIVGCAIFSHDFTLHTNEQYDVRFIQSKRPPVTLQGQKYRAEANKTPPIIEEGKMDLTISLLLQCKQVLSGVDEQKKLYQKSLKKWVYQARLVGGSITNIKNISFWTEESDLNKLKRKLLPSFVLLDATSTLEKHVEQSKIDDPNSDLFDLWTDFFAYKAESKIDEDQSTVQWVRKDKPNPRGWFVPLMIGFKGISPLYEGQEVEHHRDPRYPFRFVESVHSIGEWRSTHRIQNLSDLIWTYHIEDEWYLCQQKQNFQANIEPIEQPQPALDDGSFNFDFN

SEQ ID NO: 9095 - protein, 294 aa, Acinetobacter baumannii NIPH 146; identical to SEQ ID NO: 8773

SEQ ID NO: 9096 - protein, 294 aa, Acinetobacter baumannii NIPH 615; identical to SEQ ID NO: 8773

SEQ ID NO: 9097 - protein, 366 aa, Acinetobacter sp. ANC 3789
MAQTYSKALYIVRLNVENVSIVSSHLTWGFPAPSAFTGFMHNLQRKLNEVAEYQQIECCGIGVISHQFIPQVTKSSSYRYSPYQLNLARHPLKSDGSTPAIIEEGKGHMDVSLVIGLAGDGLDQHLSANDQDLSLATQTLLEKLNQLVYGMRLAGGSIFPHKRMKPKLVNWLSSDAEDKTKQLRHYLLPGFALMHRHEVLTAHQAWLKQYAHYLDTQKSEPNLLDTLLDIQRLNFVSTANNNTDSTDVAEGNWQIRPRPEHLQGWLVPIPIGYAALTEIQPQGMVNGLRNDQYPATFVETLLSLGEWKSPHRIKNIVDILWNYNTEPKNGVYELVQSFAPKLNLNPSSVDELENHSFEFETEEEEF

SEQ ID NO: 9098 - protein, 294 aa, Acinetobacter sp. CIP 102159; identical to SEQ ID NO: 9093

SEQ ID NO: 9099 - protein, 314 aa, Acinetobacter sp. CIP 102129
MRRFILISHLKIHNANAMSSPFTIGFPAMTAWLGVIHALQRNLKEKGFDGLILDKVAVSCHEFNLQTYKGENDFENSIIINKTPLIFDKKYTGRYPKGTFPNMYEAPLIGDGFIEEARCHLDISLLIEYSNVDAEQTLNFLQSIEAIIPTMKFASGDIISFRNCETLSFNENKDEDQELRKISNKLMLGHVLIERRDLVIESMKQGKDALDAVLDYLKVTHSSSVDENGKVIWTSKRNAQGWLVPIAVGFQGISELGIAKNQRDADTPHRFAEAVLTLGEFIMPYRIESIDQLLWQYHVDLENNLYLCQNSTTI

SEQ ID NO: 9100 - protein, 294 aa, Acinetobacter sp. CIP 102529; identical to SEQ ID NO: 9093

SEQ ID NO: 9101 - protein, 294 aa, Acinetobacter sp. NIPH 758
MSRYVVIPRMRVQNANMQSNGLLLGGVPLFAANMFAHHLARQLGTQDEGIIYIHHDQQRLGGQAYGRFTPAQRRGAVFIGKKDYSSKNKYALSLQPTASCHLEFSLVIKFSSSRISPEKLTNILKRSRFAGGQIIEFLEISTHAENELETALKKIKTGFAILDRQDLLIEYQQRKQMNRVQAFTQLLALKADALRTFFNDQNLSWISATNLGYALLEPLTDQRAGIRQAQDQETTAHAYAEPLTGIVQYFSLGEILRKSSEAEDDMWHDLQKLLWTYHWPQDDIFLLKQNCINA

SEQ ID NO: 9102 - protein, 294 aa, Acinetobacter sp. CIP 102082; identical to SEQ ID NO: 9093

SEQ ID NO: 9103 - protein, 294 aa, Acinetobacter sp. CIP 102637
MRQFLLIPHLKLHNANAMSSPYTIGFPAMTAWLGAVHALQRKLHSKGCEVSLTKVGVSCHEFNLQTYKGQGDFVHSIIGTANPLDKDGSRPAFIEEARSHLEVSLLIECQNIDPDEKEQFLEDVQQLICSMKFASGDVLAVKKCQILQFDEDADQDRELKPILNKLMLGHVLVERRDLVIESMKQGKDALDAVLDCLKVTHSSSVDENGKVIWTSKRNAQGWLVPIAVGFQGISELGIAKNQRDADTPHRFAEAVLTLGEFIMPYRIESIDQLLWQYHVDLENNLYLCQNSTTI

SEQ ID NO: 9104 - protein, 294 aa, Acinetobacter sp. CIP 56.2
MRHFLLISHLKLHNANAMSSPYTIGFPAMTAWLGAVHALQRKLQAKACDVALTKVAVSCHEFNLQTYKGQGDFVHSIIGTANPLDKDGSRPAFIEEARCHLEVSLLVEIEDLNNKKRDQLLELASDLVSSMKFASGDVLTVKNCQILDFDDDEDHDRELKPILNKLMLGHVLIERRDLVIDSMNQGKDALDAVLEYLHVTHSSNVDEDNKVIWTSKRKAQGWLVPVAVGFQGISELGFAKNQRDANTPHRFAESVLTLGEFLMPYRIEHLDQMLWQYHFDSENNLYLCQNATTN

SEQ ID NO: 9105 - protein, 294 aa, Acinetobacter bereziniae NIPH 3
MSRYVVIPRIRVQNANMHTNGFLLGGVPLFAANMFAHHLARQLGTQEEGIIYIHHDQQRLGGQAYGRFTPAQRRGAVFIGKKDYSSKNKYALSLQPTASCHLEFSLVIKFTSSRISPEKLTNILNRSRFAGGQIIEFLEITTHAENELETALKKIKTGFAILDRQDLLIEYQQRQQINRVQAFTQLLALKADALRVFFNDQHLSWISATNLGYALLEPLTDQRTGIRQAQNQKTTVHAYAEPLTGIVQYFSLGEILRKSSDADDNTWHNLQKLLWTYHWPQDDIFLLQQNCIHA

SEQ ID NO: 9106 - protein, 294 aa, Acinetobacter baumannii NIPH 190; identical to SEQ ID NO: 8773

SEQ ID NO: 9107 - protein, 294 aa, Acinetobacter gerneri DSM 14967 = CIP 107464
MSYLVIPYLKIQAANFQSSGLVMGGAPLMATAMFSHNLARQIQSKVEGFYYIHHDMQRLGGMAYGRFTPAQRRGAVFIGKNDYSSKNKYALSLQPTASCHLLVSLVIEFKARSINLDAIVQLLKRSKFAGGQIIEFGQLKAFENADEALKHISSGFLVQDRHDLLVKYQENYHVNRLQAFTQLLARKPTAKDAPPALDLIPEENLAWLSATTLGYALLEPETFERTGVRHADHQEQTAHAYAEPLTCLIQYLSLNQILDDYESDEAEKWDDLTVLKWSYQWQSDDVFLLQQNIN

SEQ ID NO: 9108 - protein, 295 aa, Acinetobacter venetianus RAG-1 = CIP 110063
MSRYAVIPRIRVQNANMQSNGFLLGGVPLMAANMFAHHLARQLGTQDQGIIYIHHDQQRLGGQAYGKFTPAQRRGAVFIGKKDYSSKNKYALSLQPTASCHLEFSLIIKFASSRLSPEKLTHLLKRSRFAGGQIIEFSEISTHNENELETALKEIKTGFVILDRQDLLIEYQQRNQINRIQAFTQLLALKSDPLRTFFNDQSLSWISATNLGYALLETATDQRAGIRQAQDQHSTAHAYAEPLTGIVQYFSLGEILRKSAEADDSSWHELEQLLWTYQWPQDDIFLLQQNCTNAN

SEQ ID NO: 9109 - protein, 313 aa, Acinetobacter schindleri CIP 107287
MRHFLLIPHLKLHNANAMSSPYTIGFPAMTAWLGAVHALQRKLKQQGCDLNLKKVAVSCHEFNLQTYKGKKDFVKSLKVYRKASIFDADYGKKYPKDVYKSKYDAPLTSDAFNEEARCHLEVSLLIEIESSSKRQRDQLLELVHEIVAGMKFASGDVLSVKPCTILNFDDDEDQSQQLRPILNKLMLGHVLIERRDLVIQSMQEGKDALDSVLDYLKVTHSSIQDDEGKVTWTSKRQAQGWLVPIAVGFQGISELGQAKNQRDANTPHRFAESVLTLGEFVMPYRIESIDQLLWQYHVDLENNLYLCQNQNTH

SEQ ID NO: 9110 - protein, 294 aa, Acinetobacter junii CIP 107470
MRHFLFIPHLKIHNANAMSSPYTIGFPAMTAWLGAVHALQRKLKQQGCDLCLNKVAVSCHDFNLQTYKGRGDFVHSIVSTANPLDKDGNRPAFIEEARCHLEVSLLVEIESSSKRQRDQLLEIVPSIVASMKFASGDVLSVKNCSILDFNDEEDQDKELRPILNKLMLGHVLIERRDLVIQSMKEGKDALDSILDYLKVTHSSTQDEDGKVTWTSKRKAQGWLVPIAVGFQGISELRHAKNQRDVNTPHRFAESVLTLGEFVMPYRIESIDQLLWQYHVDLENNLYLCQNQNTH

SEQ ID NO: 9111 - protein, 294 aa, Acinetobacter baylyi DSM 14961 = CIP 107474; identical to SEQ ID NO: 8744

SEQ ID NO: 9112 - protein, 294 aa, Acinetobacter soli NIPH 2899
MSRYVVIPRMQIQNANMQTNGLLLGGVPLFAANMFAHHLARQLGTTDEGIIYIHHDQQRLGGQAYGRFTPAQRRGAVFIGKKDYSSKNKYALSLQPTASCHLEFSLVIKFSSSRIIPEKLTNILKRSRFAGGQIIEFLEITTHAENELETALKKIKTGFAILDRQDLLIEYQQRKQINRVQAFTQLLALKADALRTFFNDQNLSWISATNLGYALLEPLTDQRAGIRQAQDQETTAHAYAEPLTGIVQYFSLGEILRKNTEAEDDTWHNLQKLLWTYHWPQDDIFLLKQNCIHA

SEQ ID NO: 9113 - protein, 294 aa, Acinetobacter junii CIP 64.5
MRYFLLIPHLKLHNANAMSSPYTIGFPAMTAWLGAVHALQRKLQAKALDVALTKVAVSCHEFNLQTYKGQGDFVHSIIGTANPLDKDGSRPAFIEEARCHLEVSLLIEIENLSIKKREQLLEMVTDLVGSMKFASGDVLAVKKCQVIDFDEDESQDKELRPILNKLMLGHVLIERRDLIIESMNQGKDALDSVLDYLKVTHSSTIDEYDKVTWTSKRKAEGWLIPIAVGFQGISELGRAKNQRDANTPHRFAESVLTLGEFVMPYRIEHIDQLLWQYHVDLENNLYLCQNVSTI

SEQ ID NO: 9114 - protein, 294 aa, Acinetobacter ursingii ANC 3649
MRRFILIPHLKIHNANAMSSPYSIGFPAITAWLGAMHALQRKLNAKGHDIELTRLAVSCHDFNLQTHKGQSDFVHSIIGTANPLDKDGSRPAFIEEARCHLEVSLLIECQNIDPDEKETLLNDIQNCISSMKFASGDLLAVKACELLTVDEDGQKDQELKPILNKLMLGHVLIERRDLVIQSMQEGQDALDAVLDHLKVTHSSQIDDDGKITWSSSRKEKGWLVPIAVGFQGISELGIAKNQRDADTPHRFAEAVLTLGEFVMPYRIKSMDQLLWQYHVDLENNLYLCQNLITN

SEQ ID NO: 9115 - protein, 297 aa, Acinetobacter radioresistens DSM 6976 = NBRC 102413 = CIP 103788
MSRYVVIPRMRVQNANIQTNGLLLGGVPLFAANMFAHHLARQLGTQEQGIIYIHHDQQRLGGQAYGRFTPAQRRAATYINMQDYIGKKSAKRPILSLQPTASCHLEFSLIIKFSSSRISPEKLTNILKRSRFAGGQIIEFLEITIYAENELENALKKIKTGFAILDRQDLLIEYQQRKQINRVQAFTQLLALKADALRTFFNDPNLSWISATNLGYALLEPLTDQRAGIRQAQDQETTAHAYAEPLTGIVQYFSLGEILRKNTEAEDDTWHNLQKLLWTYHWPQDDIFLLKQNCINA

SEQ ID NO: 9116 - protein, 294 aa, Acinetobacter calcoaceticus DSM 30006 = CIP 81.8
MSRYVVIPRMRVQNANMQTNGFLLGGVPLFAANMFAHHLARQLGTQEEGIIYIHHDQQRLGGQAYGRFTPAQRRGAVFIGKKDYSSKNKYALSLQPTASCHLEFSLVIKFSSSRISPEKLTNILKRSRFAGGQIIEFLEITTHAENELETALKKIKTGFAILDRQDLLIEYQQRKQINRVQAFTQLLALKADALRTFFNDQNLSWISATNLGYALLEPLTDQRAGIRQAQDQETTAHAYAEPLTGIVQYFSLGEILRKNTEAEDDTWHNLQKLLWTYHWPQDDIFLLKQNCINA

SEQ ID NO: 9117 - protein, 294 aa, Acinetobacter haemolyticus CIP 64.3
MRYFLLIPHLKLHNANAMSSPYTIGFPAMTAWLGAVHALQRKLQANALDVALTRVAVSCHEFNLQTYKGQGDFVHSIIGTANPLDKDGSRPAFIEEARCHLEVSLLIEIENLSIKKRDNLLEMVSDLVGSMKFASGDVLAIKKCQIIDFDEEESQDKELRPILNKLMLGHVLIERRDLIIESMNQGRDALDAVLDYLKVTHSSTVDENEKVTWTSKRKAQGWLVPIAVGFQGISELGQAKNQRDASTPHRFAESVLTLGEFVMPYRIEHIDQLLWKYHFDSDNNLYLCQNISTT

SEQ ID NO: 9118 - protein, 294 aa, Acinetobacter baumannii NIPH 201; identical to SEQ ID NO: 8773

SEQ ID NO: 9119 - protein, 294 aa, Acinetobacter baumannii NIPH 527; identical to SEQ ID NO: 8656

SEQ ID NO: 9120 - protein, 294 aa, Acinetobacter baumannii NIPH 290; identical to SEQ ID NO: 8656

SEQ ID NO: 9121 - protein, 294 aa, Acinetobacter baumannii ANC 4097; identical to SEQ ID NO: 8656

SEQ ID NO: 9122 - protein, 294 aa, Acinetobacter baumannii ATCC 19606 = CIP 70.34 = JCM 6841; identical to SEQ ID NO: 8815

SEQ ID NO: 9123 - protein, 368 aa, Acinetobacter sp. NIPH 284
MHQTYPKALYVIRLNVENASIISSHLTWGFPAPSAFTGFMHHLQRQLNQIAEYASIECCGVGIISHQFNPQITKTNSFRYSPYQLNLARHPLKADGSTPAMIEEGKGHFEVSLVIGLAGDGLDPHLSANDEDLSTQTQSLLDRLNHLVYNMRLAGGSVFPHKRVKAKLINWSEHDAVDKTKILRRSVLPGFALQHRHELLMAHQNWLAQYPTYLATQKNSPDLLDTLLDIHRFNFVSTAQEASVDQESVDGVWTLRPRPEHLKGWLVPIPIGYAALTDLQPQGVIKGLRHDDYPATFVETLISLGEWQSPHRIKNIVDTLWNYNTEPKNGLYELVQPFAPKLDIDTSLPHEDTHQSFEFESEIEEEEF

SEQ ID NO: 9124 - protein, 295 aa, Acinetobacter sp. ANC 3862
MRHFLLISHLKLHNANAMSSPYTIGFPAMTAWLGAVHALQRKLQTKTCDVALTKVAISCHEFNLQTYKGQGDFVHSIIGTANPLDKDGSRPAFIEEARCHLEVSLLIEIENLSKKKRDQLLELIPDLVCGMKFASGDVLAVKNCQILDFDDEDENQDKELRPILNKLMLGHVIIERRDLVIESMNQGKDALDAVLDYLKVTHSSSLDQDDKVTWTSKRKAQGWLVPIAVGFQGISELGQAKNQRDANIPHRFAESVLTLGEFVMPYRIEHIDQLLWKYHVDLENNLYLCENFTTN

SEQ ID NO: 9125 - protein, 294 aa, Acinetobacter ursingii NIPH 706
MRRFILIPHLKIHNANAMSSPYSIGFPAITAWLGAMHALQRKLNAKGHDIELRRLAVSCHDFSLQTHKGQSDFVHSIIGTANPLDKDGSRPAFIEEARCHLEVSLLIEVENLGKKQREGLLTILPEIVNSMKFAGGDVLAVYDQQILDFDEDGQKDQELKPILNKLMLGHVLIERRDLVIQSMQDGQDALDAVLDHLKVKHSSQIDENGKITWSSSRKEKGWFVPIAVGFQGISELGIAKNQRDADTPHRFAEAVLTLGEFVMPYRIENIDQLLWQYHVDLENNLYLCQNLTTN

SEQ ID NO: 9126 - protein, 336 aa, Xanthomonas fragariae LMG 25863
MSRCPAFSHLLVLPHLHVHNANAVSSPLTHGFPSMTALLGLMWALQRKVHAAGLELTFHAIGAVCHAHQEQVTEGGFVKAFHLTRNPIGKDGKTAPIVEEGRIHLELSLVLGVHSQRWSDDPPAQQADTDAVAELLAGMRIAGGSLRAPAQPWRHRYQPWTLELTGTEDDRTTQFRKARMRLLPGFALVERADLLDARLAELQATDPGATRLDAWLSLSRINWRYQSDTTPNDTPGWSHDRSGHGWTVPIPVGYGALGELQAAGSVANARDTDTAFRFVESLYSLGQWISPHRLDAPQQLLWYASSDPGQGLYRCRNDFAAAVIADQTPDSTFSLD

SEQ ID NO: 9127 - protein, 687 aa, Grimontia indica
MKTLRDLLEHEEPDIALRKAFAAYSELVDVTGEETQTLIVLLNLTLKRDEVESLTSRKSARAVLKDEAHIDSCLEEVWWLHTHNLKYPDTRVQAQRILCGDLLLITGALGSANCECRLGWSHNSSQVNKAKLFCSGFIWEESSTCLAECVIKNSDAWCRAFRELGLTKTKFGEWRLKLEQARNTDHFPSAVSDYSKQVRFPWLNDYLAITPVVSSAVQAKIQQLHTQRLGRFRTIGHSHPASVGDLASSKGGSVSVLNYPLNIAWRNKVSLNKSRIRQVESNKSVFNQGAVLNKRFIGLLDSLIHLDEEPLLRRRRRRRISLVRQLRRALAEWLLPIMEWRDSLRDGADTLAAIRETERSLLTEPLSDNSTLLKLVNQRFHTTLQDAGYRKTEYAYHPKLLEPVRNQLRWILDTLGNDQCGQRDTQFEVIHLENLRVFDALSLANPYLVGIPSLTALWGFIHAFDRKLKTLLGCEFTFESVAWHVRESSSVSGLKLPSPTLERKRSDHLKRPGIVESIHCDLVMDLAIRVHSTESFLQTRDELIDLIKAALPSRFAGGVIHPPSLYESKDWCSLRTTRSLHEHVSQLPATGRWIVPAKTAPKSFENLCELTELNMDLKPVMVGYQLLEEPTERPNSVSPVHAYAEPLIGLCDCKSPIDIRLKGEKYFNATCFWKMDVVGGSILMRRA

SEQ ID NO: 9128 - protein, 307 aa, Escherichia coli KTE33
MSYLLLLPHIRIENANAVSGLTWGFPAMTHFLGYVHALSRKVVDEFGVSFAGCAVVSHEQHIQAYSSGRDFQFALTRNPLTKEGKTASFNEEGRMHLTVSLLVECNGEITNGEYGRKALCDHLKVLCQSHKLAGGSIVSMRDPQLFHAPEDEKQLRKIIWRLMPGYALYDRSEWLAEHHQQHPDISLLDAWLDFAAIKYQAESPAEDNSAKWTYQPKPMPGFLVPLMCGYQRISPVYAPGEVENARDTVTPFAFAEAVYGIGEWRGLHRITDLQPLMWRYRTTDTGYYCSAIPLVDDPITHEDDDSE

SEQ ID NO: 9129 - protein, 294 aa, Acinetobacter sp. CIP 110321
MSRYVVIPRMRVQNANMQSNGLLLGGVPVFAANMFAHHLARQLGTQEQGIIYIHHDQQRLGGQAYGRFTPAQRRGAVFIGKKDYSSKNKYALSLQPTASCHLEFSLVIKFSSSRISPEKLTNILKRSRFAGGQIIDFLDITTHAENELETALKKIKTGFAILDRQDLLVEYQQRRQINRVQAFTQLLALKADALRAFFNDPNLSWISATNLGYALLEPLTDQRAGIRQAQDQETTAHAYAEPLTGIVQYFSLGEILRKNTEAEDDTWHNLQKLLWIYHWPQDDIFRLKQNCINA

SEQ ID NO: 9130 - protein, 327 aa, Pseudomonas aeruginosa PA14; identical to SEQ ID NO: 8627

SEQ ID NO: 9131 - protein, 327 aa, Pseudomonas aeruginosa MSH-10; identical to SEQ ID NO: 8627

SEQ ID NO: 9132 - protein, 71 aa, Escherichia coli KTE7; identical to SEQ ID NO: 8774

SEQ ID NO: 9133 - protein, 213 aa, Escherichia coli KTE7; identical to SEQ ID NO: 8623

SEQ ID NO: 9134 - protein, 71 aa, Escherichia coli KTE3; identical to SEQ ID NO: 8774

SEQ ID NO: 9135 - protein, 213 aa, Escherichia coli KTE3; identical to SEQ ID NO: 8623

SEQ ID NO: 9136 - protein, 307 aa, Escherichia coli KTE19
MSYLLLLPHIRIENANAVSGLTWGFPSMTHFLGYAHALSRKVVDEFGVSFDGCAVVSHEQHIQAYSSGRDFQFALTRNPLTREGKTASFNEEGRMHLTVSLLIECNGEITNGEYGRKVLCDYLKMLCQSHKLAGGSIVSMRDPQLFHAPEDEKQLRKIVWRLMPGYALYDRSEWLAEHHQQHPDISLLDAWLDFAAIKYQAESPAEDNSAKWVYQPKPMPGFLVPLMCGYQRISPVYAPGEVENARDTVTPFAFAEAVYGIGEWRGLHRTTDLQALMWRYRTTDTGYYCSATPVVDDFTFNEYDDLE

SEQ ID NO: 9137 - protein, 71 aa, Escherichia coli KTE27; identical to SEQ ID NO: 8774

SEQ ID NO: 9138 - protein, 213 aa, Escherichia coli KTE27; identical to SEQ ID NO: 8623

SEQ ID NO: 9139 - protein, 307 aa, Escherichia sp. KTE31; identical to SEQ ID NO: 9128

SEQ ID NO: 9140 - protein, 307 aa, Escherichia sp. KTE52
MSYLLLLPHVRIENANAVSGLTWGFPSMTHFLGYVHALSRKVVDEFGVSFDGCAVVSHEQHIQAYSSGRDFQFALTRNPLTREGKTASFNEEGRMHLTVSLLIECNGEITNGEYGRKALCDHLKMLCQSHKLAGGSIVDMREPQLFHAPEDEKQLRKIIWRLMPGYALYDRSEWLAEHHQQHPDISLLDAWLDFAAVKYQAESPAEDNSAQWVYQPKPMPGFLVPLMCGYQRISPVYAPGEVENARDTVMPFAFAEAVYGIGEWRGLHRITGLQPLMWRYRATDTGYYCSAIPVVDDPTTNEDDDTE

SEQ ID NO: 9141 - protein, 307 aa, Escherichia sp. KTE96; identical to SEQ ID NO: 9009

SEQ ID NO: 9142 - protein, 307 aa, Escherichia coli KTE89; identical to SEQ ID NO: 8828

SEQ ID NO: 9143 - protein, 307 aa, Escherichia coli KTE126; identical to SEQ ID NO: 8753

SEQ ID NO: 9144 - protein, 307 aa, Escherichia sp. KTE159
MSYLLLLPHVRIENANAVSGLTWGFPSMTHFLGYVHALSRKVVDEFGVSFDGCAVVSHEQHIQAYSSGRDFQFALTRNPLTREGKTASFNEEGRMHLTVSLLIECNGEITNGEYGRKALCDYLKMLCQSHKLAGGSIVDMREPQLFHAPEDEKQLRKIIWRLMPGYALYDRSEWLAEHHQQHPDISLLDAWLDFAAVKYQAESPAEDNSAQWVYQPKPMPGFLVPLMCGYQRISPVYAPGEVENARDTVMPFAFAEAVYGIGEWRGLHRITGLQPLMWRYRTTDTGYYCSAIPVVDDPTTNEDDDTE

SEQ ID NO: 9145 - protein, 71 aa, Escherichia coli KTE240; identical to SEQ ID NO: 8774

SEQ ID NO: 9146 - protein, 213 aa, Escherichia coli KTE240; identical to SEQ ID NO: 8623

SEQ ID NO: 9147 - protein, 307 aa, Escherichia coli KTE186; identical to SEQ ID NO: 8753

SEQ ID NO: 9148 - protein, 327 aa, Halomonas anticariensis FP35 = DSM 16096
MPDIHSLLVLPHLRVQNANAISSPMTWGFPAMSALVGLMHALERKLPVSLDIEFERVGVICHHFDAQVTQGGFTRAFHLTRNPIDKSGDTAAIVEEGRVHLELTLVFAVRGEVCHGSEEARDAAAKAVADIVAGMRIAGGSVMPSLSGQASRQRPALIPLDESDEERDAQFKRLRRRWLPGFALVLRDDLLAQRLSEMQQDRPDATALDAWLDLSRLNHECERIATTDEGGNPHDEIHWEIRRPPGWIVPIPIGYGALSDTFEPGTVANSRDTSTPFRFVESLYSVGQWISPHRLERPQDLLWYVDNDLDAGLYRLQNDYRTTNTIA

SEQ ID NO: 9149 - protein, 327 aa, Pasteurella multocida 1500E; identical to SEQ ID NO: 8732

SEQ ID NO: 9150 - protein, 372 aa, Delftia acidovorans CCUG 15835
MRQSPQPQAILTFPHLRVQNANAISSPLTHGFPSITAFTGLMWALERKLAQAGIPLRLHAVGVVCHHHQEQVRGSGKLYDPHTFHLRKPYVATADQARKLEEGTPPSIVEEGRIHLDISLVFAVSEKRAAGAAATLVQSAGPQMQQWADEAGQILSQMRVAGGSLLPSRAAPGRRVRPRLAVLAEDSTERSRQFREWRRQWLPGFALVGRDDLLADRLHRLRDKAAHTTLLDAWLHASRFNHEPVAAAEGQPPPADGKQPWADPWRGPGSGWIVPVPVGYAALSPSHAAGEVLNARDATTPLRFVESVYSLGEWISPHRLTHLEQLLWHAHTDEKRGLYRCRSGYVPDPAAGADPDDAAAQEQEGDDSYAYT

SEQ ID NO: 9151 - protein, 327 aa, Pasteurella multocida 2000
MFQTDFYILFDHIKVQSANAISGPLSYGFPALTGLTGAMHALNRKLTHHPVQFGGVMVACHDYELQTYQNSAFSDRTFKQTRNPIKRNGETASIIEEGKIHLDLSLVVEVHVQDDRVFEALTDKTSKASQDFLQTCKNLLWQQRIAGGSVLEIGNVQLFNLEEDQDIPLALMPAFVLMDAKQELTNITEELKTGLRIGQLDEEGNVQKSCLPSCPDATALDALLEMATVHHIPEHANATASAWQTYSVKKGRGWLVPLPVGYQAISPLFAPGQLQHCRTQQYPSQYVETLYSLGKWVFPLSLPENLSQCFWRYTALQNNLYLISQGE

SEQ ID NO: 9152 - protein, 327 aa, Pasteurella multocida P1933; identical to SEQ ID NO: 8732

SEQ ID NO: 9153 - protein, 327 aa, Pasteurella multocida 93002; identical to SEQ ID NO: 8732

SEQ ID NO: 9154 - protein, 327 aa, Pasteurella multocida RIIF; identical to SEQ ID NO: 8616

SEQ ID NO: 9155 - protein, 327 aa, Pasteurella multocida 671/90; identical to SEQ ID NO: 8706

SEQ ID NO: 9156 - protein, 327 aa, Pasteurella multocida 1500C; identical to SEQ ID NO: 8968

SEQ ID NO: 9157 - protein, 698 aa, Vibrio natriegens NBRC 15636 = ATCC 14048 = DSM 759
MIKLGDVLAIEKDEVKQATLKKVFMPYSQNIDIDGHEREALTVLINLSSHHKGSKCTDWLDIDRAKSYLSQEANVDLSLAEIKWFHTHNLKYPDCRVSAQRIIAEPLPAEGAFISSSGLPPSLGWAHNAASYRHTIWLLSSFCWQSRTVSIVSLIQQQNPVWLDLLQEFGLSVKSLNLISEEIELQLSSTTFPTEVNTYSKQLRFPWNGDYLSVTPVVSHAMQSELEHRQRSEDSHLKFVTMLLPNSASIGNLCGSVGGYMKVLNYPLDISPKVNRASSEQTLGASRQRNGRYFDDYQITNIRICEILNRLVGAEPLKTHKQRVKARKDQSKILRKQIALWMLPLIELRDRMVNDERERTMHGDQLIHDFLFLPERELSSLATSLNQKLHLVMQGNKFTRKFAYHPRLMQLIKAQIVWILDVLSKPQQQEGGCGAEEQYIYLSSLRVQDALAVSSPYLCGVPSLTAIWGFVHQYQRDFNTLTNGDAFYDFTGFAFYVRSQNIIATAKLTEPCSLAKARTLSNAKRSTIRGDRLADLEIDLVIRVQSRGRLSDCSSELKNALPVSFAGGSVFQPRISSKIDWLRTFCSRSSLLHILKGLPAYGSWLYPSERQPESFDELELMLLENENYLPVSNGYHLLEVPTQRKNSLTDLHAYVENTLSVANQVNPIEMRFSGRAPFFEQAFWSLECSPTTILIKKL

SEQ ID NO: 9158 - protein, 295 aa, Vibrio fluvialis PG41
MNVLILPHLKIHNANALSSPFTIGFPAMTAWLGFVHALERKLSQAGLSDLMLHSAAVVSHRCDVQTHKGEGDFVHSIIGTGNPLDKDGSRSAFIEEARCHLDVSLVIEWSGNEEQVQQPEFTEQLQAVIATMKVAGGDVLSIGKPSIKSVITEQDTAQVLRQLMPGYVLIERRDLMLEAMKQGADALDALLGYLTVHHHCEQLEDQSVVWHSQRKTSGWIVPIATGFQGISPLGTAKNQRDPSVPHRFAESVVTLGEFVMAHKIKHLDDILWQYNPDLENDLYLCQQVNAINEHQ

SEQ ID NO: 9159 - protein, 294 aa, Acinetobacter gerneri MTCC 9824; identical to SEQ ID NO: 9107

SEQ ID NO: 9160 - protein, 294 aa, Acinetobacter junii MTCC 11364; identical to SEQ ID NO: 9110

SEQ ID NO: 9161 - protein, 294 aa, Acinetobacter haemolyticus MTCC 9819; identical to SEQ ID NO: 9117

SEQ ID NO: 9162 - protein, 294 aa, Acinetobacter baumannii 1605; identical to SEQ ID NO: 8656

SEQ ID NO: 9163 - protein, 640 aa, Vibrio parahaemolyticus 10290; identical to SEQ ID NO: 8864

SEQ ID NO: 9164 - protein, 640 aa, Vibrio parahaemolyticus VP250; identical to SEQ ID NO: 8738

SEQ ID NO: 9165 - protein, 640 aa, Vibrio parahaemolyticus NIHCB0603; identical to SEQ ID NO: 8738

SEQ ID NO: 9166 - protein, 640 aa, Vibrio parahaemolyticus VP232; identical to SEQ ID NO: 8738

SEQ ID NO: 9167 - protein, 640 aa, Vibrio parahaemolyticus 949; identical to SEQ ID NO: 8738

SEQ ID NO: 9168 - protein, 327 aa, Pseudomonas aeruginosa WC55; identical to SEQ ID NO: 8627

SEQ ID NO: 9169 - protein, 213 aa, Escherichia coli HVH 1 (4-6876161); identical to SEQ ID NO: 8623

SEQ ID NO: 9170 - protein, 71 aa, Escherichia coli HVH 1 (4-6876161); identical to SEQ ID NO: 8774

SEQ ID NO: 9171 - protein, 213 aa, Escherichia coli HVH 3 (4-7276001); identical to SEQ ID NO: 8623

SEQ ID NO: 9172 - protein, 71 aa, Escherichia coli HVH 3 (4-7276001); identical to SEQ ID NO: 8774

SEQ ID NO: 9173 - protein, 71 aa, Escherichia coli HVH 5 (4-7148410); identical to SEQ ID NO: 8774

SEQ ID NO: 9174 - protein, 213 aa, Escherichia coli HVH 5 (4-7148410); identical to SEQ ID NO: 8623

SEQ ID NO: 9175 - protein, 307 aa, Escherichia coli HVH 9 (4-6942539); identical to SEQ ID NO: 8676

SEQ ID NO: 9176 - protein, 71 aa, Escherichia coli HVH 19 (4-7154984); identical to SEQ ID NO: 8774

SEQ ID NO: 9177 - protein, 213 aa, Escherichia coli HVH 19 (4-7154984); identical to SEQ ID NO: 8623

SEQ ID NO: 9178 - protein, 307 aa, Escherichia coli HVH 24 (4-5985145)
MSYLLLLPHIRIENANAVSGLTWGFPSMTHFLGYVHAISRKVVDEFGVSFDGCAVVSHEQHIQAYSSGRDFQFALTRNPLTREGKTASFNEEGRMHLTVSLLIECNGEITNGEYGRKVLCDYLKMLCQSHKLAGGSIVSMRDPQLFHAPEDEKQLRKIVWRLMPGYALYDRSEWLAEHHQQHPDISLLDAWLDFAAIKYQAESPAEDNSAQWVYQPKPMPGFLVPLMCGYQRISPVYAPGEVENARDTVTPFAFAEAVYGIGEWRGLHRTTDLQALMWRYRTTDTGYYCSATPVVDDFTFNEYDDLE

SEQ ID NO: 9179 - protein, 71 aa, Escherichia coli HVH 30 (4-2661829); identical to SEQ ID NO: 8774

SEQ ID NO: 9180 - protein, 213 aa, Escherichia coli HVH 30 (4-2661829); identical to SEQ ID NO: 8623

SEQ ID NO: 9181 - protein, 71 aa, Escherichia coli HVH 32 (4-3773988); identical to SEQ ID NO: 8774

SEQ ID NO: 9182 - protein, 213 aa, Escherichia coli HVH 32 (4-3773988); identical to SEQ ID NO: 8623

SEQ ID NO: 9183 - protein, 71 aa, Escherichia coli HVH 35 (4-2962667); identical to SEQ ID NO: 8774

SEQ ID NO: 9184 - protein, 213 aa, Escherichia coli HVH 35 (4-2962667); identical to SEQ ID NO: 8623

SEQ ID NO: 9185 - protein, 307 aa, Escherichia coli HVH 38 (4-2774682); identical to SEQ ID NO: 8828

SEQ ID NO: 9186 - protein, 71 aa, Escherichia coli HVH 42 (4-2100061); identical to SEQ ID NO: 8774

SEQ ID NO: 9187 - protein, 213 aa, Escherichia coli HVH 42 (4-2100061); identical to SEQ ID NO: 8623

SEQ ID NO: 9188 - protein, 71 aa, Escherichia coli HVH 48 (4-2658593); identical to SEQ ID NO: 8774

SEQ ID NO: 9189 - protein, 213 aa, Escherichia coli HVH 48 (4-2658593); identical to SEQ ID NO: 8623

SEQ ID NO: 9190 - protein, 71 aa, Escherichia coli HVH 59 (4-1119338); identical to SEQ ID NO: 8774

SEQ ID NO: 9191 - protein, 213 aa, Escherichia coli HVH 59 (4-1119338); identical to SEQ ID NO: 8623

SEQ ID NO: 9192 - protein, 71 aa, Escherichia coli HVH 73 (4-2393174); identical to SEQ ID NO: 8774

SEQ ID NO: 9193 - protein, 213 aa, Escherichia coli HVH 73 (4-2393174); identical to SEQ ID NO: 8623

SEQ ID NO: 9194 - protein, 71 aa, Escherichia coli HVH 76 (4-2538717); identical to SEQ ID NO: 8774

SEQ ID NO: 9195 - protein, 213 aa, Escherichia coli HVH 76 (4-2538717); identical to SEQ ID NO: 8623

SEQ ID NO: 9196 - protein, 71 aa, Escherichia coli HVH 80 (4-2428830); identical to SEQ ID NO: 8774

SEQ ID NO: 9197 - protein, 213 aa, Escherichia coli HVH 80 (4-2428830); identical to SEQ ID NO: 8623

SEQ ID NO: 9198 - protein, 71 aa, Escherichia coli HVH 102 (4-6906788); identical to SEQ ID NO: 8774

SEQ ID NO: 9199 - protein, 213 aa, Escherichia coli HVH 102 (4-6906788); identical to SEQ ID NO: 8623

SEQ ID NO: 9200 - protein, 71 aa, Escherichia coli HVH 104 (4-6977960); identical to SEQ ID NO: 8774

SEQ ID NO: 9201 - protein, 213 aa, Escherichia coli HVH 104 (4-6977960); identical to SEQ ID NO: 8623

SEQ ID NO: 9202 - protein, 71 aa, Escherichia coli HVH 118 (4-7345399); identical to SEQ ID NO: 8774

SEQ ID NO: 9203 - protein, 213 aa, Escherichia coli HVH 118 (4-7345399); identical to SEQ ID NO: 8623

SEQ ID NO: 9204 - protein, 307 aa, Escherichia coli HVH 125 (4-2634716); identical to SEQ ID NO: 8753

SEQ ID NO: 9205 - protein, 71 aa, Escherichia coli HVH 126 (4-6034225); identical to SEQ ID NO: 8774

SEQ ID NO: 9206 - protein, 213 aa, Escherichia coli HVH 126 (4-6034225); identical to SEQ ID NO: 8623

SEQ ID NO: 9207 - protein, 71 aa, Escherichia coli HVH 127 (4-7303629); identical to SEQ ID NO: 8774

SEQ ID NO: 9208 - protein, 213 aa, Escherichia coli HVH 127 (4-7303629); identical to SEQ ID NO: 8623

SEQ ID NO: 9209 - protein, 213 aa, Escherichia coli HVH 137 (4-2124971); identical to SEQ ID NO: 8623

SEQ ID NO: 9210 - protein, 71 aa, Escherichia coli HVH 137 (4-2124971); identical to SEQ ID NO: 8774

SEQ ID NO: 9211 - protein, 213 aa, Escherichia coli HVH 170 (4-3026949); identical to SEQ ID NO: 8623

SEQ ID NO: 9212 - protein, 71 aa, Escherichia coli HVH 170 (4-3026949); identical to SEQ ID NO: 8774

SEQ ID NO: 9213 - protein, 71 aa, Escherichia coli HVH 180 (4-3051617); identical to SEQ ID NO: 8774

SEQ ID NO: 9214 - protein, 213 aa, Escherichia coli HVH 180 (4-3051617); identical to SEQ ID NO: 8623

SEQ ID NO: 9215 - protein, 71 aa, Escherichia coli HVH 191 (3-9341900); identical to SEQ ID NO: 8774

SEQ ID NO: 9216 - protein, 213 aa, Escherichia coli HVH 191 (3-9341900); identical to SEQ ID NO: 8623

SEQ ID NO: 9217 - protein, 71 aa, Escherichia coli HVH 192 (4-3054470); identical to SEQ ID NO: 8774

SEQ ID NO: 9218 - protein, 213 aa, Escherichia coli HVH 192 (4-3054470); identical to SEQ ID NO: 8623

SEQ ID NO: 9219 - protein, 213 aa, Escherichia coli HVH 196 (4-4530470); identical to SEQ ID NO: 8623

SEQ ID NO: 9220 - protein, 71 aa, Escherichia coli HVH 196 (4-4530470); identical to SEQ ID NO: 8774

SEQ ID NO: 9221 - protein, 307 aa, Escherichia coli HVH 198 (4-3206106); identical to SEQ ID NO: 8753

SEQ ID NO: 9222 - protein, 213 aa, Escherichia coli HVH 199 (4-5670322); identical to SEQ ID NO: 8623

SEQ ID NO: 9223 - protein, 71 aa, Escherichia coli HVH 199 (4-5670322); identical to SEQ ID NO: 8774

SEQ ID NO: 9224 - protein, 71 aa, Escherichia coli HVH 201 (4-4459431); identical to SEQ ID NO: 8774

SEQ ID NO: 9225 - protein, 213 aa, Escherichia coli HVH 201 (4-4459431); identical to SEQ ID NO: 8623

SEQ ID NO: 9226 - protein, 71 aa, Escherichia coli HVH 203 (4-3126218); identical to SEQ ID NO: 8774

SEQ ID NO: 9227 - protein, 213 aa, Escherichia coli HVH 203 (4-3126218); identical to SEQ ID NO: 8623

SEQ ID NO: 9228 - protein, 71 aa, Escherichia coli HVH 211 (4-3041891); identical to SEQ ID NO: 8774

SEQ ID NO: 9229 - protein, 213 aa, Escherichia coli HVH 211 (4-3041891); identical to SEQ ID NO: 8623

SEQ ID NO: 9230 - protein, 71 aa, Escherichia coli HVH 217 (4-1022806); identical to SEQ ID NO: 8774

SEQ ID NO: 9231 - protein, 213 aa, Escherichia coli HVH 217 (4-1022806); identical to SEQ ID NO: 8623

SEQ ID NO: 9232 - protein, 71 aa, Escherichia coli HVH 222 (4-2977443); identical to SEQ ID NO: 8774

SEQ ID NO: 9233 - protein, 213 aa, Escherichia coli HVH 222 (4-2977443); identical to SEQ ID NO: 8623

SEQ ID NO: 9234 - protein, 213 aa, Escherichia coli KOEGE 32 (66a); identical to SEQ ID NO: 8623

SEQ ID NO: 9235 - protein, 71 aa, Escherichia coli KOEGE 32 (66a); identical to SEQ ID NO: 8774

SEQ ID NO: 9236 - protein, 307 aa, Escherichia coli KOEGE 56 (169a); identical to SEQ ID NO: 8753

SEQ ID NO: 9237 - protein, 71 aa, Escherichia coli UMEA 3041-1; identical to SEQ ID NO: 8774

SEQ ID NO: 9238 - protein, 213 aa, Escherichia coli UMEA 3041-1; identical to SEQ ID NO: 8623

SEQ ID NO: 9239 - protein, 307 aa, Escherichia coli UMEA 3117-1; identical to SEQ ID NO: 8676

SEQ ID NO: 9240 - protein, 213 aa, Escherichia coli UMEA 3140-1; identical to SEQ ID NO: 8623

SEQ ID NO: 9241 - protein, 71 aa, Escherichia coli UMEA 3140-1; identical to SEQ ID NO: 8774

SEQ ID NO: 9242 - protein, 71 aa, Escherichia coli UMEA 3162-1; identical to SEQ ID NO: 8774

SEQ ID NO: 9243 - protein, 213 aa, Escherichia coli UMEA 3162-1; identical to SEQ ID NO: 8623

SEQ ID NO: 9244 - protein, 71 aa, Escherichia coli UMEA 3203-1; identical to SEQ ID NO: 8774

SEQ ID NO: 9245 - protein, 213 aa, Escherichia coli UMEA 3203-1; identical to SEQ ID NO: 8623

SEQ ID NO: 9246 - protein, 71 aa, Escherichia coli UMEA 3206-1; identical to SEQ ID NO: 8774

SEQ ID NO: 9247 - protein, 213 aa, Escherichia coli UMEA 3206-1; identical to SEQ ID NO: 8623

SEQ ID NO: 9248 - protein, 307 aa, Escherichia coli UMEA 3221-1; identical to SEQ ID NO: 8753

SEQ ID NO: 9249 - protein, 307 aa, Escherichia coli UMEA 3230-1; identical to SEQ ID NO: 8753

SEQ ID NO: 9250 - protein, 307 aa, Escherichia coli UMEA 3391-1; identical to SEQ ID NO: 8828

SEQ ID NO: 9251 - protein, 213 aa, Escherichia coli UMEA 3632-1; identical to SEQ ID NO: 8623

SEQ ID NO: 9252 - protein, 71 aa, Escherichia coli UMEA 3632-1; identical to SEQ ID NO: 8774

SEQ ID NO: 9253 - protein, 71 aa, Escherichia coli UMEA 3662-1; identical to SEQ ID NO: 8774

SEQ ID NO: 9254 - protein, 213 aa, Escherichia coli UMEA 3662-1; identical to SEQ ID NO: 8623

SEQ ID NO: 9255 - protein, 71 aa, Escherichia coli UMEA 3702-1; identical to SEQ ID NO: 8774

SEQ ID NO: 9256 - protein, 213 aa, Escherichia coli UMEA 3702-1; identical to SEQ ID NO: 8623

SEQ ID NO: 9257 - protein, 71 aa, Escherichia coli UMEA 3893-1; identical to SEQ ID NO: 8774

SEQ ID NO: 9258 - protein, 213 aa, Escherichia coli UMEA 3893-1; identical to SEQ ID NO: 8623

SEQ ID NO: 9259 - protein, 71 aa, Escherichia coli UMEA 3834-1; identical to SEQ ID NO: 8774

SEQ ID NO: 9260 - protein, 213 aa, Escherichia coli UMEA 3834-1; identical to SEQ ID NO: 8623

SEQ ID NO: 9261 - protein, 213 aa, Escherichia coli HVH 210 (4-3042480); identical to SEQ ID NO: 8623

SEQ ID NO: 9262 - protein, 71 aa, Escherichia coli HVH 210 (4-3042480); identical to SEQ ID NO: 8774

SEQ ID NO: 9263 - protein, 71 aa, Escherichia coli UMEA 3298-1; identical to SEQ ID NO: 8774

SEQ ID NO: 9264 - protein, 213 aa, Escherichia coli UMEA 3298-1; identical to SEQ ID NO: 8623

SEQ ID NO: 9265 - protein, 695 aa, Pseudoalteromonas arctica A 37-1-2
MHLKELLEITDIAERDRLIRRAFNPYTTTIDITGCEGNTLIILLNLTYRKNQVDDLLDKQLAKQALKSEEHINKCIKEIAWFHTHNLKYPDIRVSKQNLAVAPPLLDSYVLSSANYPKAYGWSHDSAKVNFAKLFVSYFKWQNQDSCLAQVLATNSDNWKAAFTSLGLSVKAFKSLCVTVKKSLPEEAIPDSVDRYSRQIRMPYHDGYLAVTPVISHVVQSKIQQAAIDKRARFSNVEFTRPAAVSLLAASLGGVVNVLNYPPKILNKYHGLSSSRQFKLNNGQTVFNVGALLKPEFIKALEGIIFSNNALALKQRRQQKVKNIRDVRSTLLEWFSPIYEWRLDIIETEVGLEQLEGTSDQLEYKILSLSDDELPLLTIPLFRLLNEMLSDVSMTQRYAFHPQLMSPLKAALQWLLINLTDQKNELIEEDDEHYRYLHLSGIRVFDAQALSNPYCSGIPSLTAVWGMLHSYQRKLNEALGINVRFTSFSWFIRDYSAVAGKKLPELSLQGAQQNKLKRPGIIDGKYCDLIFDLIIHIDGYEDDLQTVDSEPDILKAYFPSTFAGGVMHQPQLSSNVNWCYLYSNENQLFEKLKRLPLSGCWVMPNDHKIEDLDELLLLLNNDSKLSPSMMGYMLLTEPMARVGALERLHCYAEPAIGVVKYETAISVRLKGIGNYFNSAFWVLDAQEKFMLMKKV

SEQ ID NO: 9266 - protein, 316 aa, Pseudoalteromonas citrea DSM 8771
MIGEVKKLLIIPHLHIHNANALSSPFTIGFPAMTAWLGAVHALQRKLNVKNIPVKFNAVGVVSHDIDLQTYKGENDFVHSIIGTANPLDKTGARSAFIEEARCHLDVSLLIEFDDISVDEREQLLTEMTHLLHAKMKIAGGDIKGFQPPFCLNATEGNDEELQHVQRSLMPGFVLIERRELMMAAMGGGQDALTALTEYLTIHHSCEVDGNGNVTWKKHRKLADEKSVGWIVPIATGFYGISAQAEAKNQRDPDTPHRFAESLVTLGEFKMPHRIHFVEQMLWRYHTQDDYYLCQQKHFMEAEDPDLSEATIESEF

SEQ ID NO: 9267 - protein, 683 aa, Pseudoalteromonas spongiae UST010723-006
MELNTLLQNTPIKELTQTLRVAFAPYSEYIDTTGSEFQALVVLINLTYKRKDIKDLTSMSAAKAVLRDEQHLKTCIDEVKWYHTHNLKYPDIRVSHQRLLAQVVDDGHRVVSSSRYPAQFGWSHDSAKINHAKLFLRGFIWRGEYVCLAQLLAKQEGFWVEQFSELGLLKKDVITVCEQIAAQLPNEDLPEQISNYTPQLLIPIEHDYLSVSPVVSHAVLAVMQTATRSGLLKRGIIEHNRPVNVGELPSALGGRVNVLKYFVKTYSATTVNNYYSQDEQRLFNVSLLNSKTLSEALLVLSKSKPFNTLRQKRLARVAAIKVLRTALYGWLEKLIKLVQSETINDSDSELVKLLATKEYKQLELTLSQELNKQMNGLKYLKRYAYHPKLMPILKAQLSYVLSHQNNQEGELEAEHIKYVHCQNLRVYNAEAMPNPYIMGMPSITALEGLGHQFQRKLQKLVGSGVHVIGVAVYIRSYQLHNHKQLPEPNKLKKDGQKREPLRSAIMQIPKCDICFDLVFRVQTKNQAVANDLSENLLKAAFPSRYAGGTLHPPSLYVQVDWCQVYAKPLALFERIRSLPKGGSWLYPTSVEVSSFEELAEQLTLRPTMRPAALGYLALEEPKPRQGSITQLHCYVEPVIGLLECVDAVTARLSGARHFFNHGFWTMHCKKASMLMKKSKFEYD

SEQ ID NO: 9268 - protein, 683 aa, Pseudoalteromonas undina DSM 6065
MNLQDALAIESLKEKTTALRKLFAPYTPHVAVDGFEEQVLVVLINLVYKRSEIDDLTSVRTAKSVLLDEVLLSKCINEVKWFHTHNLKYPDIRVSHQRLISKVVSEDIAGICSRSLPLSFGWSHNSAEINHAKLFLTSFNWQGEVTCLAKLLIAEEPVWINLIRGYGFTKKAVLDISGKIKQLLPVAELPLEVSSFSPQLQMPFQQSYLAVTPVVSHAMLAKIQQLTTDRKLNFGFVEHSRPANVGDLASSVGGNIRVLRYFPKTYSKAVNRSKVANNYIEKAFKVRALLSSQFQQALLVLVGIKQFNTLRQKRLARVAAIRQVRVSLQLWLDNILEAKNNAQGQAYPEWAKHYLDQSITNCISQFSNVLNESLGTLSKLKRFAYHPNLMGLFKMQLNYVFTHCVAEEETLNDEQVVYVHCQDMRVFDAEAMANPYIQGMPSLTALNGLAHNFERKLKNFIDPSIKCIGSAIYIENYQLHTGKPLPEPSKLKQVAGRSHVIRTGIIDKPKCDITLDLVFRLFVPNTELLDKLNSQLIKPALPSSFAGGTMHPPSLYQNINWCHVYSKPSELFKSLKVKSSNGSWLYPSKKVVKSFEQLIDALNSNFNLRPAAIGFAALEEPVKRDAALHEYHCYAEPVIGLLECVSNTSVKYAGAKQFFHDAFWVMDVQKESMLMKKSKFEYE

SEQ ID NO: 9269 - protein, 294 aa, Acinetobacter baumannii EGD-HP18
MSRYVVIPRMRVQNANMQTNGVLLGGVPLFAANMFAHHLARQLGTQDEGIIYIHHDQQRLGGQAYGRFTPAQRRGAVFIGKKDYSSKNKYALSLQPTASCHLEFSLVIKFSSSRISPEKLTNILKRSRFAGGQIIEFLEITTHAENELETALKKIKTGFAILDRQDLLIEYQQRKQINRVQAFTQLLALKVDALRTFFNDQNLSWISATNLGYALLEPLTDQRAGIRQAQDQETTAHAYAEPLTGIVQYFSLGEILRKNTETEDDTWHNLQKLLWTYHWPQDDIFLLKQNCINA

SEQ ID NO: 9270 - protein, 327 aa, Pasteurella multocida subsp. multocida str. PMTB; identical to SEQ ID NO: 8968

SEQ ID NO: 9271 - protein, 327 aa, Pseudomonas aestus
MAECPHFEHLLVIPHLQVQNANSLSSPLTHGFPSITAFLGLMWALERKTVDTGLDLQFNAVGVVVHDHEEQVTAGNFVNTLRLTRNPLNRDGSTAAIVEEGRVHLRISLVFAVQSQALDDQRSTVARQVRELLLQMRIAGGSLIPSRAPQGQQQPYSIPMTGDEEARDVLFYQAKLRLLPGFTLVERQDLLEQRHRDLQARQPGASVLDAWLSLARINWSSVAPAADGEASGPVQWRNDRTDLGWLVPIPVGYGALTALQAPGTVARARDSQTAFRFVENLYGIGQWISPHRLQSPQQLLWYADSRSDQGLYRCRNDYRAPSLAHLD

SEQ ID NO: 9272 - protein, 295 aa, Vibrio cholerae HC-36A1; identical to SEQ ID NO: 8873

SEQ ID NO: 9273 - protein, 316 aa, Yersinia pestis S3; identical to SEQ ID NO: 53

SEQ ID NO: 9274 - protein, 316 aa, Yersinia pestis 24H; identical to SEQ ID NO: 53

SEQ ID NO: 9275 - protein, 316 aa, Yersinia pestis 113; identical to SEQ ID NO: 53

SEQ ID NO: 9276 - protein, 316 aa, Yersinia pestis 9; identical to SEQ ID NO: 53

SEQ ID NO: 9277 - protein, 320 aa, Photorhabdus temperata J3
MSYLIVLRHVKVENANAIAGLTYGFPAITHFLGFTHALSRKLQQNHDLRLENCGVICHNHQLHAYQSDPIRDKVFALTRNPLTKEAKTAAFNEEGRMHMTVSLLIECLGEIENGDEGSRNLEKHLWEICQTQRLAGGTITEIAKVDVIAFPQREQETRKLMRRLLPGFVLLDRSELLANHYDALKQSNPQAEMIDAWLDFTAIKMRAIPIQEDKQPEVGDPASWEYVPKPGSGYLVPLMTGYQAISPLYPAGKVEKTRDPNTPFCFVEAIYGVGEWRSPHRINDIRQLLWCHHYQEGVYRCCNQQSVIHQSKPNKEVRID

SEQ ID NO: 9278 - protein, 299 aa, Megasphaera sp. BV3C16-1
MKQYLLISRLKIHNANAMSSQYTIGFPAMTGWLGAVHALQRQLHSHGFSRIRLPRVAVSCHNCDVQLYRGPHDYKNSVIGTANPLKKSKKTGNYERPPFIEEARCHLSVTLLIEIEGYDPDTEDELLEVIHRQLPGLKICGGDIENNVEQMHIQIEVIDENDKCDQRALRRKLMPGYVVIERKDLMEAAKGNGDALDQLLSCLCVRHSADPDKDGKIKQWIGRRDGSEGWIVPLAVGFNDITGAIKAAYQRDERYEHHFVEPIVTLGEFIMPYRFDSVEAMMWQYRYDRENGLYLCECS

SEQ ID NO: 9279 - protein, 327 aa, Pseudomonas aeruginosa C23
MSVTDPEALLLLPRLSIQNANAISSPLTWGFPSPGAFTGFVHALQRRVGISLDIELDGVGIVCHRFEAQISQPAGKRTKVFNLTRNPLNRDGSTAAIVEEGRAHLEVSLLLGVHGDGLDDHPAQEIARQVQEQAGAMRLAGGSILPWCNERFPAPNAELLMLGGSDEQRRKNQRRLTRRLLPGFALVSREALLQQHLETLRTTLPEATTLDALLDLCRINFEPPATSSEEEASPPDAAWQVRDKPGWLVPIPAGYNALSPLYLPGEVRNARDGETPLRFVENLFGLGEWLSPHRVAALSDLLWYHHAEPDKGLYRWSTPRFVEHAIA

SEQ ID NO: 9280 - protein, 327 aa, Pseudomonas aeruginosa C20; identical to SEQ ID NO: 9279

SEQ ID NO: 9281 - protein, 327 aa, Pseudomonas aeruginosa M8A.1
MSVTDPEALLLLPRLSIQNANAISSPLTWGFPSPGAFTGFVHALQRRVGISLDIELDGVGIVCHRFEAQISQPAGKRTKVFNLTRNPLNRDGSTAAIVEEGRAHLEVSLLLGVHGDGLDDHPAQEIARQVQEQAGAMRLAGGSILPWCNERFPAPNAELLMLGGSDEQRRKNQRRLTRRLLPGFALVSREALLQQHLETLRTTLPEATTLDALLDLCRINFEPPATSSEEEASPPDAAWQVRDKPGWLVPIPAGYNALSPLYLPGEVRNARDRETPLRFVENLFGLGEWLSPHRVAALSDLLWYHHVEPDKGLYRWSTPRFVEHAIA

SEQ ID NO: 9282 - protein, 327 aa, Pseudomonas aeruginosa BL15; identical to SEQ ID NO: 8627

SEQ ID NO: 9283 - protein, 327 aa, Pseudomonas aeruginosa BL16; identical to SEQ ID NO: 8627

SEQ ID NO: 9284 - protein, 327 aa, Pseudomonas aeruginosa BL10
MSVTDPEALLLLPRLSIQNANAISSPLTWGFPSPGAFTGFVHALQRRVGISLDIELDGVGIVCHRFEAQISQPAGKRTKVFNLTRNPLNRDGSTAAIVEEGRTHLEVSLLLGVHGDGLDDHPAQEIARQVQEQAGAMRLAGGSILPWCNERFPAPNAELLMLGGSDEQRRKNQRRLTRRLLPGFALVSREALLQQHLETLRTTLPEATTLDALLDLCRINFEPPATSSEEEASPPDAAWQVRDKPGWLVPIPAGYNALSPLYLPGEVRNARDRETPLRFVENLFGLGEWLSPHRVATLSDLLWYHHAEPDKGLYRWSTPRFVEHAIA

SEQ ID NO: 9285 - protein, 327 aa, Pseudomonas aeruginosa BWHPSA028; identical to SEQ ID NO: 8627

SEQ ID NO: 9286 - protein, 327 aa, Pseudomonas aeruginosa BWHPSA027; identical to SEQ ID NO: 8627

SEQ ID NO: 9287 - protein, 327 aa, Pseudomonas aeruginosa BWHPSA024; identical to SEQ ID NO: 9279

SEQ ID NO: 9288 - protein, 327 aa, Pseudomonas aeruginosa BWHPSA021; identical to SEQ ID NO: 9284

SEQ ID NO: 9289 - protein, 327 aa, Pseudomonas aeruginosa BWHPSA023; identical to SEQ ID NO: 9279

SEQ ID NO: 9290 - protein, 327 aa, Pseudomonas aeruginosa BWHPSA020
MSVTDPEALLLLPRLSIQNANAISSPLTWGFPSPGAFTGFVHALQRRVGISLDIELDGVGIVCHRFEAQISQPAGKRTKVFNLTRNPLNRDGYTAAIVEEGRAHLEVSLLLGVHGDGLDDHPAQEIARQVQEQAGAMRLAGGSILPWCNERFPAPNAELLMLGGSDEQRRKNQRRLTRRLLPGFALVSREALLQQHLETLRTTLPEATTLDALLDLCRINFEPPATSSEEEASPPDAAWQVRDKPGWLVPIPAGYNALSPLYLPGEVRNARDRETPLRFVENLFGLGEWLSPHRVAALSDLLWYHHAEPDKGLYRWSTPRFVEHAIA

SEQ ID NO: 9291 - protein, 327 aa, Pseudomonas aeruginosa BWHPSA014; identical to SEQ ID NO: 9284

SEQ ID NO: 9292 - protein, 327 aa, Pseudomonas aeruginosa BWHPSA012; identical to SEQ ID NO: 9284

SEQ ID NO: 9293 - protein, 327 aa, Pseudomonas aeruginosa BWHPSA005; identical to SEQ ID NO: 9279

SEQ ID NO: 9294 - protein, 327 aa, Pseudomonas aeruginosa BWHPSA004; identical to SEQ ID NO: 9284

SEQ ID NO: 9295 - protein, 327 aa, Pseudomonas aeruginosa BWHPSA001; identical to SEQ ID NO: 9281

SEQ ID NO: 9296 - protein, 327 aa, Pseudomonas aeruginosa UDL; identical to SEQ ID NO: 9279

SEQ ID NO: 9297 - protein, 327 aa, Pseudomonas aeruginosa CF18; identical to SEQ ID NO: 9281

SEQ ID NO: 9298 - protein, 327 aa, Pseudomonas aeruginosa MSH3; identical to SEQ ID NO: 8627

SEQ ID NO: 9299 - protein, 327 aa, Pseudomonas aeruginosa E2; identical to SEQ ID NO: 8627

SEQ ID NO: 9300 - protein, 327 aa, Pseudomonas aeruginosa BL02; identical to SEQ ID NO: 9279

SEQ ID NO: 9301 - protein, 327 aa, Pseudomonas aeruginosa BWHPSA010; identical to SEQ ID NO: 8627

SEQ ID NO: 9302 - protein, 327 aa, Pseudomonas aeruginosa BWHPSA008; identical to SEQ ID NO: 8627

SEQ ID NO: 9303 - protein, 327 aa, Pseudomonas aeruginosa BWHPSA009; identical to SEQ ID NO: 9281

SEQ ID NO: 9304 - protein, 327 aa, Pseudomonas aeruginosa CF5; identical to SEQ ID NO: 9279

SEQ ID NO: 9305 - protein, 327 aa, Pseudomonas aeruginosa MSH10; identical to SEQ ID NO: 8627

SEQ ID NO: 9306 - protein, 307 aa, Escherichia coli 908519; identical to SEQ ID NO: 8676

SEQ ID NO: 9307 - protein, 213 aa, Escherichia coli 908675; identical to SEQ ID NO: 8623

SEQ ID NO: 9308 - protein, 71 aa, Escherichia coli 908675; identical to SEQ ID NO: 8774

SEQ ID NO: 9309 - protein, 294 aa, Acinetobacter gyllenbergii NIPH 230
MRHFLLISHLKLHNANAMSSPYTIGFPAMTAWLGAVHALQRKLQAKACDVALTKVAVSCHEFNLQTYKGRGDFVHSIIGTANPLDKDGSRPAFIEEARCHLEVSLLVEIEGLNNKKREQLLELASELICSMKFASGDVLTVKNCQILDFDDDEDHDRELKPILNKLMLGHVLIERRDLVIDSMNQGKDALNAVLEYLHVTHSSNVDEDNKVTWTSKRKAQGWLVPVAVGFQGISELGFAKNQRDANTPHRFAESVLALGEFLMPYRIEHLDQMLWQYHFDSENNLYLCQNATTN

SEQ ID NO: 9310 - protein, 295 aa, Acinetobacter tjernbergiae DSM 14971 = CIP 107465
MRHFLLISHLKLHNANAMSSPYTIGFPAMTAWLGAVHALQRKLQTKMCDVTVTKVAISCHEFHLQTYKGQGDFVHSIIGTANPLDKDGSRPAFIEEARCHLEASLLIEVENLNIKKRERLLELIPDLVCSMKFASGDVLAVKDYQIIDFDDEDENQDKELRPILNKLMLGHVIIERRDLVIESMNEGKDALDAVLDYLKVTHSSSLDDDGKVTWTSKRKAQGWLVPIAVGFQGVSELGQAKNQRDANTPHRFAESVLTLGEFVMPYRIEHIDQLLWKYYVDLENNLYLCQNQTTT

SEQ ID NO: 9311 - protein, 311 aa, Klebsiella oxytoca MGH 42
MSYLLLLPHIRIENANAVAGLTWGFPAITHFLGYVHALSRRVSEFGVSFTGCAVINHEHHIQAYSSGRDYQFALTRNPLTKEGKTAAFNEEGRMHLTVSLLVECQGEIINGEYGKAALCSSLLTLCQSHKLAGGSIVMMREPQIFNAPDDERTLRKILWRLMPGFALCDRSEWLMEHYRQLQQRRPESSLLDAWLDFAAIKYQPVQQEPEDSVSWEYQPKPKPGYLVPLMCGYQRISRLYQPGEVANVRDTATPFAFTEAVYGVGEWRGLHRIADLEPLIWRYRTSDTGYYCSAMPVADDDFIFNEDDDLE

SEQ ID NO: 9312 - protein, 311 aa, Enterobacter roggenkampii MGH 34
MSSLILLRRVRVENANAIAGMTYGFPAITHFLGFTHVLSRRLKETHGLRIDGCAVVSHEHQIHAHTSGRDYQFALTRNPLTRDAKTASFNEEGRMHMTVSLLLECHGEIPNGEYGQRDLAEHLRQVCPTLRLAGGIIVDIQDISVMAMPASAQEMGRLTWQLMPGFALRDRSSWLGEHHTTLLEHNPDATLLDAWLDFAALKIQAETPEDSDIQEGDPANWHVVPKPNPGYLVPLMTGYQRISELYAPGVVANARDAETPFAFTEAVYGVGEWCGLHRIRSLDEIFWRYRTTETGYYCQGAGAPVISELIN

SEQ ID NO: 9313 - protein, 311 aa, Klebsiella oxytoca MGH 28; identical to SEQ ID NO: 9311

SEQ ID NO: 9314 - protein, 311 aa, Enterobacter sp. MGH 23
MSSLILLRRVRVENANAIAGLTWGFPAITHFLGFAHALSRRLTETHGLRIDGCAVVSHEHQVHAHTSGRDYQFALTRNPLTREANTASFNEEGRMHMTVSLLLECQGEIPNGEYGQRDLAEYLSQVCPTLRLAGGIVVDVEAFTVMAMPSTDREMRRLQWLLMPGFALRDRSSWLVQHHQTLLENHPDATLLDAWLDFAALKIQAEMPEDGNLREGEPADWHVVPKPNPGYLVPLMTGYQRISELYAPGVVENARDAETPFAFTEAVYGVGEWCGLHRIRSLDEIFWRYRTTETGYYCQGAGAPVTSEPLN

SEQ ID NO: 9315 - protein, 311 aa, Enterobacter sp. MGH 22; identical to SEQ ID NO: 9314

SEQ ID NO: 9316 - protein, 311 aa, Serratia sp. ATCC 39006
MSTLIVFRRIRVENANAIAGLTYGFPAITHFLGFTHALSRQLQASHGLTLEGCGVVSHQHQLHAYGSSWERSFALTRNPLTKEANTAAFNEEGRMHMTVSLLVVCEGQLLADIAALREHLTQLARCQRLAGGTIVDMDRVTIQPLPETAAETRVVMRRLLPGFVLCDRTALLHHHFQTQQETNPQAEMLDAWLDFAALKMRAIPSSEENHAMQWQHVPKPGEGGFLVPLMIGYRAISPIYSPGEVDKTRDQHTPFCFAEAIYGIGEWQGAHRIQDIRHILWEYDYQDGNYHCHQPAGNVTESEELEYDIDD

SEQ ID NO: 9317 - protein, 213 aa, Escherichia coli HVH 12 (4-7653042); identical to SEQ ID NO: 8623

SEQ ID NO: 9318 - protein, 71 aa, Escherichia coli HVH 12 (4-7653042); identical to SEQ ID NO: 8774

SEQ ID NO: 9319 - protein, 71 aa, Escherichia coli HVH 148 (4-3192490); identical to SEQ ID NO: 8774

SEQ ID NO: 9320 - protein, 213 aa, Escherichia coli HVH 148 (4-3192490); identical to SEQ ID NO: 8623

SEQ ID NO: 9321 - protein, 213 aa, Escherichia coli HVH 178 (4-3189163); identical to SEQ ID NO: 8623

SEQ ID NO: 9322 - protein, 71 aa, Escherichia coli HVH 178 (4-3189163); identical to SEQ ID NO: 8774

SEQ ID NO: 9323 - protein, 327 aa, Pasteurella multocida subsp. multocida P1062; identical to SEQ ID NO: 8732

SEQ ID NO: 9324 - protein, 307 aa, Escherichia coli CE418; identical to SEQ ID NO: 8800

SEQ ID NO: 9325 - protein, 640 aa, Vibrio parahaemolyticus 10296; identical to SEQ ID NO: 8864

SEQ ID NO: 9326 - protein, 640 aa, Vibrio parahaemolyticus 12310; identical to SEQ ID NO: 8864

SEQ ID NO: 9327 - protein, 108 aa, Escherichia coli ATCC BAA-2209
QAESPAEDNSAQWVYQPKPMPGFLVPLMCGYQRISPVYAPGEVENARDTVMPFAFAEAVYGIGEWRGLHRITGLQPLMWRYRTTDTGYYCSAIPVVDDPTTNEDDDTE

SEQ ID NO: 9328 - protein, 84 aa, Escherichia coli ATCC BAA-2209
RMHLTVSLLIECNGEITNGEYGRKALCDYLKMLCQSHKLAGGSIVDMREPQLFHAPEDEKQLRKIIWRLMPGYALYDRSEWLAE

SEQ ID NO: 9329 - protein, 65 aa, Escherichia coli ATCC BAA-2209
MSYLLLLPHVRIENANAVSGLTWGFPSMTHFLGYVHALSRKVVDEFGVSFDGCAVVSHEQHIQAY

SEQ ID NO: 9330 - protein, 71 aa, Escherichia coli HVH 214 (4-3062198); identical to SEQ ID NO: 8774

SEQ ID NO: 9331 - protein, 213 aa, Escherichia coli HVH 214 (4-3062198); identical to SEQ ID NO: 8623

SEQ ID NO: 9332 - protein, 683 aa, Pseudoalteromonas agarivorans
MNLQDALAIEPLKEKTTTLRKLFAPHTPHVAVDGFEEQALTVLINLVYKRSEIDDLTSVRAAKSVLRDEVLLSKCINEVKWFHTHNLKYPDIRVSHQRLLSKVVSEDIAGICSRSLSLSFGWSHNSAEINHAKLFLTSFSWQGELTCLAKLLITEEPVWINLIRGYGFTKKAVLDIAGKIKQQLPVVELPLEVSSFSPQLQMPYQQSYLAVTPVVSHAMLAKIQQLTTERKLNFALVEHSRPANVGDLASSVGGNIRVLRYFPKTYSKAVNRSKVADNDIEKAFKIRALLSSQFQQALLVLVGIKQFSTLRQKRLARVAAIRQVRVSLQLWLDNILEAKNNAQNQAYPEWAKHYLDQNITNCISQFSNILNESLGTLSKLKRFAYHPNLMGLFKTQLNYVFTHCTTEQETLNDEQIVYVHCQDMRVFDAEAMANPYIQGMPSLTALNGLAHNFERKLKNFIDPSIKCIGSAIYIENYQLHTGKPLPEPNKLKQVAGRSHVIRSGIIDKPKCDITLDLVFRLFVPNTELLDKLNSQLIKPALPSSFAGGTMHPPSLYQNINWCHVYSKPSELFKSLKVKSLNGSWLYPSKKVVKSFEQLIDALNGNFNLRPAAIGFAALEEPVKRDAALHEYHCYAEPVIGLLECVSNTSVKYAGAKQFFHNAFWIMDVQKESMLMKKSKFEYE

SEQ ID NO: 9333 - protein, 166 aa, Vibrio parahaemolyticus EKP-008
MKVAGGDILSLQRPVSKLVDEEDEQETAKLLRQLMPGYVLVERRELMADAMLEGCDALDALLSYLTVNHSSEQLEDESVIWRSQRKASGWIVPIATGFQGISPLGQAKNQRDPTVPHRFAESIVTLGEFVMVHKIKHLDEILWCYSTDLDNDLYLCQQVNTMNEYQ

SEQ ID NO: 9334 - protein, 294 aa, Acinetobacter baumannii UH22908
MSRYVVIPRMRVQNANMQTNGFLLGGVPLFAANMFAHHLARQLGTQEEGIIYIHHDQQRLGGQAYGRFTPAQRRGAVFIGKKDYSSKNKYALSLQPTASCHLEFSLVIKFSSSRISPEKLTNILKRSRFAGGQIIEFLEITTHAENELETALKKIKTGFAILDRQDLLIEYQQRKQINRVQAFTQLLALKADALRTFFNDQNLSWISATNLGYALLEPLTDQRAGIRQAQDQETTAHAYAEPLTGIVQYFSLGEILRKNTETEDDTWHNLQKLLWTYHWPQDDIFLLKQNCINA

SEQ ID NO: 9335 - protein, 294 aa, Acinetobacter baumannii UH7607; identical to SEQ ID NO: 9334

SEQ ID NO: 9336 - protein, 294 aa, Acinetobacter baumannii UH6907; identical to SEQ ID NO: 9334

SEQ ID NO: 9337 - protein, 294 aa, Acinetobacter baumannii UH7907; identical to SEQ ID NO: 9334

SEQ ID NO: 9338 - protein, 294 aa, Acinetobacter baumannii CI79; identical to SEQ ID NO: 8773

SEQ ID NO: 9339 - protein, 640 aa, Vibrio parahaemolyticus B-265; identical to SEQ ID NO: 8738

SEQ ID NO: 9340 - protein, 640 aa, Vibrio parahaemolyticus 605; identical to SEQ ID NO: 8738

SEQ ID NO: 9341 - protein, 640 aa, Vibrio parahaemolyticus 50; identical to SEQ ID NO: 8726

SEQ ID NO: 9342 - protein, 640 aa, Vibrio parahaemolyticus 3256; identical to SEQ ID NO: 8864

SEQ ID NO: 9343 - protein, 327 aa, Pseudomonas aeruginosa Z61; identical to SEQ ID NO: 8627

SEQ ID NO: 9344 - protein, 327 aa, Pseudomonas aeruginosa BWHPSA048; identical to SEQ ID NO: 9279

SEQ ID NO: 9345 - protein, 327 aa, Pseudomonas aeruginosa BWHPSA044; identical to SEQ ID NO: 8627

SEQ ID NO: 9346 - protein, 327 aa, Pseudomonas aeruginosa BWHPSA038; identical to SEQ ID NO: 8627

SEQ ID NO: 9347 - protein, 640 aa, Vibrio parahaemolyticus IDH02640; identical to SEQ ID NO: 8738

SEQ ID NO: 9348 - protein, 640 aa, Vibrio parahaemolyticus SBR10290; identical to SEQ ID NO: 8864

SEQ ID NO: 9349 - protein, 640 aa, Vibrio parahaemolyticus IDH02189; identical to SEQ ID NO: 8738

SEQ ID NO: 9350 - protein, 640 aa, Vibrio parahaemolyticus Peru-288; identical to SEQ ID NO: 8738

SEQ ID NO: 9351 - protein, 71 aa, Escherichia coli BIDMC 49b; identical to SEQ ID NO: 8774

SEQ ID NO: 9352 - protein, 213 aa, Escherichia coli BIDMC 49b; identical to SEQ ID NO: 8623

SEQ ID NO: 9353 - protein, 71 aa, Escherichia coli BIDMC 49a; identical to SEQ ID NO: 8774

SEQ ID NO: 9354 - protein, 213 aa, Escherichia coli BIDMC 49a; identical to SEQ ID NO: 8623

SEQ ID NO: 9355 - protein, 640 aa, Vibrio parahaemolyticus 861; identical to SEQ ID NO: 8738

SEQ ID NO: 9356 - protein, 311 aa, Klebsiella oxytoca OK-1
MSYLLLLPHIRIENANAVAGLTWRFPAITHFLGYVHALSRRVSEFGVSFTGCAVINHEHHIQAYSSGRDYQFALTRNPLTKEGKTAAFNEEGRMHLTVSLLVECQGEIINGEYGKAALCSSLLTLCQSHKLAGGSIVMMREPQIFNAPDDERTLRKILWRLMPGFALCDRSEWLMEHYRQLQQRRPESSLLDAWLDFAAIKYQPVQQEPEDSVSWEYQPKPKPGYLVPLMCGYQRISRLYQPGEVANVRDTATPFAFTEAVYGVGEWRGLHRIADLEPLIWRYRTSDTGYYCSAMPVADDDFIFNEDDDLE

SEQ ID NO: 9357 - protein, 320 aa, Providencia alcalifaciens PAL-2
MTSTYILKLPHLKIHNANALSSPYTIGFPAMTAWLGFMHALERKLRGDGSLNIVFDSIAVISHECDLQTHRGPNDFVNSIIGTGNPLNSDGSRSAFIEEARCHLDVSLLIKYEVGVNDRGEGIPENSPILDVFHQVIMSMKLAGGDILSLGKPTVHIIPPEDLNGESRRKLLNSVMPGYALIERRDLTMEEGQDALDALLDYVVVENQCIEKPRVEKDIANESHGEEKRHYEWRTQRKAAGWIVPIATGYQGISSLGQAKNQRDPDVPHRFAESVVTLGEFILANRANNIHEILWEFKFIESQNLYLCQQVAFESISNGE

SEQ ID NO: 9358 - protein, 640 aa, Vibrio parahaemolyticus EKP-026; identical to SEQ ID NO: 8738

SEQ ID NO: 9359 - protein, 311 aa, Enterobacter kobei
MSSLILLRRVRVENANAIAGLTWGFPAITHFLGFAHALWRRLTETHGLRIDGCAVVSHEHQVHAHTSGRDYQFALTRNPLTREANTASFNEEGRMHMTVSLLLECQGEIPNGEYGQRDLAEYLSQVCPTLRLAGGIVVDVEAFTVMAMPSTDREMRRLQWLLMPGFALRDRSSWLVQHHQTLLENHPDATLLDAWLDFAALKIQAEMPEDGNLREGEPADWHVVPKPNPGYLVPLMTGYQRISELYAPGVVENARDAETPFAFTEAVYGVGEWCGLHRIRSLDEIFWRYRTTETGYYCQGAGAPVTSEPLN

SEQ ID NO: 9360 - protein, 145 aa, Enterobacter sp. BIDMC 28
MENQSISQLYSELSLNPDFPALVERCNLLTEILLDCHSLPQTQPVCRCLGAYLDVVKTELAESMSDFRVVEFDDEAERPKGNEWLLEDTEIKCDYCRALNHVLLVSHFDREMLPHLTGLLHDITHSMAADVVAPECGKPVIHIIN

SEQ ID NO: 9361 - protein, 311 aa, Enterobacter sp. BIDMC 28
MSSLILLHRIRVENANAIAGLTYGFPAITHFLGFSHALSRKLTETHGLKIDGCAVVSHEHQIHAHTSGRDYQFALTRNPLTRDAKTASFNEEGRMHMTVSLLLECHGEIPNGEYGQRDLAEHLSQVCPTLRLAGGIIVDIQAITVMAMPSDSRDLCRLQWQLMPGFALRDRSNWLGEHYQTLLESDPNTSLLDAWLDFAAMKFQAETPEEGDIREGEPANWHYVPKPNSGYLVPLMTGYQRISALYSPGMVSNARDAETPFAFTEAVYGVGEWCGLHRIQSLNEIFWRFHTTETGYYCQGAGAPVTSAHSK

SEQ ID NO: 9362 - protein, 640 aa, Vibrio parahaemolyticus V14/01; identical to SEQ ID NO: 8738

SEQ ID NO: 9363 - protein, 640 aa, Vibrio parahaemolyticus V-223/04; identical to SEQ ID NO: 8738

SEQ ID NO: 9364 - protein, 695 aa, Vibrio vulnificus BAA87
MTNLSDLLAIEDEAIKQTALKKMFMPYTEDVCVDGYEQETLTILLNLSSSHQADRCSDWLDVARAQRYLKDRENLDASLAEIQWFHTHNLKFPDCRVKDQRIIARPLSTAEEFISSAVLAQRLGWAHNSAVYRHTLWLLNPFKWQSQPVCVLSLIQQKNPVWLDLLTEFGLDVKSLDRLQRAIEEQLPENSFPNSVSAYSKQLRFPWVDDYVSITPVVSHALQCELEIRARSPENKFSFVSSSLPNSASIGNLCGSLGGYMRVLNYPLGVKQAKGGTLTASRQKSGHYFDDYQVTNAKICQVLNRLIGSEPSKTQRQRERARQVRSKILRKQIALWMLPLIELRDIAESEPNQQQLEHDDTLAQAFLSLPELELGSLASEFNRRLHLTFQNNMYSAKFAYHPKLMPVAKAQVTWVLEQLSKPINNQDTVTGEQYIYLSSMRVQDAAAMSNPCLCGVPSLTAIWGFMHDYQRKFNQLVNNDSPVEFSSFAFYVRNENIQSTAKLTEPNSVAKARTVSNAKRPTIRSERLADLEIDLVIRVHSESRISDFRSALKTALPVAFAGGALYQPQLSTQIEWLRTFTGRSELFHVLKGLPAYGRWLYPSEKQPTNFDELERLLTQDDDNLPVSLGYHLLEHPTKRDNAITGCHAYAENAIGLAKRINPIEVRFSGRDHFLNHAFWSIECSSETILIKNYRD

SEQ ID NO: 9365 - protein, 683 aa, Pseudoalteromonas sp. BSi20652
MNLQDAFAIESLKEKTTALRKLFAPYAPHVAVDGFEEQALTVLINLVYKRSEIDDLTSTRTAKSVLRDEVLLSKCINEVKWFHTHNLKYPDIRVSHQRLISKVVSEDITGICSRSLPLSFGWSHNSAEINHAKLFLTSFNWQGEVTCLAKLLITEELVWINLIRAYGFTKKTVLDIAVKIKQQLPVAELPLEVSPFSPQLQMPFQQSYLAVTPVVSHAMLAKIQQLTTERKLNFALVEHSRPANVGDLASSVGGNIRVLRYFPKTYSKAINRSKVANNYIEKTFKIRALLNSQFQQALLVLVGIKQFNTLRQKRLARVAAIRQVRVSLQLWLDNILEAKNNAQEQAYPEWAKHYLDQSITNCISQFSNVLNESLGNLSKLKRFAYHPNLMGLFKSQLKYVFTHCTAEEETLNDEQIVYVYCQDMRVFDAEAMANPYIQGMPSLTALNGLAHNFERKLKNFIDPSIKCIGSAIYIESYQLHTGKPLPEPSKLKQVAGRSHVIRSGIIDKPKCDITLDLVFRLLVPNTELLDKLNSQLIKPALPSTFAGGTMHPPSLYQNIDWCHVHTKPSELFKNLKVKSSNGSWLYPSKKVVKSFEQLIDALNGNFNLRPAAIGFAALEEPVKRDAALHEYHCYAEPIIGLLECVSNTSVKYAGAKQFFHDAFWIMDVQKESMLMKKSKFEYE

SEQ ID NO: 9366 - protein, 313 aa, Pseudoalteromonas sp. BSi20652
MNNIKRLLLLPHIQVHNANALSSPFTIGFPAMTVWLGAVHALQRKLNTKGYNSIKFDSVAVISHQCDLQTHKGIDDFVHSIIGTGNPLDKTGSRSAFIEEARCHLDVSLIIEYTGIEKDDEQNLQDNITHLLNSKMKIAGGDILTFKAPQFFKIENGNTADLTALTRKLMPGYAIIERRDLMVEAMEAGQDAMDALIDHLAIHHQCEKALVEDAEKITWTSKRKSKGWIVPIATGFHGLTDLGEAKNQRDPNTPHRFAESVVTLGEFKMPHRIKSIDEMLWRYQTDQTNNLYLCSQTQKTIQTEEEIENSYYE

SEQ ID NO: 9367 - protein, 683 aa, Pseudoalteromonas sp. BSi20480
MNLQDAFAIELLKEKTTAIRKLFAPYMPHVAVDGFEEQALTVLINLVYKRSEIDDLTSTRTAQSVLRDEVLLSKCINEVKWFHTHNLKYPDIRVSHQRLISDVISEDIAGICSRSLPLSFGWSHNSAEINHAKLFLTSFSWQGEVTCLAKLLITEEPVWINLIRAYGFTKKTVLDIAGKIKQQLPVAELPLEVSSFSPQLQMPFQQSYLAVTPVVSHAMLAKIQQLRTDRKLNFGFVEHSRPANVGDLASSVGGNIRVLRYFPKTYSKAINRSKVANNDIEKAFKIRALLSSQFQQALLVLVGIKQFNTLRQKRLARVAAIRQVRVSLQLWLDNILEAKNNAHEQAYPEWAKHYLDQSITNCISQFSNVLNESLGNLSKLKRFAYHPNLMGLFKSQLNYVFTHCATEKETLNDEQIVYVHCQDMRVFDAEAMANPYIQGMPSLTALNGLAHNFERKLKNFIDPSIKCIGSAIYIENYQLHKGKPLPEPSKLKQVAGRSHVIRSGIIDKPKCDITLDLVFRFFVPNEEILNKLNSQLIKPALPSTYAGGTMHPPSLYQNINWCHVHTTPSELFKNIKAKSLNGSWLYPSKKVVKSFEQLIDVLNGNFNLRPAAIGFAALEEPVKRDAALHEYHCYAEPVIGLLECVSNTSVKYAGAKRFFHDAFWVMDVQKESMLMKKSKFEYE

SEQ ID NO: 9368 - protein, 683 aa, Pseudoalteromonas sp. BSi20495
MNLQNAFAIESLKEKTTTLRKLFAPYMPHVAVDGFEEQALVVLINLVYKRSEIDDLTSTRTAKSVLRDEVLLTKCINEAKWFHTHNLKYPDIRVSHQRLISEVVSEDIAGICSRSLPLSFGWSHNSAEINHAKLFLTSFNWQGEVTCLAKLLITEELVWINLIRGYGFTKKAVLDIAGKIKQLLPVAELPLEVSSFSPQLQMPFQQSYLAVTPVVSHAMLAKIQQLTTDRKLNFALVEHSRPANVGDLASSVGGNIRVLRYFPKTYSKATNRSKVANNDIEKIFKIRALLNSQFQQALLVLVGIKQFNTLRQKQLARVAAIRQVRASLQLWLDNILEAKNNAQNQVYPEWAKHYLDQSVTNCISQFSNVLNESLSSLSKLKRFAYHPNLMGMFKTQLNYVFTHCTAEQETLNDEQIVYVHCQDMRVFDAEAMANPYIQGMPSLTALNGLAHNFERKLKNFIDPSIKCIGSAIYIENYQLYTGKPLPEPSKLKQVAGRSHVISSGIIDKPKCDITLDLIFRLFVPNKEVLNKLNSQLIKPALPSVFAGGTMHPPSLYQNIDWCHLHTKPSELFKNIKVKSLNGSWLYPSKKVVKSFEQLIDALNGNFDLRPAAIGFAALEKPVKREAALHESHCYAEPVIGLLECVSNTSVKYAGAKQFFHDAFWVMDVQKESMLMKKSKFEYE

SEQ ID NO: 9369 - protein, 45 aa, Pseudoalteromonas sp. BSi20495
MSQYLLLKKVSVQNANAIAGLTYGFPAITNFWVLPMHYHVNYLKR

SEQ ID NO: 9370 - protein, 295 aa, Pseudoalteromonas sp. BSi20495
MGFTHALSRKLPETLAVNLGGVAVISHKNIVHARQPKGWGDYVFALSRNPLTHQGKTAPINEEGRMHMQISLLIEVNGLIAGDTETAEQLIEQVKQKVPTLRLAGGQITHVENIELTPLNKEQKTLRKLMPGFALIDRSDYLAEYFQQQKSINDNACLFDAWCDFAKLKFKAEKITSKDEQETDALESVKQKANWHYVAKPQSGYLVPINTGYCAISPVYEAGEVSNVRDATVPTAFAESAYSVGEWKSVHNIKNIEVAVWRYEHQYPWYVAKTSPFEDEIIEPDSFDHDEAMNF

SEQ ID NO: 9371 - protein, 297 aa, Acinetobacter radioresistens DSM 6976 = NBRC 102413 = CIP 103788; identical to SEQ ID NO: 9115

SEQ ID NO: 9372 - protein, 326 aa, Paraglaciecola chathamensis S18K6
MSQYLLLKKVSVQNANAIAGLTYGFPAITNFLGFAHALSRTLPETLAVNLGGVAVISHKNTVHARQPKGWGDYVFALSRNPLTHQGKTAPINEEGRMHMQISLLIEINGLIAGDTQTTEQLIEHVKQNVPALRLAGGQITHIESIELTPLNEEQKTLRKLMPGFALIDRSDYLAQHFQQQKEINDNACLFDAWCDFSQLKFKTEKIKSEDEQESEDLENVNQKANWHYVAKPQSGYLVPINTGYCAISTIYEAGEVSNVRDSTVPTVFAESAYSVGEWKSLHNIQNIEITLWRYEHQYPWYVAKTTPFEDEIIEPDSFDHDEAMNF

SEQ ID NO: 9373 - protein, 323 aa, Aliiglaciecola lipolytica E3
MSQYLLLKKISVQNANAIAGLTYGFPAITNFLGFAHALSRKFPETLAVNLGGLAVISHKNTVHARQPKGWGDYVFALSRNPLTHQGKTAPINEEGRMHMQVSLLIEVNGLISGDTETKEQLIEYVKQNVPELRLAGGQITHIESIELTPLNEEQKTLRKLMPGFALIDRSDYLSEHFQQHKAINDNVCLFDAWCDFAQLKFKAEKITSEDEQETEALESVNQKANWHYVAKPQSGYLVPINTGYCAISPIYEAGEVSNVRDSTVPTVFAESAYSVGEWKSLHNIKNIEITLWRYEHQYPWYVAKTIPFEDEIIEPDSSEAMPY

SEQ ID NO: 9374 - protein, 317 aa, Paraglaciecola arctica BSs20135
MIGEVKKLLIIPHIKVHNANALSSPFTIGFPAMTAWLGAVHALQRKLNAQDIPVVFSATGVVSHNMDLQTYKGNNDFVHSIVGTGNPLDKTGARSAFIEEARCHLDVSLVIQYDNISIDDRERLLGAINHLLHANMKMAGGDINGFQTPFCINCKEGDDQDLSKVQRALMPGYALIERRDLMLDAMKNGADALDALINYLAIHHLCETDDDGNVTWSSYRKTLNNKPAGWIVPIATGFHGISELGEAKNQRDPDTPHRFAESIVTLGEFKMPHRIKFIEDILWRYHHQGDLYLCQQNKHITPTSEFDLEPSSIESEF

SEQ ID NO: 9375 - protein, 393 aa, Paraglaciecola polaris LMG 21857
MSQYILINRVNVQNANAVAGFTWGFPSITHFIGFGHNLSRKLSKSNFSNFKISGCSVISHENHVHSYQGNRFTQSKNPAYLMSDVKKIIDGKAPSIIEEGKLNMTVSLLIGFDGFLGNQANIFIEWLKKQCLMQRLAGGTILDIDSIQVFDITDKNKFYLLKRKLLPGFALMDRSIDLAQYHELNLADNSDAELLDSWLDFAALKQKARPKSNLISKHLNMQVKSASILDRVLHDWITHLERIPYDLNVPTSVIKYFETLEKNKSTKAVLEQWQHYLQPTDKSSADWEYLPKPSSGYLVPIMTGYKAISQVYDNIDIENTRDSRTPVCFVEAIHSIGEWQGVNNFRNAEDIASSLWHYEHKEHWYLCKQHSTNQSDTLDEFDSTIITEILDLS

SEQ ID NO: 9376 - protein, 695 aa, Vibrio azureus NBRC 104587
MTKLSDLLAIEDEVLKQATLKKMFMPYTEDVCVEGFEKEALTILLNLSSNHQADKCADWLDDARAKNYLNDSKNLKSSLDEIQWFHTHNLKFPDCRVKDSRIIAKPLITSESFISSAALEESWGWSHNSAVYRFTLWLLTPFRWQSQSVNLLSMIKSSNHTWMVLLQDFGLGVEQLADIKELSYIEMPEESFPNRVSEYSKQIRLPRKGHYLTITPVVSHSIQRELEIRSRNKESQLRFISSYLPNPASIGGLCGSLGGYIKILDYSLGIKADSKQTLIRYHQKRSRFFDDYQLTNNKICQTLNRLIGFEPLKTHKQRNASRRIQTKLLRKQIALWMLPLIELRDLQDAEPNQQKMEYQDSLAQAFLAKPELEFTSLVNDFNQRLHLAFQENKFTTQFAYHPKLMQAAKAQIKWVLTQLSKTEQQEDTSHTEQYIYLSSLRVQDVVAMSCPYLSGFPSLTAIWGFVHQYQREFNKRIDSENHVEFSGFSLFVRSEYIQSSAKLSEPNSVATKRTISNVKRPTTLGQRQSDLEMDLVIRVDSKNRLSDYLSELKATFPLVFAGGAVYQPLMSLQIEWLKVFSSKSSFFNRIKGLPANGRWVLPSDEQPNCFDDLEQLLNQDMDNMPISIGFHLLEPPKARENALTEFHAYAENALGIAKRLSPIDVRFAGRDHFFNHAFWSLELTDETILIKNLRD

SEQ ID NO: 9377 - protein, 315 aa, Vibrio halioticoli NBRC 102217
MHITTSIYLFLFTLLMSFSLPIQAQDSEEKCLSKPDDNRPISRVYHFLNTKFCQPAVWFDDFFADDRVTEDARAGTSVRWKNDFSYFEQDGFKYKSKIDAKFNLPKVTKRLKLIIESEGEDSLFDLFPKNSDEVENNVGLRYDIYAKGNSSFNIKATFKPKIEARYRFTYPITVNTVSRITQKLYQQTELTGESTQFDIDHAINTNFLLRWTSFAEFERDHADDTSIWNMGTGFILYQYISPTQAINYTISTTATDTPHSFIDNTLISLTYRQNIFFDWFYYEITPEYNWYREYQQSFEKEASIRLRLEVRFDNF

SEQ ID NO: 9378 - protein, 316 aa, Yersinia pseudotuberculosis NBRC 105692; identical to SEQ ID NO: 8648

SEQ ID NO: 9379 - protein, 291 aa, Treponema pallidum subsp. pallidum str. Nichols; identical to SEQ ID NO: 8615

SEQ ID NO: 9380 - protein, 327 aa, Pasteurella multocida subsp. multocida str. Pm70; identical to SEQ ID NO: 8616

SEQ ID NO: 9381 - protein, 316 aa, Yersinia pestis KIM10; identical to SEQ ID NO: 53

SEQ ID NO: 9382 - protein, 640 aa, Vibrio parahaemolyticus RIMD 2210633; identical to SEQ ID NO: 8738

SEQ ID NO: 9383 - protein, 332 aa, Chromobacterium violaceum ATCC 12472; identical to SEQ ID NO: 8618

SEQ ID NO: 9384 - protein, 322 aa, Photorhabdus luminescens subsp. laumondii TTO1; identical to SEQ ID NO: 8743

SEQ ID NO: 9385 - protein, 316 aa, Yersinia pestis biovar Microtus str. 91001; identical to SEQ ID NO: 53

SEQ ID NO: 9386 - protein, 291 aa, Treponema pallidum subsp. pallidum str. Nichols; identical to SEQ ID NO: 8615

SEQ ID NO: 9387 - protein, 327 aa, Pseudomonas aeruginosa UCBPP-PA14; identical to SEQ ID NO: 8627

SEQ ID NO: 9388 - protein, 294 aa, Acinetobacter baumannii; identical to SEQ ID NO: 8815

SEQ ID NO: 9389 - protein, 294 aa, Acinetobacter baumannii
MSRYVVIPRMRVQNANMQTNGFLLGGVPLFAANMFAHHLARQLGTQEEGIIYIHHDQQRLGGQAYGRFTPAQRRGAVFIGKKDYSSKNKYALSLQPTASCHLEFSLVIKFSSSRISPEKLTNILKRSRFAGGQIIDFLEITIHAENELETALKKIKTGFAILDRQDLLIEYQQRKQINRVQAFTQLLALKADALRAFFNDQNLSWISATNLGYALLEPLTDQRAGIRQAQDQETTAHAYAEPLTGIVQYFSLGEILRRNTEAEDDTWHNLQKLLWTYHWPQDDIFLLKQNCINA

SEQ ID NO: 9390 - protein, 294 aa, Acinetobacter
MSRYVVIPRMRVQNANMQTNGFLLGGVPLFAANMFAHHLARQLGTQEEGIIYIHHDQQRLGGQAYGRFTPAQRRGAVFIGKKDYSSKNKYALSLQPTASCHLEFSLVIKFSSSRISPEKLTNILKRSRFAGGQIIEFLEITTHAENELETALKKIKTGFAILDRQDLLIEYQQRKQINRVQAFTQLLALKADALRAFFNDQNLSWISATNLGYALLEPLTDQRAGIRQAQDQENTAHAYAEPLTGIIQYFSLGEILRRNTEAEDDTWHNLQKLLWTYHWPQDDIFLLKQNCINA

SEQ ID NO: 9391 - protein, 294 aa, Acinetobacter; identical to SEQ ID NO: 9334

SEQ ID NO: 9392 - protein, 307 aa, Escherichia; identical to SEQ ID NO: 9128

SEQ ID NO: 9393 - protein, 307 aa, Escherichia
MSYLLLLPHIRIENANAVSGLTWGFPAMTHFLGYVHALSRKVVDEFGVSFAGCGVVSHEQHIQAYSSGRDFQFALTRNPLTKEGKTASFNEEGRMHLTVSLLVECNGEITNGEYGRKALCDHLKMLCQSHKLAGGSIVSMRDPQLFHAPEDEKQLRKIIWRLMPGYALYDRSEWLAEHHQQHPDISLLDAWLDFAAIKYQAESPAEDNTAQWTYQPKPMPGFLVPLMCGYQRISPVYASGEVENARDTVTPFAFAEAVYGIGEWRGLHRITDLQPLMWRYRTTDTGYYCSAIPLVDDPITHEDDDSE

SEQ ID NO: 9394 - protein, 307 aa, Escherichia coli; identical to SEQ ID NO: 8676

SEQ ID NO: 9395 - protein, 71 aa, Escherichia coli; identical to SEQ ID NO: 8774

SEQ ID NO: 9396 - protein, 307 aa, Enterobacteriaceae; identical to SEQ ID NO: 8800

SEQ ID NO: 9397 - protein, 307 aa, Escherichia coli; identical to SEQ ID NO: 8828

SEQ ID NO: 9398 - protein, 307 aa, Escherichia coli; identical to SEQ ID NO: 8753

SEQ ID NO: 9399 - protein, 307 aa, Escherichia
MSYLLLLPHVRIENANAVSGLTWGFPSMTHFLGYVHALSRKVVDEFGVSFDGCAVVSHEQHIQAYSSGRDFQFALTRNPLTREGKTASFNEEGRMHLTVSLLIECNGEITNGEYGRKALCDYLKMLCQSHKLAGGSIVDMREPQLFHAPEDEKQLRKIIWRLMPGYALYDRSEWLAEHHQQHPDISLLDAWLDFAAVKYQAESPAEDNSAQWVYQPKPMPGFLVPLMCGYQRISPVYAPGEVENARDTVMPFAFAEAVYGIGEWRGLHRITSLQPLMWRYRATDTGYYCSAIPVVDDPTTNEDDDTE

SEQ ID NO: 9400 - protein, 307 aa, Escherichia albertii
MSYLLLLPHVRIENANAVSGLTWGFPSMTHFLGYVHALSRKVVDEFGVSFGGCAVVSHEQHIQAYSSGRDFQFALTRNPLTREGKTASFNEEGRMHLTVSLLIECNGEITNGEYGRKALCDHLKMLCQSHKLAGGSIVDMREPQLFHAPEDEKQLRKIIWRLMPGYALYDRSEWLAEHHQQHPDISLLDAWLDFAAVKYQAESPAEDNSAQWVYQPKPMPGFLVPLMCGYQRISPVYAPGEVENARDTSTPFAFAEAVYGIGEWRGLHRITGLQPLMWRYRTTDTGYYCSAIPDVDDPTTNEDDDTE

SEQ ID NO: 9401 - protein, 695 aa, Vibrio mimicus; identical to SEQ ID NO: 8818

SEQ ID NO: 9402 - protein, 695 aa, Vibrio cholerae
MTKLSDLLAIEDEAIKQTALKKMFMPYTEDVCVDGYEQETLTILLNLSSSHQADRCSDWLDVARAQRYLKDRENLDASLAEIQWFHTHNLKFPDCRVKDQRIIARPLSTAEEFISSAVLDQRLGWAHNSAVYRHTLWLLNPFKWQSQPVCILLLIQQKNPVWLDLLTEFGLDVKSLARLQRAIEEQLPENSFPDSVSTYSKQLRFPWGDDYVSITPVVSHALQCELEIRARSPENKFSFVSSSLPNSASIGNLCGSLGGYMRVLNYPLGVKQAKGGTLTENRQKSGHYFDDYQVTNAKICQVLNRLIGSEPSKTQRQRERARKVRSKILRKQIALWMLPLIELRDIAESEPNQQQLEHDDTLAQAFLSLPEWELGSLAGEFNRRLHLAFQNNIYSAKFAYHPKLMQVAKAQVTWVLEQLSKPINNQDTVTGEQYIYLSSMRVQDAVAMSNPCLCGVPSLTAIWGFMHDYQRQFNQLVNNDSPVEFSSFAFYVRNENIQSTAKLTEPNSIAKARTVSNAKRPTIRSKRLADLEIDLVIRVHSESRISDFRSALKTALPVAFAGGALYQPQLSTQIEWLRTFTGRSELFHVLKGLPAYGRWLYPSEKQPTNFDELERLLTQDDDNLLVSLGYHLLEHPTKRDNAITGCHAYAENAIGLAKRINPIEVRFSGRDHFLNHAFWSIECSSETILIKNYRD

SEQ ID NO: 9403 - protein, 295 aa, Vibrio mimicus; identical to SEQ ID NO: 8813

SEQ ID NO: 9404 - protein, 295 aa, Vibrio cholera; identical to SEQ ID NO: 8873

SEQ ID NO: 9405 - protein, 84 aa, Shigella flexneri; identical to SEQ ID NO: 8868

SEQ ID NO: 9406 - protein, 640 aa, Vibrio cholerae; identical to SEQ ID NO: 8960

SEQ ID NO: 9407 - protein, 294 aa, Acinetobacter; identical to SEQ ID NO: 8773

SEQ ID NO: 9408 - protein, 294 aa, Acinetobacter; identical to SEQ ID NO: 8656

SEQ ID NO: 9409 - protein, 302 aa, Escherichia coli; identical to SEQ ID NO: 8875

SEQ ID NO: 9410 - protein, 307 aa, Escherichia coli; identical to SEQ ID NO: 9087

SEQ ID NO: 9411 - protein, 307 aa, Escherichia; identical to SEQ ID NO: 9009

SEQ ID NO: 9412 - protein, 307 aa, Escherichia coli; identical to SEQ ID NO: 9070

SEQ ID NO: 9413 - protein, 307 aa, Escherichia coli; identical to SEQ ID NO: 9078

SEQ ID NO: 9414 - protein, 292 aa, Vibrio cholerae; identical to SEQ ID NO: 8991

SEQ ID NO: 9415 - protein, 294 aa, Acinetobacter baumannii; identical to SEQ ID NO: 9059

SEQ ID NO: 9416 - protein, 316 aa, Yersinia pestis; identical to SEQ ID NO: 53

SEQ ID NO: 9417 - protein, 78 aa, Yersinia pestis; identical to SEQ ID NO: 8795

SEQ ID NO: 9418 - protein, 201 aa, Yersinia pestis; identical to SEQ ID NO: 8794

SEQ ID NO: 9419 - protein, 235 aa, Escherichia coli; identical to SEQ ID NO: 8804

SEQ ID NO: 9420 - protein, 687 aa, Grimontia indica; identical to SEQ ID NO: 9127

SEQ ID NO: 9421 - protein, 336 aa, Xanthomonas fragariae; identical to SEQ ID NO: 9126

SEQ ID NO: 9422 - protein, 309 aa, Nitrosococcus oceani; identical to SEQ ID NO: 8621

SEQ ID NO: 9423 - protein, 328 aa, Thauera sp. 28; identical to SEQ ID NO: 9089

SEQ ID NO: 9424 - protein, 327 aa, Pseudomonas; identical to SEQ ID NO: 8627

SEQ ID NO: 9425 - protein, 174 aa, Acinetobacter baumannii; identical to SEQ ID NO: 9068

SEQ ID NO: 9426 - protein, 64 aa, Acinetobacter baumannii; identical to SEQ ID NO: 9067

SEQ ID NO: 9427 - protein, 327 aa, Pseudomonas aeruginosa; identical to SEQ ID NO: 8769

SEQ ID NO: 9428 - protein, 333 aa, Pseudomonas oleovorans; identical to SEQ ID NO: 8765

SEQ ID NO: 9429 - protein, 311 aa, Moraxella; identical to SEQ ID NO: 8855

SEQ ID NO: 9430 - protein, 311 aa, Moraxella catarrhalis; identical to SEQ ID NO: 8854

SEQ ID NO: 9431 - protein, 297 aa, Moraxella catarrhalis; identical to SEQ ID NO: 8671

SEQ ID NO: 9432 - protein, 109 aa, Bifidobacterium dentium; identical to SEQ ID NO: 8827

SEQ ID NO: 9433 - protein, 116 aa, Klebsiella pneumoniae
MIVRDDSERGIPPLVTHQPPSSMDDAPVIRGRMVQIPGWIIPLYAGLFIALGWFGGEQWRHPAPPQTLPLPVAHAALLPLTAAGRVQRCRSGRSFKHAMRTARTNDKAKKYPTTDR

SEQ ID NO: 9434 - protein, 299 aa, Acinetobacter lwoffii; identical to SEQ ID NO: 8820

SEQ ID NO: 9435 - protein, 327 aa, Pseudomonas aeruginosa; identical to SEQ ID NO: 8783

SEQ ID NO: 9436 - protein, 313 aa, Yersinia kristensenii; identical to SEQ ID NO: 8810

SEQ ID NO: 9437 - protein, 296 aa, Acinetobacter bohemicus; identical to SEQ ID NO: 9090

SEQ ID NO: 9438 - protein, 294 aa, Acinetobacter proteolyticus; identical to SEQ ID NO: 9091

SEQ ID NO: 9439 - protein, 294 aa, Acinetobacter; identical to SEQ ID NO: 9092

SEQ ID NO: 9440 - protein, 294 aa, Acinetobacter; identical to SEQ ID NO: 9093

SEQ ID NO: 9441 - protein, 292 aa, Yersinia rohdei; identical to SEQ ID NO: 8811

SEQ ID NO: 9442 - protein, 329 aa, Acinetobacter lwoffii; identical to SEQ ID NO: 9094

SEQ ID NO: 9443 - protein, 366 aa, Acinetobacter sp. ANC 3789; identical to SEQ ID NO: 9097

SEQ ID NO: 9444 - protein, 314 aa, Acinetobacter sp. CIP 102129; identical to SEQ ID NO: 9099

SEQ ID NO: 9445 - protein, 294 aa, Acinetobacter sp. NIPH 758; identical to SEQ ID NO: 9101

SEQ ID NO: 9446 - protein, 294 aa, Acinetobacter sp. CIP 102637; identical to SEQ ID NO: 9103

SEQ ID NO: 9447 - protein, 294 aa, Acinetobacter sp. CIP 56.2; identical to SEQ ID NO: 9104

SEQ ID NO: 9448 - protein, 294 aa, Acinetobacter bereziniae; identical to SEQ ID NO: 9105

SEQ ID NO: 9449 - protein, 294 aa, Acinetobacter gerneri; identical to SEQ ID NO: 9107

SEQ ID NO: 9450 - protein, 295 aa, Acinetobacter venetianus; identical to SEQ ID NO: 9108

SEQ ID NO: 9451 - protein, 313 aa, Acinetobacter; identical to SEQ ID NO: 9109

SEQ ID NO: 9452 - protein, 294 aa, Acinetobacter; identical to SEQ ID NO: 9110

SEQ ID NO: 9453 - protein, 315 aa, Providencia stuartii; identical to SEQ ID NO: 8799

SEQ ID NO: 9454 - protein, 294 aa, Acinetobacter baylyi; identical to SEQ ID NO: 8744

SEQ ID NO: 9455 - protein, 294 aa, Acinetobacter; identical to SEQ ID NO: 9112

SEQ ID NO: 9456 - protein, 294 aa, Acinetobacter junii; identical to SEQ ID NO: 9113

SEQ ID NO: 9457 - protein, 294 aa, Acinetobacter; identical to SEQ ID NO: 9125

SEQ ID NO: 9458 - protein, 294 aa, Acinetobacter; identical to SEQ ID NO: 9114

SEQ ID NO: 9459 - protein, 277 aa, Bilophila wadsworthia; identical to SEQ ID NO: 8846

SEQ ID NO: 9460 - protein, 297 aa, Acinetobacter; identical to SEQ ID NO: 9115

SEQ ID NO: 9461 - protein, 294 aa, Acinetobacter calcoaceticus; identical to SEQ ID NO: 9116

SEQ ID NO: 9462 - protein, 294 aa, Acinetobacter haemolyticus; identical to SEQ ID NO: 9117

SEQ ID NO: 9463 - protein, 368 aa, Acinetobacter sp. NIPH 284; identical to SEQ ID NO: 9123

SEQ ID NO: 9464 - protein, 295 aa, Acinetobacter sp. ANC 3862; identical to SEQ ID NO: 9124

SEQ ID NO: 9465 - protein, 641 aa, Photobacterium angustum; identical to SEQ ID NO: 8777

SEQ ID NO: 9466 - protein, 291 aa, Methylomicrobium album; identical to SEQ ID NO: 8892

SEQ ID NO: 9467 - protein, 695 aa, Vibrio alginolyticus; identical to SEQ ID NO: 8778

SEQ ID NO: 9468 - protein, 640 aa, Vibrio parahaemolyticus; identical to SEQ ID NO: 8719

SEQ ID NO: 9469 - protein, 704 aa, Vibrio sp. 16; identical to SEQ ID NO: 8802

SEQ ID NO: 9470 - protein, 640 aa, Vibrio parahaemolyticus; identical to SEQ ID NO: 8738

SEQ ID NO: 9471 - protein, 316 aa, Shewanella benthica; identical to SEQ ID NO: 8789

SEQ ID NO: 9472 - protein, 640 aa, Vibrio parahaemolyticus; identical to SEQ ID NO: 8864

SEQ ID NO: 9473 - protein, 695 aa, Vibrio campbellii; identical to SEQ ID NO: 9058

SEQ ID NO: 9474 - protein, 319 aa, Aggregatibacter actinomycetemcomitans; identical to SEQ ID NO: 8710

SEQ ID NO: 9475 - protein, 331 aa, Aggregatibacter actinomycetemcomitans; identical to SEQ ID NO: 8878

SEQ ID NO: 9476 - protein, 319 aa, Actinobacillus pleuropneumoniae; identical to SEQ ID NO: 8829

SEQ ID NO: 9477 - protein, 319 aa, Actinobacillus pleuropneumoniae; identical to SEQ ID NO: 8825

SEQ ID NO: 9478 - protein, 319 aa, Actinobacillus pleuropneumoniae; identical to SEQ ID NO: 8831

SEQ ID NO: 9479 - protein, 319 aa, Actinobacillus pleuropneumoniae; identical to SEQ ID NO: 8826

SEQ ID NO: 9480 - protein, 319 aa, Actinobacillus pleuropneumoniae; identical to SEQ ID NO: 8834

SEQ ID NO: 9481 - protein, 319 aa, Actinobacillus pleuropneumoniae; identical to SEQ ID NO: 8836

SEQ ID NO: 9482 - protein, 319 aa, Actinobacillus pleuropneumoniae; identical to SEQ ID NO: 8651

SEQ ID NO: 9483 - protein, 79 aa, Actinobacillus ureae; identical to SEQ ID NO: 8847

SEQ ID NO: 9484 - protein, 183 aa, Actinobacillus ureae; identical to SEQ ID NO: 8848

SEQ ID NO: 9485 - protein, 106 aa, Pasteurella multocida
  misc_feature (76)..(76): Xaa can be any naturally occurring amino acid
MFQTDFYILFDHIKVQSANAISGPLSYGFPALTGLTGAIHALNRKLAHHPVQFGGVMVACHDYELQTYQNSAFSDXTFKQTRNPIKRNGETASIIEEGKIHLDLSL

SEQ ID NO: 9486 - protein, 404 aa, Pasteurella multocida; identical to SEQ ID NO: 8872

SEQ ID NO: 9487 - protein, 327 aa, Pasteurella multocida; identical to SEQ ID NO: 8871

SEQ ID NO: 9488 - protein, 327 aa, Pasteurella multocida; identical to SEQ ID NO: 8968

SEQ ID NO: 9489 - protein, 327 aa, Pasteurella multocida; identical to SEQ ID NO: 8972

SEQ ID NO: 9490 - protein, 330 aa, Pasteurella multocida; identical to SEQ ID NO: 8973

SEQ ID NO: 9491 - protein, 327 aa, Pasteurella dagmatis; identical to SEQ ID NO: 8816

SEQ ID NO: 9492 - protein, 320 aa, Coxiella burnetii; identical to SEQ ID NO: 8654

SEQ ID NO: 9493 - protein, 318 aa, Mitsuokella multacida; identical to SEQ ID NO: 8817

SEQ ID NO: 9494 - protein, 271 aa, Oxalobacter formigenes; identical to SEQ ID NO: 8805

SEQ ID NO: 9495 - protein, 310 aa, Pectobacterium wasabiae; identical to SEQ ID NO: 8970

SEQ ID NO: 9496 - protein, 703 aa, Moritella sp. PE36; identical to SEQ ID NO: 8788

SEQ ID NO: 9497 - protein, 276 aa, Paraburkholderia graminis; identical to SEQ ID NO: 8798

SEQ ID NO: 9498 - protein, 311 aa, Enterobacter cancerogenus; identical to SEQ ID NO: 8822

SEQ ID NO: 9499 - protein, 311 aa, Chlorobium ferrooxidans; identical to SEQ ID NO: 8781

SEQ ID NO: 9500 - protein, 179 aa, Anaeroglobus geminatus; identical to SEQ ID NO: 8886

SEQ ID NO: 9501 - protein, 99 aa, Anaeroglobus geminatus; identical to SEQ ID NO: 8887

SEQ ID NO: 9502 - protein, 422 aa, Novosphingobium pentaromativorans; identical to SEQ ID NO: 8883

SEQ ID NO: 9503 - protein, 295 aa, Dialister invisus; identical to SEQ ID NO: 8814

SEQ ID NO: 9504 - protein, 393 aa, Paraglaciecola polaris; identical to SEQ ID NO: 9375

SEQ ID NO: 9505 - protein, 322 aa, Halomonas boliviensis; identical to SEQ ID NO: 8884

SEQ ID NO: 9506 - protein, 327 aa, Enhydrobacter aerosaccus; identical to SEQ ID NO: 8812

SEQ ID NO: 9507 - protein, 282 aa, Burkholderiaceae; identical to SEQ ID NO: 8894

SEQ ID NO: 9508 - protein, 324 aa, delta proteobacterium MLMS-1; identical to SEQ ID NO: 8779

SEQ ID NO: 9509 - protein, 213 aa, Micromonospora lupini
MRSGEILDQLDTAAGDFRFPDLGHGYYYAVDARLHAYRDAHRWALIVETVGYSPRAGNLIDVLHVFGNCLTEGQPGYGNEDFLGRVDNPDEIEDMDEPEIYCGNPIVVRGRRIPVAAEPGEELVDVLRRLVPEHRELLLADEVELRRRIPADLPEILRLDQWHHPDPARDTLPSQSTTFRQLADVLATGDAGRYAPDLPPNTHWSHWPESGNL

SEQ ID NO: 9510 - protein, 319 aa, Rhizobium sp. PDO1-076
MLVEGKWTADWHPVQASDAKGGFVRQISGFRNWITPDGSAGPTGEDGFKAEDGRYHLYVALICPWASRTLIGRALKKLDGAISVSVVEPALSDQGWRFGDYPGSDFDTLNGATYMHEIYTRADPVYTGRATVPVLWDKKRGTIVNNESADILRMLNSGFGSLADNSIDLYPEDLRADIDALNERIYPMLNNGVYRAGFAVTQTAYEEAFADVFSMLDELETRLDNQGPYLFGDRLTEADVRLFVTLVRFDAAYHGLFKCNLRRLADYARLSRYVETIIAIPGIRATVNIDHIKRGYYSIKALNPNGIVPVGPQLPFEQA

SEQ ID NO: 9511 - protein, 317 aa, Paraglaciecola arctica; identical to SEQ ID NO: 9374

SEQ ID NO: 9512 - protein, 303 aa, Cellvibrio sp. BR; identical to SEQ ID NO: 8896

SEQ ID NO: 9513 - protein, 318 aa, Cronobacter dublinensis; identical to SEQ ID NO: 8766

SEQ ID NO: 9514 - protein, 295 aa, Rhizobium sp. CF142; identical to SEQ ID NO: 8962

SEQ ID NO: 9515 - protein, 326 aa, Paraglaciecola chathamensis; identical to SEQ ID NO: 9372

SEQ ID NO: 9516 - protein, 347 aa, Pseudomonas sp. GM48; identical to SEQ ID NO: 8963

SEQ ID NO: 9517 - protein, 348 aa, Pseudomonas sp. GM49; identical to SEQ ID NO: 8965

SEQ ID NO: 9518 - protein, 353 aa, Pseudomonas sp. GM55; identical to SEQ ID NO: 8964

SEQ ID NO: 9519 - protein, 683 aa, Pseudoalteromonas; identical to SEQ ID NO: 9367

SEQ ID NO: 9520 - protein, 683 aa, Pseudoalteromonas sp. BSi20495; identical to SEQ ID NO: 9368

SEQ ID NO: 9521 - protein, 45 aa, Pseudoalteromonas sp. BSi20495; identical to SEQ ID NO: 9369

SEQ ID NO: 9522 - protein, 295 aa, Pseudoalteromonas sp. BSi20495; identical to SEQ ID NO: 9370

SEQ ID NO: 9523 - protein, 683 aa, Pseudoalteromonas sp. BSi20652; identical to SEQ ID NO: 9365

SEQ ID NO: 9524 - protein, 313 aa, Pseudoalteromonas sp. BSi20652; identical to SEQ ID NO: 9366

SEQ ID NO: 9525 - protein, 320 aa, Rhodanobacter sp. 115; identical to SEQ ID NO: 8898

SEQ ID NO: 9526 - protein, 695 aa, Vibrionales bacterium SWAT-3; identical to SEQ ID NO: 8785

SEQ ID NO: 9527 - protein, 310 aa, Zhongshania aliphaticivorans; identical to SEQ ID NO: 8895

SEQ ID NO: 9528 - protein, 329 aa, Alishewanella aestuarii; identical to SEQ ID NO: 8961

SEQ ID NO: 9529 - protein, 310 aa, Rhodopirellula maiorica; identical to SEQ ID NO: 9062

SEQ ID NO: 9530 - protein, 323 aa, Aliiglaciecola lipolytica; identical to SEQ ID NO: 9373

SEQ ID NO: 9531 - protein, 278 aa, Desulfonatronospira thiodismutans; identical to SEQ ID NO: 8824

SEQ ID NO: 9532 - protein, 329 aa, Rheinheimera sp. A13L; identical to SEQ ID NO: 8869

SEQ ID NO: 9533 - protein, 321 aa, Providencia burhodogranariea; identical to SEQ ID NO: 9000

SEQ ID NO: 9534 - protein, 686 aa, Halomonas sp. GFAJ-1; identical to SEQ ID NO: 8885

SEQ ID NO: 9535 - protein, 282 aa, Thiorhodovibrio sp. 970; identical to SEQ ID NO: 8891

SEQ ID NO: 9536 - protein, 323 aa, Neisseria sp. oral taxon 014; identical to SEQ ID NO: 8823

SEQ ID NO: 9537 - protein, 325 aa, Halomonas titanicae; identical to SEQ ID NO: 9060

SEQ ID NO: 9538 - protein, 277 aa, Bilophila sp. 4_1_30; identical to SEQ ID NO: 8874

SEQ ID NO: 9539 - protein, 294 aa, Acinetobacter sp. WC-323; identical to SEQ ID NO: 9001

SEQ ID NO: 9540 - protein, 299 aa, Marinomonas sp. MED121; identical to SEQ ID NO: 8776

SEQ ID NO: 9541 - protein, 160 aa, Actinobacillus pleuropneumoniae
MNYPNFYLLFDHVEIQAANTISSPITYGFPSLTGFTGAIHALSRKLFPQQVELGGVMIACHDYQILGYKNSDFSDLTFNQTRNPLKKNGDSPSIIEEGKIHLDISLVVEMEVKDPELYYALNSQDSEQKNNFLNIAKNCLCNNELPVVVFFKLKMLNSLI

SEQ ID NO: 9542 - protein, 142 aa, Actinobacillus pleuropneumoniae
MDAKQTLADITQSLQSGISNNEITIYPATPNANALDALLEVATLHHIPLSEHATSQEWETFNVNQGKGWLVPIPVGYQAISPLFTAGEMQNCRVTEYPSQYVETVYSLGKWVFPFSLPDDLSQCFWHYNTPQDNLYLITQGA

SEQ ID NO: 9543 - protein, 327 aa, Pseudomonas aeruginosa; identical to SEQ ID NO: 9281

SEQ ID NO: 9544 - protein, 120 aa, Verminephrobacter aporrectodeae
MPSKEGEATPADGKQRWADPLRGKGSGWTVPIPVGYAALSPRHLAGTVDNARNMGTPLRFVESVYSLGRWISPHRLSQPEELWWRAEIDEVKGLYRCRNAYVPAPTDPDENADWDDDSYD

SEQ ID NO: 9545 - protein, 315 aa, Psychrobacter sp. PAMC 21119
MSYLYPDKELVGYVLIKNIRVQNANAISSPITYGFPAITGFTGAIHALSRKISAIPELEKISLDGVLISCYECQPQIYREASYKEYTFNQTRNPILRSGKTASIIEEGRCHLRVSLVIGIYAEDDLEPEEQDCLLKTINIKVQQQRLAGGSVIGLDRFKPVTFVKDSEIKELTQSLLPAFILMNAQQELTDITQQLRKSNPEASALDALIATATLHHTPIDNGNGTSSWQTQSVKQGKGWLVPIPIGFQAISECYESGMMQNVRNPEYPSQYVESIYGLGKWVFPHRIDNLADALWYQHHDDANNLYLVTQNKGN

SEQ ID NO: 9546 - protein, 310 aa, Pectobacterium brasiliense
MSTLIILRRIKVENANAIAGLTYGFPAITHFLGFTHALSRKLQARHGLTLDGCGVVSHQHQLHAYGSSWERSFALTRNPLTKEAKTAAFNEEGRMHMTVSLLIRCEGQIPADTTALCDFLTQQAQCQRLAGGTIVDIERVTIQSLPSDEAETRKVMRRLLPGFVLKDRTSLLHDHFQTLQQDNPQAELIDAWLNFAALKMRAERDPNGSNVQWQYQPKPGGGGFLITLMIGYRAISPLYAPGEVDKTRDPHTPFCFAEAAYGIGEWQGAHRISDIRQILWEYDYQNGDYHCRQLADTHSAAEDISYEFDD

SEQ ID NO: 9547 - protein, 310 aa, Pectobacterium carotovorum
MSTLIILHRIKVENANAIAGLTYGFPAITHFLGFTHALSRKLQANHGLTLDGCGVVSHQHQLHAYGSSWERSFALTRNPLTKEAKTAAFNEEGRMHMTVSLLIRCEGQIPADTTALRDFLTQQAQCQRLAGGTIVDIKRVTIQSLPSDAAETRKVMRRLLPGFVLKDRTSLLYDHFQTLQQTNPHAELIDAWLDFAALKMRAERDPNGSNVQWQYQPKPGGGGFLIPLMIGYRAISPLYAPGEVDKTRDPHTPFCFAEAAYGIGEWQGAHRISDIRHIFWEYDYQNGDYHCRQLADTDSTAEDTSYEFDD

SEQ ID NO: 9548 - protein, 297 aa, Vibrio ordalii
MRLLILPHIKIHNANALSSPFTIGFPAMTAWLGFVHALERKLNQTGLEELMFRSAAVVSHQFDLQTHKGEGDFVHSIIGTGNPLDKDGSRSAFIEEARCHLDVSLVIECDGNDDELDHENFVVRLQDTIATMKVASGDVLSLQLPFLTTVKIDDELETAKLLRQLMPGYFLLERRDLMIEAMKQGHDALDALLSHLTVDHHCEQLKDETVVWRSQRKTAGWIVPIATGFQGISPLGEAKNQRDPSVPHRFAESVVTLGEFVMAYKIKHLDDMLWHYHSDLENNLYLCQQNNLINEHQ

SEQ ID NO: 9549 - protein, 316 aa, Pseudoalteromonas citrea; identical to SEQ ID NO: 9266

SEQ ID NO: 9550 - protein, 683 aa, Pseudoalteromonas undina; identical to SEQ ID NO: 9268

SEQ ID NO: 9551 - protein, 695 aa, Pseudoalteromonas arctica; identical to SEQ ID NO: 9265

SEQ ID NO: 9552 - protein, 683 aa, Pseudoalteromonas spongiae; identical to SEQ ID NO: 9267

SEQ ID NO: 9553 - protein, 683 aa, Pseudoalteromonas flavipulchra
MELHTLLQNTPSKELTQTLRAAFAPYSEHVDITGSEPQALVILINLTYKRKDIKDLTSTIAAKAALRDEQHLKTCIDEVKWYHTHNLKYPDIRVSHQRLLAGVFDDGHRVVSSSSYPMQFGWSHDSAKINHAKLFLTGFVWRGEYVCLAQLLAKQEGVWVAQFGELGLLKRDVIAVCEQIAAQLPHEELPEQISNYTLQLLIPIEHDYLSVSPVVSHAVLAALQMATRSGLLKRGIIEHNRPANVGELPSALGGRVNVLKYFAKTYCVTTVNDYYSQGEQRLFNVAALNSKTVSEALLVLSKSKPFNTLRQKRLARIAATKALRTALYGWLEKLIKLAQSGAINDSGPEPVKLLATQEYKQLELVLSQELNRQMSGLKYLKRYAYHPELMPILKAQRSYVLSHQNNQEDELEAEHIQYVHCQNLRVYNAEAMPNAYLMGMPSITALEGLGHQFQRKLQKLLGSGVHVIGVAVYIRSYQLHNNKQLPEPNKLKKDGQKRVPLRSAIMQIPKCDICFDLVFRVQTNNQAVANDLSENLLKAAFPSRYAGGTLHPPSLYDQVDWCQVYAKPLALFERIRSLPKGGSWLYPTSIEVSSFEELAEQLTLRPTMRPAALGYLALEEPKPRQGSITQLHCYVEPVIGLLECVDAVTVRLSGARHFFNHGFWAIHCKKASMLMKKAKFEYD

SEQ ID NO: 9554 - protein, 1019 aa, Sporolactobacillus vineae
MVRYLQITFLPHMENGWNFFIWLTDEAGSALPFPDSSNKPQERPAGEADDSVLPVGVKLTGESNDLFVSGRLMTMQSVFHLIQEQNGECGESDIRPGRTFQWLKRIASALEVLLEGGHFYPYFYHLDDHHHDVLYFCQWMPEAHFLIESGLFAGWLNSLPHLAFTLDALQDEKTSQWLYLLIIFWTGELVRGGAPAVPDTILEKNLSFSKEETEAVLRERLPFAYYGSPWLIVSDPESVKKANALETELTAWVHPAAGGKYPAWTRALLDDRRAWLTDHFSPDRVQVLLNPSDEDDPFSEDAVWECETVVAGEQNRTKQKRPLHDFIVRSPIESRIWLDKKIHQLNGSVPDLILDLLDQKPQRLLSTDQFSQLLASREPLASAGIDLVFANDLKIDEEASPVSVSLELEPDKPDGKSLFTLNALIHYNWRISVGEINLTAEEFRQLVQKNQSFIRRGNRWIHLPISQMVRAYTEMDDTLHLFHGKADVAGALRLDTLNRRKRDPRIRIQLTPDLENYINRIIRKPAKSIAVPAEFIGKLRPYQKKGFTWLVNLRRQRVGGCLADDMGLGKTVQAIAYLDYCRNLPLAGMPKGGIVGPALVICPTSLVANWKHECGTFSPELRLYIHHGSSRLRGEELIHRLGECDVMITSYALYTKESEFLNPVYWKSVILDEAQAIKNPRAQKTRALRKIHCAHRLVLTGTPIENHLEELWSIMDFLNPGYLGSLDHFRRQYVRPVEKKDNRVKMNELTRMIQPFLLRREKTDKRIIRDLPDKFEAKKSCFLSKDQASLYQNVVDRLARSVTASSGIRRKGLILSALTKLKQICDHPALLAGEAGEDKKSGKLELFFSLLDPLFKHQEKVLVFTQYVKMGKLLMRETRKRYPDADVFFLYGGLNAEQRSALIQRFQSETHRKTLFILSLKAGGLGINLTAAGYVFHYDRWWNPAVEEQATDRAYRIGQERNVHVYKLICEGTLEERIDLLIDRKKNLQRQILGSGDAWLTELSDSELFNLIKLRKGVV

SEQ ID NO: 9555 - protein, 291 aa, Treponema pallidum; identical to SEQ ID NO: 8615

SEQ ID NO: 9556 - protein, 327 aa, Pasteurella multocida; identical to SEQ ID NO: 8616

SEQ ID NO: 9557 - protein, 310 aa, Pectobacterium atrosepticum; identical to SEQ ID NO: 8745

SEQ ID NO: 9558 - protein, 332 aa, Chromobacterium violaceum; identical to SEQ ID NO: 8618

SEQ ID NO: 9559 - protein, 322 aa, Photorhabdus laumondii; identical to SEQ ID NO: 8743

SEQ ID NO: 9560 - protein, 316 aa, Yersinia pseudotuberculosis; identical to SEQ ID NO: 8648

SEQ ID NO: 9561 - protein, 313 aa, Legionella pneumophila; identical to SEQ ID NO: 8747

SEQ ID NO: 9562 - protein, 313 aa, Legionella pneumophila; identical to SEQ ID NO: 8746

SEQ ID NO: 9563 - protein, 337 aa, Zymomonas mobilis; identical to SEQ ID NO: 8620

SEQ ID NO: 9564 - protein, 108 aa, Candidatus Koribacter versatilis
MGAADPLGNSRPGPVLAYVRPNVSADPDRKRVWPRRLGLIIFVVFCMEVGIMLAVLPWKQVWMSNPLVMKFPALRAFLGHFFVRGLFSGLGLVDLWIGIWEAVHYSEE

SEQ ID NO: 9565 - protein, 701 aa, Shewanella sp. ANA-3; identical to SEQ ID NO: 8628

SEQ ID NO: 9566 - protein, 318 aa, Psychromonas ingrahamii; identical to SEQ ID NO: 8629

SEQ ID NO: 9567 - protein, 316 aa, Shewanella; identical to SEQ ID NO: 8630

SEQ ID NO: 9568 - protein, 360 aa, Acidovorax sp. JS42; identical to SEQ ID NO: 8631

SEQ ID NO: 9569 - protein, 347 aa, Verminephrobacter eiseniae; identical to SEQ ID NO: 8632

SEQ ID NO: 9570 - protein, 319 aa, Actinobacillus pleuropneumoniae; identical to SEQ ID NO: 8633

SEQ ID NO: 9571 - protein, 316 aa, Dichelobacter nodosus; identical to SEQ ID NO: 8637

SEQ ID NO: 9572 - protein, 339 aa, Coxiella burnetii; identical to SEQ ID NO: 8641

SEQ ID NO: 9573 - protein, 320 aa, Coxiella burnetii; identical to SEQ ID NO: 8640

SEQ ID NO: 9574 - protein, 310 aa, Enterobacter sp. 638; identical to SEQ ID NO: 8636

SEQ ID NO: 9575 - protein, 331 aa, Shewanella baltica; identical to SEQ ID NO: 8638

SEQ ID NO: 9576 - protein, 316 aa, Yersinia pseudotuberculosis complex; identical to SEQ ID NO: 8639

SEQ ID NO: 9577 - protein, 640 aa, Vibrio campbellii; identical to SEQ ID NO: 8642

SEQ ID NO: 9578 - protein, 331 aa, Shewanella baltica; identical to SEQ ID NO: 8644

SEQ ID NO: 9579 - protein, 362 aa, Delftia acidovorans; identical to SEQ ID NO: 8643

SEQ ID NO: 9580 - protein, 319 aa, Actinobacillus pleuropneumoniae; identical to SEQ ID NO: 8646

SEQ ID NO: 9581 - protein, 316 aa, Yersinia pseudotuberculosis; identical to SEQ ID NO: 8647

SEQ ID NO: 9582 - protein, 313 aa, Erwinia tasmaniensis; identical to SEQ ID NO: 8751

SEQ ID NO: 9583 - protein, 690 aa, Aliivibrio fischeri; identical to SEQ ID NO: 8652

SEQ ID NO: 9584 - protein, 320 aa, Coxiella burnetii; identical to SEQ ID NO: 8653

SEQ ID NO: 9585 - protein, 701 aa, Shewanella baltica; identical to SEQ ID NO: 8657

SEQ ID NO: 9586 - protein, 314 aa, Erwinia pyrifoliae; identical to SEQ ID NO: 8754

SEQ ID NO: 9587 - protein, 336 aa, Laribacter hongkongensis; identical to SEQ ID NO: 8658

SEQ ID NO: 9588 - protein, 325 aa, Tolumonas auensis; identical to SEQ ID NO: 8659

SEQ ID NO: 9589 - protein, 316 aa, Dickeya paradisiaca; identical to SEQ ID NO: 8660

SEQ ID NO: 9590 - protein, 313 aa, Dickeya chrysanthemi; identical to SEQ ID NO: 8661

SEQ ID NO: 9591 - protein, 337 aa, Zymomonas mobilis; identical to SEQ ID NO: 8662

SEQ ID NO: 9592 - protein, 318 aa, Dickeya zeae; identical to SEQ ID NO: 8666

SEQ ID NO: 9593 - protein, 327 aa, Xanthomonas albilineans; identical to SEQ ID NO: 8756

SEQ ID NO: 9594 - protein, 322 aa, Thioalkalivibrio sp. K90mix; identical to SEQ ID NO: 8667

SEQ ID NO: 9595 - protein, 309 aa, Nitrosococcus halophilus; identical to SEQ ID NO: 8668

SEQ ID NO: 9596 - protein, 461 aa, Coraliomargarita akajimensis; identical to SEQ ID NO: 8669

SEQ ID NO: 9597 - protein, 319 aa, Desulfurivibrio alkaliphilus; identical to SEQ ID NO: 8672

SEQ ID NO: 9598 - protein, 309 aa, Nitrosococcus watsonii; identical to SEQ ID NO: 8673

SEQ ID NO: 9599 - protein, 335 aa, Dickeya dadantii; identical to SEQ ID NO: 8674

SEQ ID NO: 9600 - protein, 319 aa, Halomonas elongata; identical to SEQ ID NO: 8758

SEQ ID NO: 9601 - protein, 682 aa, Pseudoalteromonas; identical to SEQ ID NO: 8682

SEQ ID NO: 9602 - protein, 328 aa, Desulfurispirillum indicum; identical to SEQ ID NO: 8684

SEQ ID NO: 9603 - protein, 276 aa, Burkholderia sp. CCGE1001; identical to SEQ ID NO: 8686

SEQ ID NO: 9604 - protein, 331 aa, Marinomonas mediterranea; identical to SEQ ID NO: 8689

SEQ ID NO: 9605 - protein, 297 aa, Sphaerochaeta coccoides; identical to SEQ ID NO: 8690

SEQ ID NO: 9606 - protein, 372 aa, Delftia sp. Cs1-4; identical to SEQ ID NO: 8691

SEQ ID NO: 9607 - protein, 295 aa, Methylomonas methanica; identical to SEQ ID NO: 8692

SEQ ID NO: 9608 - protein, 223 aa, Treponema paraluiscuniculi; identical to SEQ ID NO: 8693

SEQ ID NO: 9609 - protein, 295 aa, Megasphaera elsdenii; identical to SEQ ID NO: 8761

SEQ ID NO: 9610 - protein, 311 aa, Klebsiella; identical to SEQ ID NO: 8700

SEQ ID NO: 9611 - protein, 699 aa, Vibrio sp. EJY3; identical to SEQ ID NO: 8701

SEQ ID NO: 9612 - protein, 577 aa, Burkholderia sp. YI23; identical to SEQ ID NO: 8699

SEQ ID NO: 9613 - protein, 327 aa, Pasteurella multocida; identical to SEQ ID NO: 8698

SEQ ID NO: 9614 - protein, 458 aa, Treponema pallidum
MEQGILWVLRVWGSGQSVREGGDSAELGARQATREQQCSDREERDGALAIRRGMSLDLVENGMPVYYFAARAQPPAVAPANDILWDAGVHARPLERLHPSPSPARSPSPSHLLPGCSYNSTLSGDYARAAAAAGAGVDINFPVYGGVLHASQASNVFQGVFLTDTTPMRTHDIPRSPLVGHKKNAAPDGIGASRACCPARENEPFKKGSTNSRGGGVEWSRSSTRRVRGSALERGMKQLKWWAVGPVLGICAGVWGAAHPVHADPWDTTAAGRSTIRLSAMGAVPLFQVDWCNSGRGDDRNANAQTNGHKYIYPAFSAALGFEHFVCRGLSLGIDASVQYHCSYPNNTYSPTTPYYYLAIPVALTAGYTVAFWRIRLPLTVGAGFNYQHYYTSTYYGLVLKAAAGCYFQLTEHWSLGVSATYSGVPRSCEKIIEEDRQQTNTRTAQFIAAGVDVRYHL

SEQ ID NO: 9615 - protein, 223 aa, Treponema pallidum; identical to SEQ ID NO: 8703

SEQ ID NO: 9616 - protein, 327 aa, Pasteurella multocida; identical to SEQ ID NO: 8706

SEQ ID NO: 9617 - protein, 310 aa, Selenomonas ruminantium; identical to SEQ ID NO: 8741

SEQ ID NO: 9618 - protein, 295 aa, Spirochaeta africana; identical to SEQ ID NO: 8707

SEQ ID NO: 9619 - protein, 337 aa, Zymomonas mobilis; identical to SEQ ID NO: 8694

SEQ ID NO: 9620 - protein, 335 aa, Xanthomonas campestris; identical to SEQ ID NO: 8695

SEQ ID NO: 9621 - protein, 315 aa, Providencia stuartii; identical to SEQ ID NO: 8708

SEQ ID NO: 9622 - protein, 310 aa, Pectobacterium parmentieri; identical to SEQ ID NO: 8711

SEQ ID NO: 9623 - protein, 313 aa, Methylophaga frappieri; identical to SEQ ID NO: 8712

SEQ ID NO: 9624 - protein, 337 aa, Zymomonas mobilis; identical to SEQ ID NO: 8714

SEQ ID NO: 9625 - protein, 310 aa, Pectobacterium carotovorum; identical to SEQ ID NO: 8715

SEQ ID NO: 9626 - protein, 328 aa, Alcanivorax; identical to SEQ ID NO: 8716

SEQ ID NO: 9627 - protein, 331 aa, Thioalkalivibrio nitratireducens; identical to SEQ ID NO: 8718

SEQ ID NO: 9628 - protein, 336 aa, Desulfovibrio hydrothermalis; identical to SEQ ID NO: 8767

SEQ ID NO: 9629 - protein, 295 aa, Taylorella asinigenitalis; identical to SEQ ID NO: 8763

SEQ ID NO: 9630 - protein, 289 aa, Taylorella equigenitalis; identical to SEQ ID NO: 8762

SEQ ID NO: 9631 - protein, 309 aa, Serratia sp. FGI94; identical to SEQ ID NO: 8720

SEQ ID NO: 9632 - protein, 275 aa, Yersinia pestis; identical to SEQ ID NO: 8664

SEQ ID NO: 9633 - protein, 317 aa, Rahnella aquatilis; identical to SEQ ID NO: 8702

SEQ ID NO: 9634 - protein, 310 aa, Pectobacterium parmentieri; identical to SEQ ID NO: 8663

SEQ ID NO: 9635 - protein, 320 aa, Photorhabdus asymbiotica; identical to SEQ ID NO: 8752

SEQ ID NO: 9636 - protein, 335 aa, Desulfovibrio magneticus; identical to SEQ ID NO: 8740

SEQ ID NO: 9637 - protein, 294 aa, Acinetobacter sp. CIP 110321; identical to SEQ ID NO: 9129

SEQ ID NO: 9638 - protein, 307 aa, Escherichia coli; identical to SEQ ID NO: 9136

SEQ ID NO: 9639 - protein, 307 aa, Escherichia; identical to SEQ ID NO: 9144

SEQ ID NO: 9640 - protein, 307 aa, Escherichia; identical to SEQ ID NO: 9140

SEQ ID NO: 9641 - protein, 460 aa, Bilophila wadsworthia; identical to SEQ ID NO: 8845

SEQ ID NO: 9642 - protein, 327 aa, Halomonas anticariensis; identical to SEQ ID NO: 9148

SEQ ID NO: 9643 - protein, 372 aa, Delftia acidovorans; identical to SEQ ID NO: 9150

SEQ ID NO: 9644 - protein, 327 aa, Pasteurella multocida; identical to SEQ ID NO: 8732

SEQ ID NO: 9645 - protein, 327 aa, Pasteurella multocida; identical to SEQ ID NO: 9151

SEQ ID NO: 9646 - protein, 695 aa, Vibrio cyclitrophicus
MTKLSGLLAIEDEAVKQAALKKMSMPYTEDVCVDGFEKEALTILLNLSSSHQADRCSDWLDVARAKRHLKVAENLEASLDEIKWFHTHNLKFPDCRVKDQRIIAQPLATTEAFISSSVLEQSLGWGHNSAVYRHTLWLLNPFRWQSQSVSLLSLVQQETPVWVELLKEFGLGANSLARLKHTIEEQLPENSFPDSVSTYSKQLRFPWGDDYVSVTPVVSHAIQRELEVRSRSRESKLSFVSSSLPNSASIGNLCGSLGGHMKVLNYPLDVKPAQGRTLTESRKKSGRYFDDYQVTNAKICQVLNHLIGSEPSKTQKQRESARKVRSKILRKQIALWMLPLIELRDIVDADLNQQQLEHDDTLAQAFLALPESGLGSLASEFNRRLHLTFQNNKYAAKFAYHPKLMEVAKAQIVWVLEQLGKPNGNEDKVTGEQYIYLSSMRVQDAVAMSSPYLSGAPALAPIWGFMHRYQREFNKLVNCDSLFEFSSFSFYVRSENIQPTAKLTEPNSVAKARTVSNAKRPTIRSERLADLEIGLVIRVHSDSRISDFKSALKTALPVAFAGGALYQPQLSTQVEWLKTFTSRSELFHVLKGLPAYGRWLYPSEKQPNDFDELERLITKDADNLPVSIGYHLLERPTKRCNSITGCHAYAENAMGLAKRVNPIEVRFSGRDHFLNHAFWSIECSSETILIKNYRD

SEQ ID NO: 9647 - protein, 640 aa, Vibrio cyclitrophicus
MESLKELLQSRPDDLNVELKRAFRPLTPHIKIDGKELDALTVLVNLTDKTAVQKDLLDRVKCKQKLRDEKWWAHCLKTVEYRQSHNLKFPDIRSEGVIRATPLGQLPEFILSSSKFEPHHWAYSHDSSDVNKSSLLTNEFSWNCVISCLGDLLKDVEHPLWQKLNTLGCYQKTRKAIAKKLAQISQTTIKVSLAPNYLTQLSLPDNDSSYISLSPVASQSMQSHCYQALETEYRYTALTRYSRGTNMGVLPMTCGGALKMLKAVPNFSLTPHYQINIGKSWLTSSHIQSLKQYQTHTQYLMPKNKRVAYRRTVKNEIQEMVKAWLLIQDRTMDVNTLVQHLNHDLSRIKLAKCFAYEPSITKLLLGLIKRELNEHRSDSTNVGGSEKKDSFFAIPNIRVCGASALSSPITVGLPSLTAFLGFTHAFERNLNESFPTLTIDSFAICVHQLHVENRGLTKEYVQKANHTISPPATHDDWQCDLVFSLVIKFDRSLNVDENTVVRALPKRFARGSAKIAIADFKYIKSFARLEKAIQFLPQKAGKWLSMHIEPIESIGDILSEVKENRKLAPSCVGYHFLEDPTDKPNSLRGYKHAFSECIIGLIEPITFDQNTDINTILWHHKCYQNYLSVQPSSTYHGTTD

SEQ ID NO: 9648 - protein, 314 aa, Enterovibrio norvegicus
MAYLVLKNIQISNANAISGMTWGFPAVSHFLGFVHALSRHTERSEFGFSLDACAIVCNQHQVHAHRENAYEPYAFSLTRNPLTKEGKTAPIVEEGRMHLTVSLVIECNGVNRVTDDMERAQSDFVKRLAERNKLAGGTITDIGACYFSDEPHAKLLRRLLPGFILVDRSQYLAEQNEQCNESALQNWLDFSALKYQATDTPLSAEEHKESPKVEWQRVKSSFDGYLVPIQIGYKKIAPTYAAGDVANTRDNDTPVSFVEAIYSVGEWVGSPSRLTSMQQALWQHAYRDPFYVCHTQSQLSANVDPIDLDDDFLE

SEQ ID NO: 9649 - protein, 690 aa, Aliivibrio fischeri
MEFTDILIIQDVKERNRALKVTFAHYSSAICIDDHEVEAITCLLNLCTPKTEDYLDKTSASLFLNNQDNIQKCLDELKWFHSHNVKYPDCRVKGQNIISLPIDSVDNTINSNVVPYRLGWSHDSGKVNYTHFLLSFFKWRGSQTTLSQLFITDTLFWLDIIKKIQCNWTKKQTEQFIHSIHKEMPAKTLPENISPYSKQILFPYKNDYLTLTPVTSNSVQTWLEHQSRKPNDIHWIKRESKHPASVGALSSSIGGYHCLIFSPPNTSQSPHSYHDNMTSKTECREAFCASAITEKSTTDALQRLISSEVRMNVKHRKQIRKSGLHFIRQKIALWLTPLIRWRDHIDNNQIQITNDHPSLVNLFLSSPIANFPDLLTPLHNHLNQTLGKNKYTKRFAYHPNLMPIFKSQISWILNKLAQDENINQQPVLTRTQFIHLKNLRLYNGNALNSPYVCGLPSLTGFWGFMHDFERRLKTKIEENIHFEAFSLFVHQYELQSSPPLCEASDVYKKRELSPAKRLLTQPSYSCDMRFDLIINVHTEVNLSDISQRMLSAMPTRCVGGTLHQPSLHESLEWLRTYTSSEPLFEELACFPNSGRWIYPPSETFNTPDEFLSILGNSTHLAICNGYSFLEDPTNRENVSLNQHVFCEPLIGLAEQIIPIDMRLNRQKHYFSNAFWSINSDFNSILIQKHE

SEQ ID NO: 9650 - protein, 695 aa, Vibrio rumoiensis
MAKLKDLINEKNEVDRQTVLKKAFMPYSELIDVDGDEFNALIILLNLSLSKPECSNWLDSARAKGYLIDPKHIDIICNEIKWLHSHNLKFPDCRVKDQRIIAHPLLFDASFISSAYLSSSLGWSHNSAVYKHTVWLLSTFIWQGETWCLLDLIRQSDPLWLKLLKQFGLKAASLKLLQQAITCDLPEKPDFPSEIDRFSKQVRFPWGSDYLSITPVVSHAIQLEIEKLARDKSSGLNFTTLAFPNSASIGNLCASVGGNMKALHYPLGLNKDPKSTFSASRNKTGKWFDDYQLTNRKFCKVLSHLCGSESLHTAKKQQRARHFQLRIVRKQIALWLLPLIELRDHLTAENDVSQVSDDNSAITEFLHGDEFQIIKLLNPLNHLLQQTLQLNQYSSRYAYHPKLLIPLKQQLQWILDQLSKPSVPSDVTKTQEQYIHLSSLRVEDANAMSSPYLCGCLSLTALWGFIHHYQRQFNQSLSDSAVFQFQSVAIFYRNENIKSAAKLTEPSVLKAKRTISKVKRSTILPARTVNLEFDVVIKVQGQGCLSDYTKQLKASLPSSLGGGSLFQPNLHLKTNWIETYRSQTDLFYRIKSFPAFGTWLFPEEQQPISFTELTELLSNDGELIPVTNGFHFLEHPAERMNSLTDIHVYAENTTGVAKCVNAIDVRFSGRDHFFKQAFWKQENNEATILIQKDKN

SEQ ID NO: 9651 - protein, 695 aa, Vibrio breoganii
MTKLSDLLAIEDEVVKQASLKKMFMPYTEDVCVEGFEKEALTILLNLSSSHQSDRCSDWLDVARTKRHLKAAENLEASLDEIKWFHTHNLKFPDCRVKDQRIVAQPLATAEVFISSAVLDQRLGWAHNSAVYRHTLWLLNPFSWQSQPVCILSLIQQESPVWIELLKEFGLGAKSLARLKHTIEEQLPDNHFPDSVSTYSKQLRFPWGDDYVSVTPVVSHAIQSELEVRSRSQESQLSFVSLSLPNSASIGNLCGSLGGYMKVLNYPLNVKPAQGGTLPESRKKSGHYFDDYQVTNAKICQVLNHLIGSEPSKTQKQRESARKVRSKILRKQIALWMLPLIELRDIVDADPNQQQLEHDDTLAQAFLTLPESDLGSLASEFNRHLHLTFQNNKYAAKFAYHPKLMQVVKAQIVWVLEQLSKPNGNEDKVTGEQYIYLSSMRVQDAVAMSNSYLCGAPSLTAIWGFMHHYQREFNKLVNCDSPFEFSSFSFYVRSENIQPTAKLTEPSSVAKARTVSNAKRPTIRSERLADLEIDLVIRVHSDSRISDFKSALKTALPVAFAGGALYQPQLSTQVEWLKTFTSRSELFHVLKGLPAYGRWLYPSEKQPKDFDELERLITKDADNLPVSIGYHLLERPTKRCNSITGCHAYAENAIGLAQRVNPIEVRFSGRDHFLNHAFWSIECSSETILIKNYRD

SEQ ID NO: 9652 - protein, 695 aa, Vibrio ordalii
MTKLNDLLAIEGETVKQAVLKKMFMPYTENVCIDGLEKEALTILLNLSSNHKGDKCTDWLDVARAKKYLKNDENLAESLAEIQWLHTHNLKFPDCRVKDQRIIARPLSTTEEFISSAGLDQRLGWAHNSAVYRHTLWLLNPFKWQSQPVCILSLIQQKNPVWLDLLTEFGLDVKSLARLQRAIEEQLPENSFPDSVSTYSKQLRFPWGDDYVSITPVVSHALQCELEIRARSPENKLSFVSSSLPNSPSIGNLCGSLGGYMRVLNYPLGVKQTKGGTLTASRQKSGHYFDDYQVTNAKICQVLNRLIGSEPAKTQRQRERARQVRSKILRKQIALWMLPLIELRDIAESEPNQQQLEYDDTLAQAFLSLPELELGSLAGEFNRRLHLALQNNMYSAKFAYHPKLMQVAKAQVTWVLDQLSKPINNQDTVTGEQYIYLSSMRVQDAVAMSNPCLCGAPSLTAIWGFMHDYQRQFNQLVNNGSPVEFSSFAFYVRNENIQSTAKLTEPNSVAKARTVSNAKRPTIRSERLSDLEIDLVIRVNSESRISDFESALKTALPSSFAGGALYQPLISSQIDWLRTFTSKGELFHVLKGLPAYGRWLYPSEKQPASFDELEQFLAKDADILPVSIGYHLLEHPTDRGNSITDCHAYAENALGISKRLNPIEVRFSGRDHFFSQAFWSLECSSEAILIKNDRN

SEQ ID NO: 9653 - protein, 695 aa, Vibrio anguillarum
MTKLSDLLAIEDEAIKQTALKKMSMPYTEDVCVDGYEQETLTILLNLSSSHQADRYSDWLDVARAQRYLKDRENLDASLAEIQWFHTHNLKFPDCRVKDQRIIARPLSTTEEFISCAGLDQRLGWAHNSAVYRHTSWLLNPFKWQSQPVCILSLIQQKNPVWLDLLTEFGLDVKSLARLQRAIEEQLPENSFPDSVSTHSKQLRFPWGDDYVSITPVVSHALQCELEIRARSPENKLSFVSSSLPNSPSIGNLCGSLGGYMRVLNYPLGVKQTKGGTLTASRQKSGHYFDDYQVTNAKICQVLNRLIGSEPAKTQRQRERARQVRSKILRKQIALWMLPLIELRDIAESEPNQQQLEYDDTLAQAFLSLPELELGSLAGEFNRRLHLALQNNMYSAKFAYHPKLMQVAKAQVTWVLDQLSKPINNQDTVTGEQYIYLSSMRVQDAVAMSNPCLCGAPSLTAIWGFMHDYQRQFNQLVNNGSPVEFSSFAFYVRNENIQSTAKLTEPNSVAKARTVSNAKRPTIRSERLSDLEIDLVIRVNSESRISDFESALKTALPSSFAGGALYQPLISSQIDWLRTFTSKGELFHVLKGLPAYGRWLYPSEKQPASFDELEQFLAKDADILPVSIGYHLLEHPTDRGNSITDCHAYAENALGISKRLNPIEVRFSGRDHFFSQAFWSLECSSEAILIKNDKN

SEQ ID NO: 9654 - protein, 695 aa, Vibrio crassostreae
MTKLSDLLTIEDEAVKQSALKKMFMPYTEDVCVDGCEKEALTILLNLSSSHQSDRCLDWLDVARAKRHLKAAENLEASLGEIKWFHTHNLKFPDCRVKDQRIIAQPLATTEAFISSSVLEQRLGWAHNSAVYRHTLWLLNPFSWQSQRLCILSLIQQESPVWIELLKEFGLGAKSLARLKHTIEKQLPDNHFPDSVSSYSKQLRFPWEGGYISVTPVVSHAIQSELEVRSRSQESKLSFVSSSLPNSASIGNLCGSLGGHMKVLNYPLDVKPAQGGTLTESRKKSGHYFDDYQVTNAKICQVLNHLIGSEPSKTQKQRESARKVRSKILRKQIALWMLPLIELRDIVDAEPNQQKLKHDDTLVQSFLSLPESDLGSLASELNRRLHLSFQNNKYAAKFAYHPKLMQVAKAQIVWVLEQLSKPNGNEDKVTGEQYIYLSSMRVQDAVAMSSPYLCGAPSLTAIWGFMHHYQREFNKLVNCDFPFEFSSFSFYVRSENIQPTAKLTEPNSVAKARTVSNAKRPTIRSERLADLEIDLVIRVHSDSRISDFKSALKTALPVAFAGGALYQPQLSTQIEWLRTFTSRSELFHVIKGLPAYGRWLYPSENQSSDFDELERFITKDADNLPVSIGYHLLEQPTKRGNSITRCHAYAENAIGLAKKVNPIEVRFSGRDHFLNHAFWSIECSSETILIKNYRD

SEQ ID NO: 9655 - protein, 695 aa, Vibrio crassostreae
MTKLSDLLTIEDEAVKQSALKKMFMPYTEDVCVDGCEKEALTILLNLSSSHQSDRCLDWLDVARAKRHLKAAENLEASLGEIKWFHTHNLKFPDCRVKDQRIIAQPLVTIEAFISSAVLEQRLGWAHNSAVYRHTLWLLNPFSWQSQPVCILSLIQQESPVWIELLKEFGLGAKSLARLQNTMAEQLPENSFPDSVSTYSKQLRFPWEGDYISVTPVVSHAIQSELEVRSRSQESKLSFVSSSLPNSASIGNLCGSLGGHMKVLNYPLDVKPAQGGTLTESRKKSGHYFDDYQVTNAKICQVLNHLIGSEPSKTQKQRESARKVRSKILRKQIALWMLPLIELRDIVDADPNQQQLEHDDTLAQAFLTQPESDLGSLASEFNRCLHLAFQNNKYAAKFAFHPKLMQVVKAQIVWILEQLSKPNGNEEKVTGEQYIYLSSMRVQDAVAMSSPYLCGAPSLAAIWGFMHHYQREFNKLVNCDSPFEFSSFSFYVRSEKIQPTAKLTESNSVAKARTVSNAKRPTIRSERLADLEIDLVIRVHSDSRISDFKSALKTALPVAFAGGALYQPQISKQVEWLKTFTSRSELFHLIKGLSAYGRWLYPSENQPSDFDELERFITKDADNLPVSIGYHLLEQPTKRGNSITGCHAYAENAIGLAQRVNPIEVRFSGRDHFLNHAFWSIECSSETILIKNYRD

SEQ ID NO: 9656 - protein, 695 aa, Vibrio splendidus
MTKLSDLLAIEDEAVKQSALKKMFMPYTEDVCVEGYEKEALTILLNLSSSHQADRCSDWLDVARAKRHLKATENLEASLDEIKWFHTHNLKFPDCRVKDQQIVAQPLVTTEAFISSAVLEQRLGWAHNSAVYRHTLWLLNPFSWQSQPVYILSLIQQDSPVWIELLKEFGLGAKSLARLKHTIEEQLPDNHFPDSVSTYSKQLRFPWGDDYVSVTPVVSHAIQSELEVRSRSRESQLSFVSSLLPNPASIGNLCGSLGGHMKVLNYPLDVKPAQGGTLPESRKKSGHYFDDYQVTNAKICQVLNHLIGSEPSKTQKQRESARKVRSKILRKQIALWMLPLIELRDIVDADLNQQQLDHDDNLAQAFLTLPESNLGSLASEFNRRLHLTFQNNKFAAKFAYHPKLMQVAKAQIVWVLEQISKPNGNEDKVTGEQYIYLSSMRVQDAVAMSCPYLCGAPSLAAIWGFMHHYQREFNKLVNCDSPFEFSSFSFYVRSENIQPTAKLTEPNSVAKARTVSNAKRPTIRSERLADLEIDLVIRVHSDSRISDFKSALKTALPVAFAGGALYQPQLSTQVEWLKTFTSRSELFHVIKGLPAYGLWLYPSEKQPNDFNDLERLNTKDADNLPVSIGYHLLERPTKRYNSITGCHAYVENAIGLAKRVNPIEVRFSGRDHFLNHAFWSIECSSETILIKNYRD

SEQ ID NO: 9657 - protein, 660 aa, Vibrio tasmaniensis
TQCPKLLVRINLSSSHQADRCSDWLDITRAKRHLKAAENLEASLDEIKWFHTHNLKFPDCRVKDQRIIAQPLVTTEAFISSAVLEQRLGWAHNSAVYRHTLWLLNPFRWQSQSVCILSLIQQESPIWVGLLKEFGLSAKSLTRLQNTLAEELPENSFPDSVSTYSKQLRFPWGDDYVSVTPVVSHAIQSELEVRSRSQESKLSFVSSSLPNSASIGNLCGSLGGHMKVLNYPLDVKPAQGGTLTESRKKSGHYFDDYQVTNAKICQVLNHLIGSEPSKTQKQRESARKVRSKILRKQIALWMLPLIELRDIVDAAPNQQQLEHDDTLAQAFLTRPEADLGSLASEFNRRLHLTFQNNKYAAKFAYHPKLMQVVKAQIVWVLEQISKPNGNEDKVTGEQYIYLSSMRVQDAVAMSSPYLCGAPSLTAIWGFMHHYQREFNKLVNCDSPFEFSSFSFYVRSENIQPTAKLTEPNSVAKARTVSNAKRPTIRSERLADLEIDLVIRVHSDSRISDFKTALKTALPVAFAGGALYQPQLSTQIEWLRTFTSRSELFHVIKGLPAYGRWLYPSENQPSDFDELERLITKDADNLPVSIGYHLLERPTKRGNSITSCHAYAENAMGLAQRVNPIEVRFSGRDHFLNHAFWSIECSSETILIKNYRD

SEQ ID NO: 9658 - protein, 695 aa, Vibrio tasmaniensis
MTKLSDLLAIEDEAVKQITLKKMFMPYTEDVCVEGCEKEALTILLNLSSSHQSDRCLDWLDVARAKRHLKAAENLKASLDEIKWFHTHNLKFPDCRVKDQRIIAQPLATTEAFISSSVLEQSLGWGHNSAVYRHTLWLLNPFSWQSQSVSLLSLVQQETPVWVELLKEFGLGANSLARLKHTIEEQLPENSFPDSVSTYSKQLRFPWGDDYVSVTPVVSHAIQRELEVRSRSRESKLSFVSSSLPNSASIGNLCGSLGGHMKVLNYPLDVKPAQGGTLTESRKKSGHYFDDYQVTNAKICQVLNHLIGSEPSKTQKQRESARKVRSKILRKQIALWMLPLIELRDIVDADPNQQQLEHDDTLAQAFLALPESDLGSLASEFNRLLHLTFQNNKYAAKFAYHPKLMQVAKAQIVWVLEQLSKPTGNEGKVTGEQYIYLSSMRVQDAVAMSSPYLCGAPSLTAIWGFMHHYQREFNKLVNCDSPFEFSSFSFYVRSENIQPTAKLTEPNSVAKARTVSNAKRPTIRSERLADLEIDLVIRVHSDSRISDFKSALKTALPVAFAGGALYQPQLSTQVEWLKTFTSRSELFHVLKGLPAYGRWLYPSEKQPNDFDELERLITKDADNLPVSIGYHLLERPTKRGNSITSCHAYAENAIGLAQRVSPIEVRFSGRDHFLNHAFWSIECSSETILIKNYRD

SEQ ID NO: 9659 - protein, 695 aa, Vibrio
MTKLSDLLAIEDEAVKQITLKKMFMPYTEDVCVEGFEKEALTILLNLSSSHRSDRCSDWLDVARAKRHLKAAENLEASLDEIKWFHTHNLKFPDCRVKDQRIIAQPLATTEAFISSSVLEQSLGWAHNSAVYRHTLWLLNPFRWQSQSVSLLSLVQQETPVWVELLKEFGLGANSLARLKHTIEEQLPENSFPDSVSTYSKQLRFPWEDDYVSVTPVVSYAIQSELEVRSRSRESKLSFVSSSLPNSASIGNLCGSLGGHMKVLNYPLDVKPAQGGTLTESRKKSGHYFDDYQVTNAKICQVLNHLIGSEPSKTQKQRESARKVRSKILRKQIALWMLPLIELRDIVDADPNQQQLERDDTLAQAFLTQPESDLGSLASEFNRCLHLAFQNNKYAAKFAYHPKLMQVVKAQIVWILEQISKPNGNEDKVTGEQYIYLSSMRVQDAVAMSSPYLCGAPSLTAIWGFMHRYQREFNKLVNCDSPFEFSSFSFYVRSEKIQPTAKLTEPNAVAKARTVSNAKRPTIRSERLADLEIDLVIRVHSDSRISDFKSALKTALPVAFAGGALYQPQLSTQVEWLKTFTSRSELFHVLKGLPAYGRWLYPRENQPSDFDELERLITKDADNLPVSIGYHLLERPTKRGNSITSCHAYAENAIGLAQRVNPIEVRFSGRDHFLNHAFWSIECSSETILIKNYRD

SEQ ID NO: 9660 - protein, 115 aa, Arthrobacter sp. M2012083
MADGTCLLILTGAFHRFKAIGLKQAETVDNYTKREQRWQNEAMPRFLTLADVAEQLQINSPQAYALVRSGELKAIQVGGRGQWRIEEKMLEQYIEDRYAEASRMIEEAKNKVNQP

SEQ ID NO: 9661 - protein, 683 aa, Pseudoalteromonas sp. NJ631
MELHTLLQNTSSKELTQKLRAAFAPYSEHVDITGSEPQALLILINLTYKRKDIKDLACVNSAKAALRDEQHLKTCIDEVKWYHTHNLKYPDIRVSHQRLLAQVVDDGLRVVSSASYPMQFGWSHDSAKINHAKLFLTGFVWRGEYVCLAQLLAKQEGFWVAQFRELGLLKRDVIAVCEQIAAQLPHEELPEQISNYTLQLLIPIEHDYLSVSPVVSHAVLAALQMATRSGLLKRGIIEHNRPANVGELPSALGGRVNVLKYFAKTYSATTVNDYYSQDEQRLFNVASLNSKTVGEALLVLSKSKPFNTLRQKRLARIAATKALRTALYGWLEKLIKLAQSGAINDSGPEPVKLLAMQEYKQLELVLSQELNRQMSGLKYLKRYAYHPELMPILKAQFSYVLSHQNNQEDELEAEPIQYVHCQNLRVYNAEAMPNAYLMGMPSITALEGLGHQFQRKLQKLLGVGVHVIGVAVYVRSYQLHNNKQLPEPNKLKKDGQKRVPLRSAIMQIPKCDICFDLVFRVQIDNQTVANDLSENHLKAAFPSRYAGGTLHPPSLYDQVDWCQVYAKPMALFERIRSLPKGGSWLYPTSVEVSSFEELAEQLTLRPTMRPAALGYLALEEPKSRQGSITQLHCYVEPVIGLLECVDAVTVRLSGARHFLNHGFWAMHCKKASMLMKKAKFEYD

SEQ ID NO: 9662 - protein, 300 aa, Pandoraea sp. B-6
MTQPGYTLMRVPARFRLARNAVSRSRSLLQNARLQQFLAECEARMHKSVFAGVSGPEFVQTLETDGLAFGLKIPVHMVEEIKAYAAQANCYADREPAYGFRPDQREAAEKVLGKPILLAQYFNTQRNCPTIDKLRHDPLIEWIAARYIGSVPSFVGANLWWTYAVKAREEDRFKHAHLYHRDVDCFRFFKFFFYLTDVLPGDGAHVAVAGSHHRPPTLQRFDAIKVRRYADEEIDSAYAPDDIREICGPAGTGFAENTLCIHKGRTPVRQARLLLQLQFALFDYGVMHDNRDESDLHLIV

SEQ ID NO: 9663 - protein, 320 aa, Coxiella burnetii
MSYNKILLIPHLHIHNANALSSPFTIGFPAMTAWLGATHALQRNLNERGIPVTIPATGVVNHQMDLQTYRGNDDYVSSIINTGNPLVPKTKREKGEPWHNFERPPFIEEARCHLDVSLLIEFRGVSQEQDDEIKEQVSHLLNCKMKVAGGDIQSFNPPAILLIEDGNDADLRRLSRKIMPGYVLIERRDLMIEAMQQGQDALDALIDYVAIHHSCEKTEDGDVLWESHRKTQIDKPPGWIVPIATGFHGISELGQAKNQRDPETPHRFAESLVTLGEFKMPHRFESVTDMLWCYQVDSTNNLYQCVALNTITENLYDEFG

SEQ ID NO: 9664 - protein, 294 aa, Acinetobacter haemolyticus
MRYFLLIPHLKLHNANAMSSPYTIGFPAMTAWLGAVHALQRKVQAKALDVALTKVAVSCHEFNLQTYKGQGDFVHSIIGTANPLDKDGSRPAFIEEARCHLEVSLLIEIENLSIKKREQLLEMVPDLVSSMKFASGDVLAIKKCQIIDFDEEESQDKELRPILNKLMLGHVLIERRDLIIESMNQGRDALDAVLDYLKVTHSSTVDDNEKVTWTSKRKAQGWLVPIAVGFQGISELGQAKNQRDASTPHRFAESVLTLGEFVMPYRIEHIDQLLWKYHFDSDNNLYLCQNISTT

SEQ ID NO: 9665 - protein, 571 aa, Vibrio vulnificus
MTKLSDLLAIEDEAIKQTALKKMFMPYTEDVCVDGYEQETLTILLNLSSSHQADRCLDWLDVARAQRYLKDSENLDASLAEIQWFHTHNLKFPDCRVKDQRIIARPLSTAEEFISSAVLAQRLGWAHNSAVYRHTLWLLNPFKWQSQPVCVLSLIQQKNPVWLDLLTEFGLDVKSLARLQRAIEEQLPENSFPDSVSTYSKQLRFPWGDDYVSITPVVSHALQCKLEIRARSPENKFSFVSSSLPNSASIGNLCGSLGGHMRVLNYPLGVKQTKGGTLTENRQKSGHYFDDYQVTNAKICQVLNRLIGSEPSKTQRQRERARQVRSKILRKQIALWMLPLIELRDIAESEPNQQQLEHDDTLAQAFLSLPELELGSLASEFNRRLHLTFQNNMYSAKFAYHPKLMQVAKAQVTWVLEQLSKPINNQDTHTGEQYIYLSSMRVQDAAAMSNPCLCGVPSLTAIWGFMHDYQRQFNQLVNNDSPVEFLSFAFYVRNENIQSTAKLTEPNSVAKARTVSNAKRPTIRSERLSDLEIDLVIRVHSESRISDFRSALKTALPVAFAGGALYQPQLL

SEQ ID NO: 9666 - protein, 297 aa, Vibrio parahaemolyticus
MRLLILPHIRIHNANALSSPFTIGFPAMTAWLGFTHALERKLNQAGLDELMFDSVAVVSHQFDLQTHKGEGDFVHSIIGTGNPLDKDGSRSAFIEEARCHLEVSLVIEYSGNDDEIESDNFAQRLQDMVATMKIAGGDILSLQTPVSQLLNEDNEQETVKLLRQLMPGYVLVERRELMTDSMQEGSDALDALLSYLTVNHSSEQLEDESVIWRSQRKASGWIVPIATGFQGISPLGQAKNQRDPTVPHRFAESIVTLGEFVMVHKIKHLDEILWCYSTDLDNDLYLCQRVNTMNEYQ

SEQ ID NO: 9667 - protein, 695 aa, Vibrio sp. 624788
MTKLRDLLAIEDETVKQITLKKMFMAYTEDVCVEGCEKEALTILLNLSSSHQADRCSDWLDITRAKRHLKAAENLEASLDEIKWFHTHNLKFPDCRVKDQRIIAQPLATTEAFISSLVLEQRLGWAHNSAVYRHTLWLLNPFRWQSQSVSLHSLIQQETPVWLELLKGFGLGTKSLARLQNTMAEQLPENSLPDRVSTYSKQLRFPWGDDYVSVTPVVSHTIQSELEVRSRSQESKLCFVSSSLPNSASIGNLCGSLGGHMKVLNYPLDVKPAQGGTLTESRKKSGHYFDDYQVTNAKSCQVLNHLIGSEPSKTQKQRENARKVRSKILRKQIALWMLPLIELRDIVDADSNQQQLEHDDTLAQAFLALPESDLGSLANEFNRRLHLTFQNNTYAAKFAYHPKLMQVAKAQIVWVLEQLSKPNGNEDKVAGEQYIYLSSMRVQDAVAMSSPYLCGAPSLTAIWGFMHRYQREFNKLVNCDSPFEFSSFSFYVRSENIQPTAKLTEPNSVAKARTVSSVKRPAIRTERLADIEIDLVIRVHSDSRISDFKSALKTALPVVFAGGALYQPQLSTQIEWLRTFTSKSELFHVIKGLPAYGRWLYPSENQPSDFDDLEHLITKDADNLPVSIGYYLLERPTKRCNSITNYHAYAENAIGLAKKVNPIEVRFSGRDHFLNHAFWSIECSSETILIKNYRD

SEQ ID NO: 9668 - protein, 496 aa, Vibrio sp. 624788
MISCLGDLLKDVEHPLWQKLNTLGCYQKTRKAIAKQLAQISQTTINVSLAPNYLTQLSLPDNDSSYISLSPVASQSMQSHCYQALENEYRYTALTRYSRSTNMGVLPMTCGGALKMLKTVPNFSLTHHYQINIGKSWLTSSHIQSLTQYQTHTQYLMPKNKRVAYRRTVKNEIQEMVKAWLPIQDRTMDVNTLVQHLNHDLSRIKLAKCFAYEPSMTKLLLGLIKRELNERRSDSTNVSGSEKKDSFFAIPNIRVCGASALSSPITVGLPSLTAFLGFTHAFERNLNESFPTLTIDSFAICVHQLHVEKRGLTKEYIQKANHTISPPATHDDWQCDLVFSLVIRFNRSLSVDESAIVRALPRRFARGSAKIAIADFKYIRSFSTLEKTIQSFPQKTGKWLSMHTEPIENMSDILSEVKENRKLTPSCVGYHFLEEPTDKPNSLRGYKHAFSECIIGLIEPITFDQNTDTTTILWHHKRYQNYLSVQPRSTYHGTTD

SEQ ID NO: 9669 - protein, 321 aa, Aeromonas hydrophila
MGMRSTLLLRHLKVENANAISGLTYGFPAISHFLGFTHALSRRLEQEHGLTLGGCAVIAHHTELQSQPLGNRREQVFALTRNPLTKEGKTAPFNEEGRVHLDISLLIECDFNADQLPKGGTLDQRIDALQTWCERTVPTLRLAGGTITTLGQVQWREHYDERERRHLCMGLLPGFALVCRHDLLTLHHQQRLSTEPGSELLDSLLDFVTLRHQAQQDEAGSVSWQQLAKPASGYLVPLAMGYQSISPLHEPGTIPSSRDQETPFRFVESIYTLGQWISLHRIQRLDSLLWRYRHQEPYYLCENHYIAPSLSVEEDDEEFIS

SEQ ID NO: 9670 - protein, 322 aa, Thioalkalivibrio sp. HL-Eb18
MLDEPQHLLEIPRLRVQNANAISSPMTWGFPAMSAFVGLMHTLERSLVDRGVDIVFDAVGVICHRIEPQITEDTFPITFRLTRNPVGKDGATAAIVEEGRTHLEITLVFAVRGDAGPDVAQTAEHLVHQLRIAGGTVQPPLHDKQRRWPSRIIPMSDDPAKRPNEYRRLLRRWLPGFTLVARDDLLQGHLQNLRQEDPECSLLDAWLDLARLNMECRTQPPENGEEEPRAQWEARLPRETGWFVPIPVGYGALGPLLDPGTVKAARDLETPFRFVESLYSIGQWLSPHRLTTPTQLLWYPDSDPDQGRYRLQNDFTRHNTPA

SEQ ID NO: 9671 - protein, 333 aa, Oligella urethralis
MNDYFYILVDGLKLTNANAISGPQSYGFPALNGFISAAHALERRLKKLADFPDISFDGVLISCRDFKIKMDDSGYFATFNQKRAPILKDGKTAPIIEEGYVDLTVSLVIKATGDQLRLFNLDKNKKTFEEKFRNLCLMQRFAGGSVEYIRAVEFFTAEDTDTLKRRLLPGFVLIDAYEDAANIYHEMVEGYRTEIEEKIDPETGEITRYICPVGHNPETDMLDVLISTAAIYQIPPKAEQSEWTRYSFKRDRGWLVPIPVGYQAITQKYDADQVANIRNPNYASQFVEVIYGLGKWVFPHRLKGDINQYFWRYDNSVENLYLITQHQPSNTNL

SEQ ID NO: 9672 - protein, 295 aa, Rhizobium sp. JGI 0001005-K05
MDFDASQGDRKYPTSQQVGGLVECSGLQVELRRFDPGWQVDLTLECTEIAVLLSGQSKIRWTGDGHRREAIARPGVAWVCPAGVNESAVEIVGTMPESLHIFLPPSLVAESALSNFDIDPARAQIAYAGGVPDPVILQLGELFRGVLNRKLEATDRLFLDGIQLALAAHLLGTYSSARWHPPTRTPTIDPKRLRRVLDFIEARIAAEISLEDLAAEACLSPFHFSRVFRAATGFAPHRYVTERRIEAAKEKLRLAQSSLVEIAIDTGFGSQANLTRVFRKMTGLTPGQYRALFTS

SEQ ID NO: 9673 - protein, 314 aa, Wohlfahrtiimonas chitiniclastica
MAKRYFLKIPHLSIHNANALSSPLTIGFPAMTAWLGAMHALERHVTVDPELSGVKFTQMAVSCHDFHLRTHKGRGDFVHSVINSRNPMQLKKKREKGEPDDTAESSPFIEEPLCNLEVTLLIEVEGKSMKSSDVRAALVKACDQYVMRMKFASGDVMSVKACQWVSIDGDDDSADHRHIARELMLGNVLVEARDVMAKAMEENPEKDAITILLDHLAIQHEATPNEHNDGAQWSSSRLGDHGWLVPISVGFQALSPVTDPILNQRDDMTPHRFAESMLTLGRFVMPHRCESLSSLFWSYHVDEAQGLYLCRNQS

SEQ ID NO: 9674 - protein, 324 aa, Desulfovibrio oxyclinae
MSDAPQFDGLLTFPRIKVQNVNCISSPLTWGFPSMTAFMGLMWALERRLAGREEGGEVLFNRVGVVCHAFQPHVSDDGFSHTFHLTRNPVGKDGKTAPIIEEGRANMEISLVFGVQSDVLGDAVGEQQMLARQIGDVLFSMRIAGGSILPMAHKPFFTSLGDEWEERLSKFRSVRRRLLPGFTLIGRDDLLKERHDDLLQEDPTATPLDAWLDMSRINWRCSRIEEVNEDTGEVTERGEWKRDAREGWIVPIPVGYTALSPRYDNSEVDNTRDDSTSFQFVESIYSLGQWVGPHHLSEPADMLWHASYDEENGVYRCINKSKPM

SEQ ID NO: 9675 - protein, 295 aa, Thioalkalivibrio sp. AKL8
MTYLALPHLRIQRANALSTQWMISLCPVMAAVMMSHALGRALKVQPSGVAVIHHDAHLHAESFGNDRHPHQYRASTYIDGDDYSSHSKDPTLSLQPTASMDLEWSLVLRFDEDVSERILSKVHTFLQRARLAGGLIVDFRDPVMSHSLQGRDGGDRDHWGVIDRAIGGGHILADRSGLLVGDESHTRLDRLLALAGNDPNPGASGAVKFNGWLTPAVLGYALTSPVEYRENVRNNLTHAYSEPMVGLVEYLGLRTLKDRPDIDPADLFWSYSWPDETAFLLEQDRASGSTSSQLQ

SEQ ID NO: 9676 - protein, 343 aa, zeta proteobacterium SCGC AB-133-C04
MSQYLVLSRIKVQNANCIAGFTWGFPAITHFLGFTHAMQRKLSPAYDITFNGCAVVSHNYQLHVYKPNPRASYEFIQSKNPPVLAKHKNAVSAPIIEEGKMNLTVSMIIELSKELVTTTEQIEQFKHAILDQCLTSRLAGGSILSVGQVDLLSASTEEQFSKLNRSVKRLTMPGFVLQDCSVYLKQHFEQLKEDNPDAQVLDAWLDFAAMKYQAKPKLKDGEQECSLETDAEWEFLPKPVKGWLVPIMTGYKAISEKYATNQVGHLRVSEDDPSVTGCCFVEAVHSIGKWKSIHRVTNIGEIIWRYHYDNDWYLCSQAREQPDEEQVIIDNESQSFENAIANL

SEQ ID NO: 9677 - protein, 308 aa, Fangia hongkongensis
MSEIKKLLLLPHINIQNANALSSPLTIGFPAITAWLGAVHALQRKLNALGYEDLKFIATGIVSHRCDIQTYKNEGDYVHSIIGTANPLDKSGARSAFIEEARCHLDVSLLIEYNGITKDDENELIEKIKHILHAKMKLAGGDILSFKPPAFFKVETGNGKDMHTLRRKLMPGYALIERRDLMVAAMENGQDAIDGLLEYLCIHHTCEYDDKDKVIWSSARKAKGWIVPIAIGFHGISALGTAKNQRDPDTPHRFAESVVTLGEYKMPHRIESINEIMWHYKTTEQDNLYLCTQSKSQPELDELFDLFN

SEQ ID NO: 9678 - protein, 321 aa, Teredinibacter turnerae
MKSLILLKGVQVENANAIAGHTYGFPALTHFLGYTHALSRALQSRLGLTLGGCAIVCHDHQVQSYQPGGWGDHVFALTRNPLTKEGNTAAFIEEGRMQLNVSLVIACDFNEYDLDQTAGSKEEAISLFCDSVRELALIRKLAGGTITGLQSVQFHVLPEQFDERSIWMKKFMRRLLPGFLLQDATEQLREHFSTLKTTDENTELLDAWLEFMSYKQISVEKPSTKSGDNTTNVVWERVPPPGAGWCVPLALGYRAISALYEPGEVARTRDQTTPFRFAELAYGLGRWVSPHRFESIEPFIWRYHYENEWYLCQQFQNSTTN

SEQ ID NO: 9679 - protein, 295 aa, Acinetobacter tjernbergiae; identical to SEQ ID NO: 9310

SEQ ID NO: 9680 - protein, 324 aa, Arhodomonas aquaeolei
MYESHSLLVLPHVRVQNANAISSPMTWGFPAMTAFVGLMHLLERRLTARDVPLLFEGVGVVCHHCEPQASHRGYTHAFHLTRNPVGRDGDTAAIVEEGRVHLEVSLVFAVRGDACAAPAEERAAIAREVGELLLTLRVAGGTVLPGSFRGRRWNGPELIPLDEQEDERRQQSKRLLRRWLPGFALVCRDDLLHERHAEMRADDPDTTLLDAWLDLSRLNMTCRGGEDDGEETIRWEARRRPGWLVPIPVGYGALGPLQAGGDVRRARDTATPLRFVESLYSIGQWVSPHRLDSPERLLWYVDNRLDEGRYRLRNDYIDNAAEFV

SEQ ID NO: 9681 - protein, 606 aa, Streptomyces sp. CNQ766
MRILWSFARPHRRVLALGLLLALAGSALGLASPMVTKWVLDSLAGDASLTGPVVTLLVLMVVGAVLGHRQWVILGTVGERVVLDARESMVRRFFRATVPGVTARPPGELVSRAVSDTTLLHASASGAVVGLVNAVVMLVGTLAMMAVLDLVLLATTVASVILVVVLFATLMPAIARAQEQAQEHVGRLGGRLEGALRAVRTVKASAAEERQADRIAQDARSAADHGLKAVRLEATVWVIAWTGIELAIILVLGIGAWRVDAGTLEVSGLIAFLLYAFGLMGPVTELSEHTSELQSGIAAAKRIRAIDELATEEGSASAADGQRGGQADGRVRTGAGGAVLELRGVTAGYGPGREPAVRGIDLAVPRRGHTAIVGPSGAGKTTLLSLVLRFLEPQEGELALDGRPYGELRHPDIRARMAYVEQDTPVVPGTIRDNLLFSRPDAREEDLRRVLRDVRLAEKVDGLDDGLDTELSSTAVSGGERQRIALARALLREPDVLLLDEATAQLDALTEAAVHECIRARARAGAVVTIAHRLSTVIDADTIVVMEAGRIRARGTHGELLAADALYRDLVEALRIASAGSGAAAPAGHAAAPATVAAPGAPQRTG

SEQ ID NO: 9682 - protein, 606 aa, Streptomyces sp. CNS335
MRILWSFARPHRRVLALGLLLALAGSALGLASPMVTKWVLDSLAGDASLTGPVVTLLVLMVVGAVLGHRQWVILGTVGERVVLDARESMVRRFFRATVPGVTARPPGELVSRAVSDTTLLHASASGAVVGLVNAVVMLVGTLAMMAVLDLVLLATTVASVILVVVLFATLMPAIARAQEQAQEHVGRLGGRLEGALRAVRTVKASGAEERQADRIAQDARSAADHGLKAVRLEATVWVIAWTGIELAIILVLGIGAWRVDAGTLEVSGLIAFLLYAFGLMGPVTELSEHTSELQSGIAAAKRIRAIDELATEEGSASAADGQSGGRADGRVRTGAGGAVLELRGVTAGYGPGREPAVRGIDLAVPRRGHTAIVGPSGAGKTTLLSLVLRFLEPQEGELALDGRPYGELRHPDIRARMAYVEQDTPVVPGTIRDNLLFSRPDAREEDLRRVLRDVRLAEKVDGLDDGLDTELFSTAVSGGERQRIALARALLREPDVLLLDEATAQLDALTEAAVHECIRARARAGAVVTIAHRLSTVIDADTIVVMEAGRIRARGTHGELLAADALYRDLVEALRIASAGSGAAAPAGHAAAPATVAAPGAPQRTG

SEQ ID NO: 9683 - protein, 296 aa, Thioalkalivibrio
MMYLALPHLQVQQANALSTQWMISLCPVMAAVLMSHALGRALKVQPSGVAIIHHDAYLRAESFGDDRHPHQFRASTYIDGDDYSSHSKDPTLSLQPTATMDLEWSLVLRFDEDLPERALRKVHTFLQRGRLAGGLIVDYRDPVLGYSLKGRSGGDRSNWGVIDRVVGGGHILADRSSLLTGKGPHTRIDRLLALAGNDPDPEASGAQPFSGWLTPAVLGYALTSSVESRANVRNDLPHAYCEPMVGLVEYIGLRTLQEHPDLNPEDLFWRYSWPHEAAFMLDQDVDLPELQSNPSQ

SEQ ID NO: 9684 - protein, 318 aa, Succinimonas amylolytica
MSIKTFLILPHIKVNNANAWSSPYTAGFPSVCAFGGAVHALQRKFNEKGFNNFEINGLGIINHKFSMRTYREGQYSDLSIIAGANPLDKDGNRPSFVPEIKCILEVSLLCELAGITNDDEDEDIEHTANDLLNSGFRIASGDVQPTETPYITRVNTTNEEDENFRKDIIHRLMPGYALIERRELMIESMKLGNDALDALIEHISVIAEPHINNGKVDIERYRKNRGWLVPISTGYAAINELGRATNQRDPETPHCFAEAIVTLGEFKMLHRFHNINSLLWRRYYDANTGIYCYSQYEEESQQTYTGEEDEENSELFNI

SEQ ID NO: 9685 - protein, 290 aa, Halomonas lutea
MPFKAILRGSLKASGFREELVSKSNWDEGGRGLYIYLKNIQVYDALAMANPYLCGIPSLTALWGLTKEYEIKLKALSHTSLKFDGVAWFLREYQERGDIKIPAPTKLAREPGRLMRSGLLPARFCDMVMDVVIRVSDPDIELAAIEPHLLQAACPGRFAGGVLHPPGLRDERHWCQVAEGNGLFKQLRRLPRSGRWVTPGSMQSDSLFETLELCNKFSDLRPVSAGYALLEDPIGRAGSVMEQHAFAESLISLAHLVSPIVYRWEGWKAFTQQAFWGMRPENRAMLMSKA

SEQ ID NO: 9686 - protein, 282 aa, Thioalkalivibrio
MYLPISHMRVQAANALVTPSMISPCPIMAAVMFGHALGDTIGCETTGVAIIHHDAQLRGERMNPHKRKEFQPHQMRSATYINGKDYANKSNGPTLSLQPVALADLEWSIILELSCDGEAGLNAGQIKKLRKRLRGGRLAGGQIVGYSAADEAFPALLGKEGAIAKKIGGGHALIDRSDRLIHPERSRLEQLMKIGTGDRDVVAEESGFFVPAPMGYAMVTEFEERKGSREGLPHAFGEIMVGLAEYAGIRTLGERGFEAQSLLWRHHWDVDNAAFILSQESY

SEQ ID NO: 9687 - protein, 640 aa, Vibrio anguillarum
MQTLKELIESTPDDLTTVLKRAFRPLTPHIAIDGNELDALTILVNLTDKTDDQKDLLDRAKCKQKLRDEKWWASCLNCVNYRQSHNPKFPDIRSEGIIRTEALGELPSFLLSSSKIPPYHWSYAHDSKYVNKSALLTNEFCWNGVISCLAELLKNVDHPLWKTLTKLGCYQKTRKAMAKKLASIAHITISMPLAPNYLTQISLPNSDTSYISLSPVASLSMQSHFYQGLQDEYRHASTTRFSRATNMGVTAMTCGGAFRMLKSNTKFSITPHHRLNSKRSWLTSENVQSLKQYQRLNKRLIPENARKALRRKYKIEIQNMVSVWLAMQDHTLDSIILVQHLNHDLSCLGATKRFAYNPVMTKLFTELLKRALSNSLNDSTHYSNGSFLVLPNIRVCGATALSSPVTVGIPSLTAFFGFVHAFERKLNRLNPTFRVESFAICVHQLHVEKRGLTAEFVEKGNGTISAPATRDDWQCDVVFSLILNTNFAQRIDQSTLITLLPKRFARGSAKIAIDDFKHINSFSTLEAAIQSLPIEAGRWLSLYAQPNNNLGDLLAAMKEDHQLMASCVGYHLLEEPKDKPNSLRSYKHAFAECIIGLINSITFSSETDANTIFWSLNNHQNYLVVQPRIINDETTDKSSL

SEQ ID NO: 9688 - protein, 324 aa, Moraxella boevrei
MANYILLERIQVENANAIAGFTYGFPAITAFLGFEHALSRKLKDLIGVEFNGCAIFCHDYIVNSYQDFYTRFIQSRNPPSTLKGKSGDAKSPAPIIEEGKIDMTVSILLRCDGVLSSNSEILESYNQTIKNSVYQSRLAGGSIKNIKGIYILSDSDKLLNHIKHILLPSFVLIDGTHLLKEHFENTQHENKSLLNIWTDFFAFKEMAIKSPQTEEITWQRYLPANKKGWIVPLMIGYKGISPLYSPEQVENLRDTRYPFRFVEAVHGLGEWRSVHRIQALDSLFWQYHVENEWYLCQQNTDTNIDTKYQDDESESDYFDDIFNN

SEQ ID NO: 9689 - protein, 304 aa, Selenomonas bovis
MSRQYILLPHIVVHNANAMSSTYTVGFPAMTAWLGAFHRMERELRRKDCPALRITGVAVACEHFHLQQYQKNKFAPINLAMTANPLKKSKKTGAYERPPFIAEARCDIRVSFILRTEGIEAEQSDDLKERMLSLLARQKLAGGDIVSLPEKKQIQMKHLEGSAEERKFMRRLMPGFVLVERKDLFEALEGDDLDKLLTAVSLHAEPVLDETTGKIEKWMYRKNLAQGWVVPIAVGYRDLSGDKALHVANQRDPQTEHHFVEPLVTLGEFKMPYRFERIEEILWTYHYGQSRGLYECVNDISKES

SEQ ID NO: 9690 - protein, 695 aa, Vibrio
MTKLSDLLAIEDEAVKQITLKKMFMPYTKDVCVEGFEKEALTILLNLSSSHQSDRCSDWLDVARAKRHLKAAENLEASLDEIKWFHTHNLKFPDCRVKDQRIIAQPLATTEALISSSVLEQSLGWGHNSAVYRHTLWLLNPFRWQSQSVSLLSLVQQETPVWVELLKEFGLGANSLARLKHTIEEQLPENSFPDSVSTYSKQLRFPWGDDYVSVTPVVSHAIQRELEVRSRSRESKLSFVSSSLPNSASIGNLCGSLGGHMKVLNYPLDVKPAQGGTLTESRKKSGHYFDDYQVTNAKSCQVLNHLIGSEPSKTQKQREIARKVRSKILRKQIALWMLPLIELRDIVDADSNQQQLEHDDTLAQAFLALPESDLGSLANEFNRRLHLTFQNNRYAAKFAYHPKLMQVAKAQIVWVLEQLSKPNGNEDKVAGEQYIYLSSMRVQDAVAMSSPYLCGAPSLTAIWGFMHRYQREFNKLVNCDSPFEFSSFSFYVRSENIQPTAKLTEPNSVAKARTVSNAKRPTIRSERLADLEIDLVIRVHSDSRISDFKSALKTALPVAFAGGALYQPQLSTQVEWLKTFTSRSELFHVIKGLPAYGRWLYPRENQPSDFDELERLITKDADNLPVSIGYHLLERPTKRGNSITSCHAYAENAIGLAQRVNPIEVRFSGRDHFLNHAFWSIECSSETILIKNYRD

SEQ ID NO: 9691 - protein, 317 aa, Dickeya zeae
MSKLMILRRIVVENANAIAGHTYGFPAISHFLGFTHALSRQLQTSHGLRLEGCGVVCHQHQVHAYGNGWNRSFALTRNPLTKEEKTAAFNEEGRMHLTVSLLIECHGMLPGEDGREALRQQVQQQVQQQRLAGGLIVDIEQVSFHDIPANGAATRSLMRRLLPGFVLVDRTALLSSHLDTRQQADAQADMLDAWLDFAALKYQAVRSSDDAVSWQPLPKPQGGYLVPLMTGYRAISPLYAPGEVEKTRDPSTHFCFAEAIYGVGEWRGAHRIDDINRIFWRYLYQRDNQHHTYRCLQTVNDADSAADDDYPELEFNY

SEQ ID NO: 9692 - protein, 246 aa, Hydrogenovibrio halophilus
MQTSYLTINSAFVMPAVLLGQALAHHCDLNVESVSYIHHDIQPLGEIQNWKFMPHQRKGAAFINKGDYAANAKGPSLSMQPTASGHLRASLIIDIGDSLADFDEIEYFFRQGRFAGGEIISHGEIQSAETLKEIRFRSGFCLIDKSDMLGDKASIDAFVKAMAEPFDENKDNGWLTPFVAGYALISEPNHKPGARDACLHAFCEPMISLAQYKSVNSELIKEKGLSFWALENHQSHFSLTNTFKQP

SEQ ID NO: 9693 - protein, 319 aa, Oceanimonas smirnovii
MTEPNTLLILPRLRIQNANAISGNLTWGFPAMTAFAGLSHALERKCADAGLKVAFPGIGVVCHHHEAQVTQGGYQRAFHLTRNPVDKTGKTAAIVEEGRIHLEISLILEVDLKDEPLNDQTAFAQQVADLVATLRVAGGTVQPALPGQRVHQPWLINVDEAADVRKRQLRRLTRQLLPGFALVLRDDLLQQHLELRQQQNPDADLLDAWLDLSRLNHECRQVDDSVEWSIRRDYPGWLVPVPIGFAALSELYDAGTVDAARDQTTPFRFVEGLYSIGQWLSPHRFERFNDYLWYVDNGLDTGTYRLNNDYSLNLQDKEF

SEQ ID NO: 9694 - protein, 170 aa, Kushneria aurantia
MIDAIPHLLVLPRLRLQNANAISSSMTWGFPAMSAFMGAIQALERNLPDDIRIVFDGIGVVCHHIEPQVTAGGFTRAFHLTRNPVDKSGNTAAIVEEGRAHLEITLLIGVESDGDDLGNPERRHDIARRLFEQVQSMRIAGGSVMPPLSDATRQRPELITFDANEEERSK

SEQ ID NO: 9695 - protein, 145 aa, Kushneria aurantia
MLRDDYLNEHTETLQAEDDSATALDAWLDLCRLNHECRIETQQDKEGQTKEVAKWEIRRPYPGWLVPIPVGYGAISDLFAPGEVANARDPGVSFQFVESLYSIGEWVSPHRLRSPDALLWFVSNDLERGVYRLTNDYALTHAHND

SEQ ID NO: 9696 - protein, 294 aa, Vitreoscilla stercoraria
MRHFLLIPRLKLHNANAMSSPYTIGFPAMTAWLGAVHALERRLHQQNCHVNLSKVAVSCHDFNLQTYKGRGDFVHSIVATANPLDKDGSRPAFIEEARCHLEVSLLIEIDGLLYEQREVLLQHTANLVLSMKFAGADVLSVKPCSILDLDEDKDLNQALKPILNKLMLGHVLIERRDLVKQSMQQGQDALDAILEHLKVSHTSVQDEEGKVTWTSKRQTPGWLVPIAVGFQGISELGTAKNQRDAHTPHRFAESVLTLGEFVMPYRIEHIDQLLWQYHVDLENNLYLCQNAVNV

SEQ ID NO: 9697 - protein, 284 aa, Paraburkholderia caledonica
MQNAAVETPISHFADLPATASHGPLRIEYRWLNGAAAEPTGNATSHAPIAVFLHEGLGSIAMWRDWPQSLCERLGMRGLVYSRPGYGLSTPRPHHVKWPVDFMSDQARDILPALLDELGIGLQERRRMWVIGHSDGGSIALLYAALHPDALAGAVAIAPHVFVEELSVQSIAQTKQLYESTDLRDKLARYHADVDSAFYGWNDIWLDPAFRDWSIAQQLSTISKPLLALQGHDDNYGTMAQIDTIPEYAPHAELVKLDACGHSPHRDAPDRLNEAIAEFVSRHR

SEQ ID NO: 9698 - protein, 297 aa, Cycloclasticus pugetii
MKDIVLIPNIKIHNANALSSPYTIGFPAMTAWLGFMHALERKIRQAEFKDIKFTGVIVSCLELDLQTYKGQGDYVHSIIATSNPLDKSGKRPSFIEEARCDIEVTIAIECELGIIDYEKFTQLINNKLHTMKIASGDITSFKPSQHKEVDNNKPRELTKYLMPGFCLVTRQDLMQSSMDKGADAIDAMLDYLKITTDIEVDENHKVSRSKAHKKEEGWIVPIAIGYQGISELGSLKNTRDLTTPHRFAESVVTLGEFKMPYHFDTLDEMVWRYQEYEKNDLYLCQNNYSINQEKSKL

SEQ ID NO: 9699 - protein, 295 aa, Vibrio; identical to SEQ ID NO: 9158

SEQ ID NO: 9700 - protein, 698 aa, Vibrio harveyi group; identical to SEQ ID NO: 9157

SEQ ID NO: 9701 - protein, 298 aa, Thiolinea disciformis
MKRYLLIKQLQVQNANALSSPFTYGFPAVTAFLGFGHALQRHLNRYVSNDAEAYFKKLSVSGVGIACHALAMQDYQSQYESTLKLTANPLDKDGNRPSFVEEGRCHLTVSLVLELKNLGNGLEDELVEAVADLLMGRMKLAGGDILPLREISQQIMLIPNEKKSLHRLMPSYVLIEQRDLMVEAMQSGQDALDALHGALQLNHTCTDLGEGKGQWQTSRAHKGWIVPIATGFHALTPATLAENQRDSSTPHRFAESVVTLGEFKMPIRCETVSEIIWRYQQDGDLYLCTQQVAEISIQ

SEQ ID NO: 9702 - protein, 399 aa, Psychrobacter sp. G
MSNFLLIDHIDIQGANTVAGFTWGFPAITHFLGFVHLLQRKIHQHADFHSIKLAGCAVIAHDQQTSAYCSGSTIAFTQSRNPPYLASHAKDSPPPIIEEGKMSMTVSLLIEVEDSVKQYGQVFIDWVQQQSYLQRLAGGSIFNIAGVTGFAINNDEDKASLRALQRKLLPGFALINRSNLLDDYFESMQTDNPSTEIFDAWIDFFALKRRARPAYDLIDRHLVGLLKDQDSDNTILIAEWKHHLEKSYNPKELPDNLLNYFSHLVADKPNKNLIDQWQQYMEPTERTTAKWEYIPKPARGYLVPIMCGYKAISEVLNNDEVTGTRDSATEVCFVEAVHSIGEWQSVHRWKNLNDVSNSFWQYNYSPDWYLCSNHHSFEKSDSTATDDIDALLVQDLNSL

SEQ ID NO: 9703 - protein, 323 aa, Marinobacterium rhizophilum
MTELNAVLMLPRLQVQNANAISGPLSWGFPSPTAFTGFAHALERRFRAELQEGFAGIGIVCHRFEPQVYRPAGKRTQVFSLTRNPLDREKTAAIVEEGRAHLEVSLLIGIKDYKTDNEGVCFAEDVMDAVQGMRLAGGSILPQRRGKRYAGQWLPWASDLEGQAEGFQKLRRRLLPGFALVQREDRLSERLLQMREHMPDASALDALMDLCRLNIEPDIPDPDNPEAMHWGIRKTAGWLAPVPVGYGALSPLYGAGEVANARDENTPFRFVESLYSLGEWIGPHRLSTLEQLFWHTSADTESGIYRCINHYSDSLTVATSGIA

SEQ ID NO: 9704 - protein, 640 aa, Vibrio parahaemolyticus; identical to SEQ ID NO: 8726

SEQ ID NO: 9705 - protein, 701 aa, Shewanella piezotolerans; identical to SEQ ID NO: 8655

SEQ ID NO: 9706 - protein, 311 aa, Serratia sp. ATCC 39006; identical to SEQ ID NO: 9316

SEQ ID NO: 9707 - protein, 258 aa, Photorhabdus temperata
MSYLIVLRHVKVENANAIAGLTYGFPAITHFLGFTHALSRKLQQNHDLRLENCGVICHNHQLHAYQSDPIRDKVFALTRNPLTKEAKTAAFNEEGRMHMTVSLLIECLGEIENGDEGSRNLEKHLWEICQTQRLAGGTITEIAKVDVIAFPQREQETRKLMRRLLPGFVLLDRSELLANHYDALKQSNPQAEMIDAWLDFTAIKMRAIPIQEDKQPEVGDPASWEYVPKPGSGYLVPLMTGYQAISPLYPAGKVEKNP

SEQ ID NO: 9708 - protein, 294 aa, Acinetobacter baumannii; identical to SEQ ID NO: 9269

SEQ ID NO: 9709 - protein, 307 aa, Escherichia coli; identical to SEQ ID NO: 9178

SEQ ID NO: 9710 - protein, 695 aa, Vibrio azureus; identical to SEQ ID NO: 9376

SEQ ID NO: 9711 - protein, 309 aa, Desulfovibrio gigas; identical to SEQ ID NO: 8728

SEQ ID NO: 9712 - protein, 303 aa, Dialister invisus CAG:218; identical to SEQ ID NO: 8770

SEQ ID NO: 9713 - protein, 302 aa, Dialister hominis; identical to SEQ ID NO: 8771

SEQ ID NO: 9714 - protein, 321 aa, Megasphaera elsdenii CAG:570; identical to SEQ ID NO: 8772

SEQ ID NO: 9715 - protein, 327 aa, Pseudomonas; identical to SEQ ID NO: 9271

SEQ ID NO: 9716 - protein, 323 aa, Aquaspirillum serpens
MVNPQVDTAGLLVLPHLQIQNANAISGPFSWGFPPPSAFLGFAHALERKLLAAGVLEKGFAGVGVVCHRFEPQVTRLASKYQYVFHLSRNPINKDGTPATIVEEGRVHLEISLVIAVKDELFGDTEIAPLIQAVHTEVNAMRFAGGSVLPWGQQQRAYWKTVPQQQTEQEAFFKKLRYRLLPGFTLVHRPDKLRTHLDTLGPNATVLDALLDLTQLNIAPATPDPTHPEFVEWQVHKPATGWLVPLPIGYAGLSPLHAAGEVTNTRDVATPTRFVECLYSLGEWIAPHRLTSFSQMLWRHQAEPDTGLYRCVNFYTDLNPFSA

SEQ ID NO: 9717 - protein, 351 aa, Candidatus Symbiobacter mobilis; identical to SEQ ID NO: 8729

SEQ ID NO: 9718 - protein, 324 aa, Geovibrio sp. L21-Ace-BES
MSKKPNTLVTLPHVRIQNANMISGPYSWGFPAVSNFLGFVHALHRKLGGAETSFDGVGIVCHDYEAQVYQPVPYVPHQLKITRNPYDSNGDPSSTLEEGRIHLDVTLVIGVWTADTTEAGLKELAEKVLEASQSMRIAGGSVLPRRKEDPKPYASPLSDIDDERKEQIARLKRRLIPGFVLVERGDILSERLKEMRVENPDSTALDALLDLCAVKVEPEMSPEEYEDKKAENEDKDFNVTWGFRRERPGWLVPIPVGFLPISELYEPGVVKNARDNEVPFRFVEAAYSMGEWLNPLKLRNAEDLMWYYESDPEIGTYLCKQKNK

SEQ ID NO: 9719 - protein, 700 aa, Psychromonas hadalis
MVNILHIKELLNDTDIALRDVALRHAFSSFTEPVDITGCENSALIILLNLTYPRKKVDDLLNKKLAKKTLNNEVHIENCLGEVQWLHSHNLKYPDIRVSKQRLLVALPVLHRSVLSSANFEACLGWSHDSAKVNFAKLFDCHFVWQGKKSCLARLLVEEQAKWKVVFQSLGMPVKDYLNLSARINSFLPECSQPEIVDRHSPQIRLPYHDGYTALTPVISHAVQSEIQQASRQRRGKFTHVEFTRPAAVSDLVSSIGGNVCVLDYPPPINKTVHGLTHSRLFRVLNGESVLNIHALVRSQFRDGITGFLSIGNALALKQRREQKVTSIKQIRAGLAEWLAPLIEWRLEVKDNGRGLVQLESCKGSLEYQFLTVTDDQLAELTVPLFSLLNTTLSNLSAMEKYAFHQQLMPVLKNHLKWLLTHIADEDKQFYSDAENNRSRYLYLKGLRVFDAQALSNPYCCGTPSLTAVWGMIHRYQRKLNEALGATIRLTSFSWFIKEFSYVTGKKLPEKTMQGPKQNQFRRPSIIDNKHCDLVFDLVVHIDGYEEELLLLDSQQALLKACFPANFAGGVMHQPELSEGNDWCDLYSSEVLLYKKLSRLPMSGRWIMPTKHKVSSVKELIELLKKHTSLYPTMFGYLLLGTPQKRTGSLGRLHCYAEPTIGVAEYVSPIDIRLQGIKNYFNKSFWMLDAQECSMLMKRV

SEQ ID NO: 9720 - protein, 320 aa, Photorhabdus temperata; identical to SEQ ID NO: 9277

SEQ ID NO: 9721 - protein, 299 aa, Megasphaera sp. BV3C16-1; identical to SEQ ID NO: 9278

SEQ ID NO: 9722 - protein, 327 aa, Pseudomonas; identical to SEQ ID NO: 9279

SEQ ID NO: 9723 - protein, 327 aa, Pseudomonas; identical to SEQ ID NO: 9284

SEQ ID NO: 9724 - protein, 327 aa, Pseudomonas aeruginosa; identical to SEQ ID NO: 9290

SEQ ID NO: 9725 - protein, 294 aa, Acinetobacter gyllenbergii; identical to SEQ ID NO: 9309

SEQ ID NO: 9726 - protein, 311 aa, Klebsiella oxytoca; identical to SEQ ID NO: 9311

SEQ ID NO: 9727 - protein, 311 aa, Enterobacteriaceae; identical to SEQ ID NO: 9312

SEQ ID NO: 9728 - protein, 311 aa, Enterobacter cloacae complex; identical to SEQ ID NO: 9314

SEQ ID NO: 9729 - protein, 315 aa, Vibrio halioticoli; identical to SEQ ID NO: 9377

SEQ ID NO: 9730 - protein, 337 aa, Zymomonas mobilis; identical to SEQ ID NO: 8730

SEQ ID NO: 9731 - protein, 317 aa, Dickeya zeae
MSKLMILRRIVVENANAIAGHTYGFPAISHFLGFTHALSRQLQASHGLRLEGCGVVCHQHQVHAYGNGWNRSFALTRNPLTKEEKTAAFNEEGRMHLTVSLLIECHGMLPGEDGREALRQQVQQQVQQQRLAGGLIVDIEQVSFHDIPANGAATRGLMRRLLPGFVLVDRTALLSSHLDTRQQADAQADMLDAWLDFAALKYQAVRSSDDAVSWQPLPKPQGGYLVPLMTGYRAISPLYAPGEVEKTRDPSTHFCFAEAIYGVGEWRGAHRIDDINRIFWRYLYQRDNQHHTYRCLQTVNDADSAADDDYPELEFNY

SEQ ID NO: 9732 - protein, 313 aa, Erwinia piriflorinigrans; identical to SEQ ID NO: 8764

SEQ ID NO: 9733 - protein, 65 aa, Escherichia coli; identical to SEQ ID NO: 9329

SEQ ID NO: 9734 - protein, 84 aa, Escherichia coli; identical to SEQ ID NO: 9328

SEQ ID NO: 9735 - protein, 108 aa, Escherichia coli; identical to SEQ ID NO: 9327

SEQ ID NO: 9736 - protein, 683 aa, Pseudoalteromonas agarivorans; identical to SEQ ID NO: 9332

SEQ ID NO: 9737 - protein, 317 aa, Dickeya dianthicola
MSSLIILRRIQVENANAIAGHTYGFPAISHFLGFTHALSRRLQASHGLRLEGCGVVCHQHQLHAYGSGWNRSFALTRNPLTKEEKTAAFNEEGRMHFTVSLLMECHGMLPGEDGLDALKQQLQQLALRQRLAGGLMVDIERVSIDDMPADDSSTRGLMRRLLPGFVLVDRTPLLQSHFQTLQQTNPQAEMLDAWLDFAALKYQAVRSPDDDVSWQPLPKPQGGYLVPLMTGYRAISPLYNPGEVEKTRDPSTPFCFAEAIYGVGEWRGAHRIDDINRLFWRYHYQHDNQHHTYRCLQTVNDADGAVDDDYPELEFNY

SEQ ID NO: 9738 - protein, 148 aa, Aedes aegypti; identical to SEQ ID NO: 8780

SEQ ID NO: 9739 - protein, 321 aa, Phytophthora infestans T30-4; identical to SEQ ID NO: 8819

SEQ ID NO: 9740 - protein, 582 aa, Micromonas pusilla CCMP1545; identical to SEQ ID NO: 8803

SEQ ID NO: 9741 - protein, 122 aa, Trichophyton rubrum CBS 118892; identical to SEQ ID NO: 8853

SEQ ID NO: 9742 - protein, 886 aa, Leishmania major strain Friedlin; identical to SEQ ID NO: 8760

SEQ ID NO: 9743 - protein, 374 aa, Cucumis sativus
MEDEDPPLAVEIGETITAVQQHEDDGVSVGVTVITGYLGAGKSTLVNYVLNSQHGKRIAVILNEFGEEIGIERAMINEGDGGALVEEWVELANGCICCTVKHSLVQALEQLVQRKERLDHILLETTGLANPAPLASVLWLDDQLESSIKLDSIITVVDAKNLHFQLNEHRSSSSFPEAFHQIVFADTIILNKVDLVSSDRGDGALEDLEYEIRNINSLIRNINSLAKIIHSVRCQVDLSLILDCNSYNAANTAHLEALLKESRSLSTQDLHDTGVRTLCISEDDKVDLDKVHSWLEEILWEKKGGMDVYRCKGVLSIKNSDQLHTLQAVRELYEIVPTRQWNNGESQTNKIVFIGRNLNEDVLSKTFRECASIS

SEQ ID NO: 9744 - protein, 309 aa, Ceratitis capitata
MSYLILLPRVRVENANAVAGLTWGFPAITQFLGYTHALSRRLQQSDGLSLEGCAVICHDSQPHAHSSGRDFQFALTRNPLTKEGKTAAFNEEGRMHLTVSLLIECSGEIANGEYGKKALAQRLAELCQRHKLAAGSIVSMREPQIFDYPHDDKQLRKILWRLMPGFALCDRHPWLTEHHLDLQQEQPQATLLDAWLDFAALKYQSEEDEGKVEWRYRPKPQPGYLVPLMCGYQRISPLYAPGEVANARDAGTPFAFAEAVYGVGEWRSLHRITDLQTLLWRYHTTETGYYCRAVPLPEEISFNEFDDLE

SEQ ID NO: 9745 - protein, 375 aa, Theileria equi strain WA; identical to SEQ ID NO: 9002

SEQ ID NO: 9746 - protein, 314 aa, Agaricus bisporus var. bisporus H97
MDAAVTSAVQHLLAGKYFQIAAAAMFAYDHLITVGQEVERVWMHPKSAASLLFFLNRYATLMQLIIILVVGEASRMYLYTNGSTIASLGNCFRCDKYVLFEGVSTVGVVAGLRTGFAVPLPPGLIGCILTDSNTLFPSLWIASLVTDSFIFLLTIYRTKENIGHLITSMMNGGASDRVVTILLRDGLMYYFLIFLANLMNCLIYFIAEPDLKSIGASFSQLLTCTMISRLVLNLRSLSDGNSGHTTDITAIQFNGQRDPLDQPGTTASTQPETQANNSITLEIGHSAFDEAPLEQVPERISDLNDKTGHSLHDV

SEQ ID NO: 9747 - protein, 319 aa, Actinobacillus pleuropneumoniae serovar 5b str. L20; identical to SEQ ID NO: 8633

SEQ ID NO: 9748 - protein, 316 aa, Yersinia pestis Pestoides F; identical to SEQ ID NO: 53

SEQ ID NO: 9749 - protein, 310 aa, Enterobacter sp. 638; identical to SEQ ID NO: 8636

SEQ ID NO: 9750 - protein, 316 aa, Dichelobacter nodosus VCS1703A; identical to SEQ ID NO: 8637

SEQ ID NO: 9751 - protein, 331 aa, Shewanella baltica OS185; identical to SEQ ID NO: 8638

SEQ ID NO: 9752 - protein, 316 aa, Yersinia pseudotuberculosis IP 31758; identical to SEQ ID NO: 8639

SEQ ID NO: 9753 - protein, 339 aa, Coxiella burnetii Dugway 5J108-111; identical to SEQ ID NO: 8641

SEQ ID NO: 9754 - protein, 320 aa, Coxiella burnetii Dugway 5J108-111; identical to SEQ ID NO: 8640

SEQ ID NO: 9755 - protein, 640 aa, Vibrio campbellii ATCC BAA-1116; identical to SEQ ID NO: 8642

SEQ ID NO: 9756 - protein, 331 aa, Shewanella baltica OS195; identical to SEQ ID NO: 8644

SEQ ID NO: 9757 - protein, 362 aa, Delftia acidovorans SPH-1; identical to SEQ ID NO: 8643

SEQ ID NO: 9758 - protein, 316 aa, Yersinia pestis Angola; identical to SEQ ID NO: 53

SEQ ID NO: 9759 - protein, 319 aa, Actinobacillus pleuropneumoniae serovar 3 str. JL03; identical to SEQ ID NO: 8646

SEQ ID NO: 9760 - protein, 294 aa, Acinetobacter baumannii AYE; identical to SEQ ID NO: 8656

SEQ ID NO: 9761 - protein, 316 aa, Yersinia pseudotuberculosis YPIII; identical to SEQ ID NO: 8647

SEQ ID NO: 9762 - protein, 316 aa, Yersinia pseudotuberculosis PB1/+; identical to SEQ ID NO: 8648

SEQ ID NO: 9763 - protein, 313 aa, Erwinia tasmaniensis Et1/99; identical to SEQ ID NO: 8751

SEQ ID NO: 9764 - protein, 291 aa, Treponema pallidum subsp. pallidum SS14; identical to SEQ ID NO: 8615

SEQ ID NO: 9765 - protein, 319 aa, Actinobacillus pleuropneumoniae serovar 7 str. AP76; identical to SEQ ID NO: 8651

SEQ ID NO: 9766 - protein, 690 aa, Vibrio fischeri MJ11; identical to SEQ ID NO: 8652

SEQ ID NO: 9767 - protein, 320 aa, Coxiella burnetii CbuG_Q212; identical to SEQ ID NO: 8653

SEQ ID NO: 9768 - protein, 320 aa, Coxiella burnetii CbuK_Q154; identical to SEQ ID NO: 8654

SEQ ID NO: 9769 - protein, 701 aa, Shewanella piezotolerans WP3; identical to SEQ ID NO: 8655

SEQ ID NO: 9770 - protein, 294 aa, Acinetobacter baumannii AB307-0294; identical to SEQ ID NO: 8656

SEQ ID NO: 9771 - protein, 316 aa, Yersinia pestis CO92; identical to SEQ ID NO: 53

SEQ ID NO: 9772 - protein, 701 aa, Shewanella baltica OS223; identical to SEQ ID NO: 8657

SEQ ID NO: 9773 - protein, 307 aa, Escherichia coli ED1a; identical to SEQ ID NO: 8753

SEQ ID NO: 9774 - protein, 336 aa, Laribacter hongkongensis HLHK9; identical to SEQ ID NO: 8658

SEQ ID NO: 9775 - protein, 325 aa, Tolumonas auensis DSM 9187; identical to SEQ ID NO: 8659

SEQ ID NO: 9776 - protein, 335 aa, Desulfovibrio magneticus RS-1; identical to SEQ ID NO: 8740

SEQ ID NO: 9777 - protein, 316 aa, Dickeya dadantii Ech703; identical to SEQ ID NO: 8660

SEQ ID NO: 9778 - protein, 313 aa, Dickeya zeae Ech1591; identical to SEQ ID NO: 8661

SEQ ID NO: 9779 - protein, 320 aa, Photorhabdus asymbiotica; identical to SEQ ID NO: 8752

SEQ ID NO: 9780 - protein, 337 aa, Zymomonas mobilis subsp. mobilis NCIMB 11163; identical to SEQ ID NO: 8662

SEQ ID NO: 9781 - protein, 310 aa, Pectobacterium wasabiae WPP163; identical to SEQ ID NO: 8663

SEQ ID NO: 9782 - protein, 318 aa, Dickeya dadantii Ech586; identical to SEQ ID NO: 8666

SEQ ID NO: 9783 - protein, 327 aa, Xanthomonas albilineans GPE PC73; identical to SEQ ID NO: 8756

SEQ ID NO: 9784 - protein, 322 aa, Thioalkalivibrio sp. K90mix; identical to SEQ ID NO: 8667

SEQ ID NO: 9785 - protein, 309 aa, Nitrosococcus halophilus Nc 4; identical to SEQ ID NO: 8668

SEQ ID NO: 9786 - protein, 461 aa, Coraliomargarita akajimensis DSM 45221; identical to SEQ ID NO: 8669

SEQ ID NO: 9787 - protein, 316 aa, Yersinia pestis Z176003; identical to SEQ ID NO: 53

SEQ ID NO: 9788 - protein, 297 aa, Moraxella catarrhalis RH4; identical to SEQ ID NO: 8671

SEQ ID NO: 9789 - protein, 319 aa, Desulfurivibrio alkaliphilus AHT2; identical to SEQ ID NO: 8672

SEQ ID NO: 9790 - protein, 309 aa, Nitrosococcus watsonii C-113; identical to SEQ ID NO: 8673

SEQ ID NO: 9791 - protein, 335 aa, Dickeya dadantii 3937; identical to SEQ ID NO: 8674

SEQ ID NO: 9792 - protein, 319 aa, Halomonas elongata DSM 2581; identical to SEQ ID NO: 8758

SEQ ID NO: 9793 - protein, 682 aa, Pseudoalteromonas sp. SM9913; identical to SEQ ID NO: 8682

SEQ ID NO: 9794 - protein, 328 aa, Desulfurispirillum indicum S5; identical to SEQ ID NO: 8684

SEQ ID NO: 9795 - protein, 276 aa, Burkholderia sp. CCGE1001; identical to SEQ ID NO: 8686

SEQ ID NO: 9796 - protein, 331 aa, Marinomonas mediterranea MMB-1; identical to SEQ ID NO: 8689

SEQ ID NO: 9797 - protein, 297 aa, Sphaerochaeta coccoides DSM 17374; identical to SEQ ID NO: 8690

SEQ ID NO: 9798 - protein, 372 aa, Delftia sp. Cs1-4; identical to SEQ ID NO: 8691

SEQ ID NO: 9799 - protein, 295 aa, Methylomonas methanica MC09; identical to SEQ ID NO: 8692

SEQ ID NO: 9800 - protein, 223 aa, Treponema paraluiscuniculi Cuniculi A; identical to SEQ ID NO: 8693

SEQ ID NO: 9801 - protein, 295 aa, Megasphaera elsdenii DSM 20460; identical to SEQ ID NO: 8761

SEQ ID NO: 9802 - protein, 311 aa, Klebsiella oxytoca KCTC 1686; identical to SEQ ID NO: 8700

SEQ ID NO: 9803 - protein, 699 aa, Vibrio sp. EJY3; identical to SEQ ID NO: 8701

SEQ ID NO: 9804 - protein, 577 aa, Burkholderia sp. YI23; identical to SEQ ID NO: 8699

SEQ ID NO: 9805 - protein, 327 aa, Pasteurella multocida 36950; identical to SEQ ID NO: 8698

SEQ ID NO: 9806 - protein, 317 aa, Rahnella aquatilis CIP 78.65 = ATCC 33071; identical to SEQ ID NO: 8702

SEQ ID NO: 9807 - protein, 223 aa, Treponema pallidum subsp. pertenue str. Gauthier; identical to SEQ ID NO: 8703

SEQ ID NO: 9808 - protein, 223 aa, Treponema pallidum subsp. pallidum DAL-1; identical to SEQ ID NO: 8703

SEQ ID NO: 9809 - protein, 210 aa, Treponema pallidum subsp. pertenue str. CDC2
MKQLKWWAVGPVLGICAGVWGAAHPVHADPWDTTAAGRSTIRLSAMGAVPLFQVDWCNSGRGDDRNANAQTNGHKYIYPAFSAALGFEHFVCRGLSLGIDASVQYHCSYPNNTYSPTTPYYYLAIPVALTAGYTVAFWRIRLPLTVGAGFNYQHYYTSTYYGLVLKAAAGCYFQLTEHWSLGVSATYSGVPRSCEKIIEEDRQQTNTRTA

SEQ ID NO: 9810 - protein, 331 aa, Shewanella baltica OS678; identical to SEQ ID NO: 8644

SEQ ID NO: 9811 - protein, 327 aa, Pasteurella multocida subsp. multocida str. HN06; identical to SEQ ID NO: 8706

SEQ ID NO: 9812 - protein, 310 aa, Selenomonas ruminantium subsp. lactilytica TAM6421; identical to SEQ ID NO: 8741

SEQ ID NO: 9813 - protein, 295 aa, Spirochaeta africana DSM 8902; identical to SEQ ID NO: 8707

SEQ ID NO: 9814 - protein, 275 aa, Yersinia pestis D106004; identical to SEQ ID NO: 8664

SEQ ID NO: 9815 - protein, 316 aa, Yersinia pestis D182038; identical to SEQ ID NO: 53

SEQ ID NO: 9816 - protein, 316 aa, Yersinia pestis A1122; identical to SEQ ID NO: 53

SEQ ID NO: 9817 - protein, 337 aa, Zymomonas mobilis subsp. mobilis ATCC 10988; identical to SEQ ID NO: 8694

SEQ ID NO: 9818 - protein, 316 aa, Yersinia pestis biovar Medievalis str. Harbin 35; identical to SEQ ID NO: 53

SEQ ID NO: 9819 - protein, 335 aa, Xanthomonas campestris pv. raphani 756C; identical to SEQ ID NO: 8695

SEQ ID NO: 9820 - protein, 314 aa, Erwinia pyrifoliae DSM 12163; identical to SEQ ID NO: 8754

SEQ ID NO: 9821 - protein, 327 aa, Pseudomonas aeruginosa M18; identical to SEQ ID NO: 8627

SEQ ID NO: 9822 - protein, 307 aa, Escherichia coli O83:H1 str. NRG 857C; identical to SEQ ID NO: 8676

SEQ ID NO: 9823 - protein, 315 aa, Providencia stuartii MRSN 2154; identical to SEQ ID NO: 8708

SEQ ID NO: 9824 - protein, 327 aa, Pasteurella multocida subsp. multocida str. 3480; identical to SEQ ID NO: 8706

SEQ ID NO: 9825 - protein, 310 aa, Pectobacterium sp. SCC3193; identical to SEQ ID NO: 8711

SEQ ID NO: 9826 - protein, 319 aa, Aggregatibacter actinomycetemcomitans D7S-1; identical to SEQ ID NO: 8710

SEQ ID NO: 9827 - protein, 313 aa, Methylophaga frappieri; identical to SEQ ID NO: 8712

SEQ ID NO: 9828 - protein, 327 aa, Pseudomonas aeruginosa DK2; identical to SEQ ID NO: 8627

SEQ ID NO: 9829 - protein, 337 aa, Zymomonas mobilis subsp. mobilis ATCC 29191; identical to SEQ ID NO: 8714

SEQ ID NO: 9830 - protein, 310 aa, Pectobacterium carotovorum subsp. carotovorum PCC21; identical to SEQ ID NO: 8715

SEQ ID NO: 9831 - protein, 328 aa, Alcanivorax dieselolei B5; identical to SEQ ID NO: 8716

SEQ ID NO: 9832 - protein, 223 aa, Treponema pallidum subsp. pallidum str. Mexico A; identical to SEQ ID NO: 8703

SEQ ID NO: 9833 - protein, 331 aa, Thioalkalivibrio nitratireducens DSM 14787; identical to SEQ ID NO: 8718

SEQ ID NO: 9834 - protein, 640 aa, Vibrio parahaemolyticus BB22OP; identical to SEQ ID NO: 8719

SEQ ID NO: 9835 - protein, 336 aa, Desulfovibrio hydrothermalis AM13 = DSM 14728; identical to SEQ ID NO: 8767

SEQ ID NO: 9836 - protein, 309 aa, Serratia marcescens FGI94; identical to SEQ ID NO: 8720

SEQ ID NO: 9837 - protein, 295 aa, Taylorella asinigenitalis 14/45; identical to SEQ ID NO: 8763

SEQ ID NO: 9838 - protein, 289 aa, Taylorella equigenitalis 14/56; identical to SEQ ID NO: 8762

SEQ ID NO: 9839 - protein, 223 aa, Treponema pallidum str. Fribourg-Blanc; identical to SEQ ID NO: 8703

SEQ ID NO: 9840 - protein, 223 aa, Treponema pallidum subsp. pallidum str. Nichols; identical to SEQ ID NO: 8703

SEQ ID NO: 9841 - protein, 223 aa, Treponema pallidum subsp. pallidum SS14; identical to SEQ ID NO: 8703

SEQ ID NO: 9842 - protein, 640 aa, Vibrio parahaemolyticus O1:Kuk str. FDA_R31; identical to SEQ ID NO: 8726

SEQ ID NO: 9843 - protein, 640 aa, Vibrio campbellii ATCC BAA-1116; identical to SEQ ID NO: 8642

SEQ ID NO: 9844 - protein, 71 aa, Escherichia coli PMV-1; identical to SEQ ID NO: 8774

SEQ ID NO: 9845 - protein, 213 aa, Escherichia coli PMV-1; identical to SEQ ID NO: 8623

SEQ ID NO: 9846 - protein, 309 aa, Desulfovibrio gigas DSM 1382 = ATCC 19364; identical to SEQ ID NO: 8728

SEQ ID NO: 9847 - protein, 351 aa, Candidatus Symbiobacter mobilis CR; identical to SEQ ID NO: 8729

SEQ ID NO: 9848 - protein, 336 aa, Desulfovibrio hydrothermalis; identical to SEQ ID NO: 8767

SEQ ID NO: 9849 - protein, 327 aa, Pseudomonas aeruginosa SCV20265; identical to SEQ ID NO: 8627

SEQ ID NO: 9850 - protein, 294 aa, Acinetobacter sp. ADP1; identical to SEQ ID NO: 8744

SEQ ID NO: 9851 - protein, 310 aa, Pectobacterium atrosepticum SCRI1043; identical to SEQ ID NO: 8745

SEQ ID NO: 9852 - protein, 316 aa, Yersinia pseudotuberculosis IP 32953; identical to SEQ ID NO: 8648

SEQ ID NO: 9853 - protein, 313 aa, Legionella pneumophila str. Lens; identical to SEQ ID NO: 8747

SEQ ID NO: 9854 - protein, 313 aa, Legionella pneumophila str. Lens; identical to SEQ ID NO: 8746

SEQ ID NO: 9855 - protein, 337 aa, Zymomonas mobilis subsp. mobilis ZM4 = ATCC 31821; identical to SEQ ID NO: 8620

SEQ ID NO: 9856 - protein, 309 aa, Nitrosococcus oceani ATCC 19707; identical to SEQ ID NO: 8621

SEQ ID NO: 9857 - protein, 71 aa, Escherichia coli UTI89; identical to SEQ ID NO: 8774

SEQ ID NO: 9858 - protein, 213 aa, Escherichia coli UTI89; identical to SEQ ID NO: 8623

SEQ ID NO: 9859 - protein, 316 aa, Yersinia pestis Nepal516; identical to SEQ ID NO: 53

SEQ ID NO: 9860 - protein, 316 aa, Yersinia pestis Antiqua; identical to SEQ ID NO: 53

SEQ ID NO: 9861 - protein, 327 aa, Pseudomonas aeruginosa UCBPP-PA14; identical to SEQ ID NO: 8627

SEQ ID NO: 9862 - protein, 213 aa, Escherichia coli APEC O1; identical to SEQ ID NO: 8623

SEQ ID NO: 9863 - protein, 701 aa, Shewanella sp. ANA-3; identical to SEQ ID NO: 8628

SEQ ID NO: 9864 - protein, 318 aa, Psychromonas ingrahamii 37; identical to SEQ ID NO: 8629

SEQ ID NO: 9865 - protein, 316 aa, Shewanella sp. W3-18-1; identical to SEQ ID NO: 8630

SEQ ID NO: 9866 - protein, 360 aa, Acidovorax sp. JS42; identical to SEQ ID NO: 8631

SEQ ID NO: 9867 - protein, 347 aa, Verminephrobacter eiseniae EF01-2; identical to SEQ ID NO: 8632

SEQ ID NO: 9868 - protein, 335 aa, Pasteurella multocida subsp. multocida str. Pm70
MSKLSTPSVLAFERNLDISDAIFAQKDSKNDKDAPVPLRIREKSVRGTISNRLKNTITNDPAKLDAETEKANLQRVDVATLDDDKDTLVATFSIKVLPFTGRPNVCNDQDYQHQVMTTVAQYLSEQGMDELAKRYATNIANARWLWRNRMGAEKIKIEVTCGENTIHFDDAKQFSLNHFDHQDDKIHQIAKEIKQGLLGEKFVILYVTAYANMGYGQEVYPSQELVLDNSTNNRKSKILYEINQKAGMHSQKVGNAIRTIDTWYAEEVAFPIAAEPYGAVTTLGTAFRQPKTKKNDFYTLFDNWLLKGEVPPVEQQHYVMSVLIRGGVFGASGKE

SEQ ID NO: 9869 - protein, 334 aa, Yersinia pestis KIM10+; identical to SEQ ID NO: 55

SEQ ID NO: 9870 - protein, 369 aa, Coxiella burnetii RSA 493
MTNLVNLKLRRTTMAKKENIDIASVLSFEKKLIPSDGYMFGTSWDKKSEVTPLKLREKAVRGTISNRFNKNDSKTFLDDPMKLDADVERPNLQRVDACALDQNQDTLKLCFTLKVLGGITNPSACNNALFKQSYKAAAKIYIDTHGFTELATRYAENLANARFLWRNRFGAERIEVRVNASNKTVSQKWAFDATKFNLHTFDSSDTSVKELGALIANALSSEDDYLLLDVNCYVQVGSSQEVYPSEELVLDKSSSDKKGKKTKILYAVNDIAAMHSQKIGNAIRTIDTWYPDFTNQEQTAGPIAIEPYGAVTNLGRSYRTPKDKQDFYTFFDAWARGEQLARVEDEHYVMAVLVRGGVFGKSDKKESDK

SEQ ID NO: 9871 - protein, 344 aa, Chromobacterium violaceum ATCC 12472
MSKLENPSVLAFERKLDPSDALFYAGNWDARDASQTWPHIAIQEKSVRGTISNRLKTKDQDPAKLDAAIESPNLQTVDVAALPHDADTLKASFTLRVLAGAGAPSACNSAAYRAKLLVTVSAYARDIGFGELARRYAHNLANGRFLWRNRVGAEQVEVRIQRLADGQEQAGWTFDAQALRLRDFAASGQAASDLDAVAKLIAAGLNGEQHVLLRVTAFVRIGAGQEVFPSQELILDRQRGDKSKTLYAVKQKDGDIAAIHSQKIGNAIRTIDTWYPEADDNGPIAIEPYGSVTTQGKAYRQPKQKQDFYNLLDNWVLKDEAPPLEQQHFVIATLIRGGVFGEAG

SEQ ID NO: 9872 - protein, 334 aa, Yersinia pestis biovar Microtus str. 91001; identical to SEQ ID NO: 55

SEQ ID NO: 9873 - protein, 346 aa, Zymomonas mobilis subsp. mobilis ZM4 = ATCC 31821
MSEEKNLKTASVLSFERKLDPSDALFFSGNWSNKSDDKAWQPIHLREKSVRGTISNRLKKGEADPAKLNAAIEKPNLQTVDVATLPFDSDTLKVEFTLRVLGGVGEPAACNSMEYRSKLVATISHYIDTHGLDILGNRYAANLANGRFLWRNRLGADAISIQITRLSGDESTLVGVFDALAHPLRQFEEKSVSEELEALAKLITAGLAGQEHVLLRVKAFIRMGEGQEVFPSQELLLDKGKSTKSRFLYSVGQDEKAIAAIHSQKIGNALRTIDTWYPDAEINGPIAVEPYGSVTTQGVAYRQPKAKKDFYSLLDAWVLKDKEPTIEDQHFVAAVLVRGGVFGDAS

SEQ ID NO: 9874 - protein, 357 aa, Nitrosococcus oceani ATCC 19707
MATVQLPSLLNYTRSIVPSEGTFWVANADNRPLLIQDKTLLGTIANYSSVYKKDKQRDEGAIEKEMMAGDNNIQRVDSCHLPADADTFELRFTLKFLANANGPEACEGAEFREDLESIAQAYAEKGGFTLLAERYLANLLNGRFLWRNRYGVQRQITLRAPYNELKEKTFEIIDRAEPTLPQVRMDELKPWIDHIASALSGKTSFFLMEVSARVTIGLGQEVYPSQEFVDKDSRGQGKKSKTLFFVQVADQQVAAMHSQKIGNAIRTIDNWYPDANADRPLAVDPFTVDKRRARAVRLPDHGKSDFYSLLKNLPALKDDIEHAPNAEAIPGQAHYFMAVLIRGGVFSGEKKAEKKAK

SEQ ID NO: 9875 - protein, 333 aa, Escherichia coli UTI89
MAKAPVAIKTASVLAFERKLATSDAVMYAGNWQGNEWQPIEIQEKAVRGTISNRLKNAIVSDPTKLDAEIQKANLQRVDVASLPVDTDTLKVVFTLRVLGNLSTPSVCNDMAYQEALSGVIEGYISEHGFKELALRYALNLANGRFLWRNRIGAEQIQVKVTANETSWTFNSHDFSLRQFDQGQAAVTQLAAIIEQGLSAKEWVMLTVEAQVRLGAGQEVFPSQELVLDSNSSKSRVLYQVAGIAGIHSQKIGNALRTIDTWHPKVDELGAIAVEPYGSVTSRGVACRQPKEKLDFYTLLDNWVTKGMKPDVEQQHYVMAVLIRGGVFGEKSE

SEQ ID NO: 9876 - protein, 334 aa, Yersinia pestis Antiqua; identical to SEQ ID NO: 55

SEQ ID NO: 9877 - protein, 334 aa, Yersinia pestis Nepal516; identical to SEQ ID NO: 55

SEQ ID NO: 9878 - protein, 333 aa, Escherichia coli APEC O1; identical to SEQ ID NO: 9875

SEQ ID NO: 9879 - protein, 342 aa, Pseudomonas aeruginosa UCBPP-PA14
MSKPILSTASVLAFERKLDPSDALMSAGAWAQRDASQEWPAVTVREKSVRGTISNRLKTKDRDPAKLDASIQSPNLQTVDVANLPSDADTLKVRFTLRVLGGAGTPSACNDAAYRDKLLQTVATYVNDQGFAELARRYAHNLANARFLWRNRVGAEAVEVRINHIRQGEVARAWRFDALAIGLRDFKADAELDALAELIASGLSGSGHVLLEVVAFARIGDGQEVFPSQELILDKGDKKGQKSKTLYSVRDAAAIHSQKIGNALRTIDTWYPDEDGLGPIAVEPYGSVTSQGKAYRQPKQKLDFYTLLDNWVLRDEAPAVEQQHYVIANLIRGGVFGEAEEK

SEQ ID NO: 9880 - protein, 349 aa, Shewanella sp. ANA-3
MELCNVLKYDRSLYPSKAVFFYKTADSDFVPLEAEITRIRGQKAGFTEAFTPQFKSKNLAPQDLTHCNPLTIEECYVPPNVDHIYCRFSLRVQANSLKPSGCSDSEVSSLLEKLSAAFKECDGYQELATRFCKNLLLGTWLWRNQNSGNTQIDIKTSTGKCYQISNTRQLAWNIWSDEARTVLGELSKEMHLALTDPNVFWNADITAKIETVFCQEIYPSQTFGEKSAEGETSKQFTKVKCTDGRYAVSFNSVKIGAAIQSIDNWWDQDDVKRLRVHEYGADKELGIARRSPESALSFYTLFVNTELYLAELNQQAAEPGHSIHPNIYYLFAVLIKGGMFQKKAETKKA

SEQ ID NO: 9881 - protein, 341 aa, Psychromonas ingrahamii 37
MAKNENIASVLAFEKKLVPSDGYMYGTNWDNKTLVTALSLIEKSVRGTISNRLKAAIKSDPVKLNTEVEKANLQTIDVCALAPEQDTLKLHFTLKILGGVQQPSACNNALFKQSYSKAVNKYIEKEGFKELGKRYALNLANARFLWRNRVGSENIEVQVNALNKDSKQSWGFDATQFSMRNFDDANAQVLELGDRIAKALSSEDDFLMLEINCFVQLGKAQEVYPSEELVLDKGKGTKSKILYAVKDIAAMHSQKIGNALRSIDTWYPEFVEVEKTAGPIAIEPYGAVTNLGKAYRTPKDKQDFYTFFDKWARGTELGRIEDEHYVMAILVRGGVFGESDK

SEQ ID NO: 9882 - protein, 342 aa, Shewanella sp. W3-18-1
MAKKENVASVLAFEKKLVVSDGYMYGTSWTERSQIVPLALREKSVRGTISNRLKAAIKNDPAKLNAEVEKANLQRVDACALAPEHDTLNLQFTIKVLGGITEPSACNNALFKQSYRAAAATYIENQGFTELARRYATNLANARFLWRNRVGAENIEVQVRAKNSTLDQSWTFDAAQFSTKSFDNNDAQINALANHIATVLSSEDDFLLLDINCFAQVGRAQEVYPSEELVLDKGKGEKSKILYNVNGLAAMHSQKLGNALRTIDTWYPEFTDPETSAGAIAIEPYGAVTNLGKAYRTPAAKQDFYSFFDLWARGEKLSRIEDEHYVMAVLVRGGVFGESDKE

SEQ ID NO: 9883 - protein, 341 aa, Acidovorax sp. JS42
MTDKLTTASVLAFERKLDPSDAVFHAGRWDDRAQSHAWQPVTVREKSVRGTISNRLKAKDQDPAKLDAAIENPNLQTVDVAALPAEADTLKVQFTLRVLGGAGTPSACNSAAYQAKLLATVQGYVQQHGFGELARRYAANLANGRFLWRNRAGAEQVEVTVEQMQNGQAAQIWSFDALALNTRAVGAINTEAKGLDELGQAMAAGLAGSQHVLLRITAFVRQGAGQEVFPSQELILDKDSAGKSKTLYHVDGVAAIHSQKIGNAIRTIDTWYEGAEELGPIAVEPYGSVTTQGKAYRQPKQKLDFYTLLDNWLLKDQVPPVEQQHFVMAVLIRGGVFGDAS

SEQ ID NO: 9884 - protein, 340 aa, Verminephrobacter eiseniae EF01-2
MSNNLKTASVLAFERKLDPSDATLHAGNWDNRNNTSGWNAVSIRPKSVRGTISNRLKTKDQDPAKLDAAIENPNLQTVDVAMLPSGADTLKIQFTLRVLAGTGTPSACNNAEYQAKLKHTVQGYVAKEGFTELAKRYAANLANGRFLWRNRLGAENVQVEVALLQDGKEEQSWSFDALTLDLRKPDVTNDDVLALGAVIASGLAGERRVLLQVTAFVRQGAGQEVFPSQELILDKGSNGKSKTLYHVNGVAAIHSQKIGNALRTIDTWYEGASDLDLGPIAVEPYGSVTTQGKAYRQPKQKQDFYTLLDNWLLKDQEPPMEQQHFVMAVLIRGGVFGDAS

SEQ ID NO: 9885 - protein, 331 aa, Actinobacillus pleuropneumoniae serovar 5b str. L20
MTKLTTASVLAFERKLDISDATFTQKNSTSSEPEIAVTIREKSVRGTISNRLKNALANDPAKLDAEIEKANLQRVDVATLNDDYDTLVARFTCKVLPFEGKPNVCNDPEYQAKLLSTIQNYLTAHGMSELAKRYATNLANARWLWRNRISAETIQVSIKVADDVIVFENAKQLPLNSFEQADEKLQKIASYIEKGLKGEEFIILEVEAQAKMGRGQEVYPSQELVLDTGTRKSKILYEINHKAGMHSQKIGNAIRTIDTWYAENAPFPIAAEPYGAVTNLGTAFRQPKEKIDFYTLFDNWVLKDVAPELEQQHYVISVLIRGGVFGASGKE

SEQ ID NO: 9886 - protein, 334 aa, Yersinia pestis Pestoides F; identical to SEQ ID NO: 55

SEQ ID NO: 9887 - protein, 96 aa, Bacteroides uniformis
MKTCRKDFQGRKSTTVLKLLCRNIAAGRFNWRRYCTPQTYFGQEICVTPLHCSYGQIGYTVHFPYSNMPEVEYDWEMGKLTVDEENWKEYFRHSEQ

SEQ ID NO: 9888 - protein, 332 aa, Enterobacter sp. 638
MAKAPTAVKTASVLAFERKLATSDAVMFSGHWQSERWQPIRIQEKAVRGTISNRLKNAVASDPAKLDSEIQKANLQRVDVAALPADADTLQVKFTLRVLGNLSTPSVCNDRIYQTELQQVIDGYISEHGFAELAHRYATNLANGRFLWRNRIGAEKITVKVKGSKLWEFDAHDFALRDFTAKDDKLKELAKEIEKGLCDKGFVLLNVEAQVLLGAGQEIFPSQELVLDSNSTKSRLLYQVDNVAGMHSQKIGNAVRTIDTWHSYVDELGAIAVEPYGSVTSRGVACRQPKEKMDFYTLLDNWVTKGQTPDVDQQHYVMAVLIRGGVFGEKSE

SEQ ID NO: 9889 - protein, 336 aa, Dichelobacter nodosus VCS1703A
MSNKRESSEQKLKTPSLLSFARSIDISDAFFWQTNSKDAKHNRSIVTVQEKSVRGTISNRLKNTSTSDIAKIDAKIEEANLQRVDASSLDEDKDILLVHFTCKILPFTAEPCVCNDQAYQEKLQTVMSKYIEEQGFKELARRYAINIANARWLWRNRVGAESILVTVTLNEKESLTFDACSFELRHFNCHNKQLDQLAQWIESGFKGEFILLSVEARVKIGYGQEVYPSQELILDGKSKKSKVLYLVGDGSDNHAGMHSQKISNAIRTIDDWYPEAEFPIAVEPYGAVTTLGKAFRHPKDKKDFYNLFDNWILKDQVPEVNDQHYVAAVLIRGGVF

SEQ ID NO: 9890 - protein, 327 aa, Shewanella baltica OS185
MADIKLSTPSVLAFEAKLLPSDALMFAGNWDENVWQPIIVGEKAVRGTISNRLKAATANDPAKLDAEVSKANLQTVDIAALPHHTDTLKLVFTLRILSDLHIPSTCNDPAYQEALAAKVKQYQIETQFSELAKRYAQNIANGRFLWRNRVGAQAVKIVVTANNQHFTFDSYDFNLRDFADDQQINELAKIIQFGLMEKHALIKVEAYSQLGQGQAVFPSQELVMGGGKGDKSKFLYQLDGQAAMHSQKIGNALRTIDTWHPDFEEIGPIAVEPYGSVTNRGAAYRQPKEKNDFYNLLDAWMLKDKIPSIEQQHYVMAMLIRGGVFGE

SEQ ID NO: 9891 - protein, 334 aa, Yersinia pseudotuberculosis IP 31758; identical to SEQ ID NO: 55

SEQ ID NO: 9892 - protein, 369 aa, Coxiella burnetii Dugway 5J108-111
MTNLVNLKLRRTTMAKKENIDIASVLSFEKKLIPSDGYMFGTSWDKKSEVTPLKLREKAVRGTISNRFNKNDSKTFLDDPMKLDADVERPNLQRVDACALDQNQDTLKLCFTLKVLGGITNPSACNNALFKQSYKAAAKIYIDTHGFTELATRYAENLANARFLWRNRFGAERIEVRVNASNKTVSQKWAFDATKFNLHTFDSSDTSVKELGALIANALSSEDDYLLLDVNCYVQVGSSQEVYPSEELVLDKSSSDKKGKKTKILYAVNDIAAMHSQKIGNAIRTIDTWYPDFTNQEQTAGPIAIEPYGAVTNLGRAYRTPKDKQDFYTFFDAWARGEQLARIEDEHYVMAVLVRGGVFGKSDKKESDK

SEQ ID NO: 9893 - protein, 353 aa, Coxiella burnetii Dugway 5J108-111
MSDKNKKAASVLAFERKLDPSDAVFFAGKWEDLDKPDQWSPIRVREKAVRGTISNRLKVKEQNSGKINQKIEVPNLQRVDVAALPNDCDTLKVSFTLRILGEVGKPSACSSTDYLNKLLSVVEGYKITQGFSELAKRYAHNLANGRFLWRNRIGAEAIKIRVCQRENGAAKSTWEFDAFQFSLRDFEVKDNLEMFENLARLIESGLEGKQRSVLLAIEAFVRIGEGQEVFPSQELVLDNRKSKKKGEKGKLLYQINEIAAIHSQKIGNALRTIDTWYKADEQEEIGPIAVEPYGSVTTLSKACRPPKESDFYSLFDNWVLYNKTPEDIGNQHFVMATLIRGGVFGESSKEDSE

SEQ ID NO: 9894 - protein, 352 aa, Vibrio campbellii ATCC BAA-1116
MKLPSSLAYERSIDPSDVCFFVVWPDDKKTPLTYTSRTLLGQMETASLAYDTSGQPKKSVTAEALAQGNPHQVDFCHVPYGASHVECCFSVSFSSELRKPYKCNSSSVKQTLVKLVGLYEKKIGWTELATRYLINICDGTWLWKNTRKAYCWNIELTPWPWNGENVKFEDIRNNYISRKDFENHKDWSGMTEMIKTAFSSSNGLAILEVKATVHLPTNAMVRPSQAFTEKENGSKNKSKSQNSRVFQHTVIDGERSPILGAFKTGAAIATIDDWYPEATETLRVGRFGVHREDVTCYRHPSTGKDLFSLLQKADHYIEVLSSNEAPDQEAINDMHFVMANLIKGGLFQHKGD

SEQ ID NO: 9895 - protein, 342 aa, Delftia acidovorans SPH-1
MSSTLKTASVLAFERKLDPSDAVFHAGNWDDRAASASWPSVKLREKSVRGTISNRLKTKDQDPAKLDAAIENPNLQTVDVAALPADADTLKVQFTLRVLSGAGTPSACNSAEYQARLAQTVQTYASAQGFAELANRYAANLANGRFLWRNRVGAESVQVQVVQLKDGKAGQAWSFDALAHNLRTLEQPDEKVASLGSVIAQGLEGKAHVLLQITAFVRLGAGQEVFPSQELILDKGSTKKSKTLYQIGEKGQEVAAIHSQKIGNALRTIDTWYDGAQDLGPIAVEPYGSVTTQGKAWRQPKQKQDFYTLLDDWLLKDKVPPVEQQHFVMAVLIRGGVFGDAS

SEQ ID NO: 9896 - protein, 327 aa, Shewanella baltica OS195
MADIKLSTPSVLAFEAKLLPSDALMFAGNWDENVWQPIIVGEKAVRGTISNRLKAATANDPAKLDAEVSKANLQTVDIAALPHHTDTLKLVFTLRILSDLHIPSTCNDPAYQEALAAKVKQYQIETQFSELAKRYAQNIANGRFLWRNRVGAQAVKIVVTANKQHFTFDSYDFNLRDFADDQQINELAKIIQFGLMEKHALIKVEAYSQLGQGQAVFPSQELVMGGGKGDKSKFLYQLDGQAAMHSQKIGNALRTIDTWHPDFEEIGPIAVEPYGSVTNRGAAYRQPKEKNDFYNLLDAWMLKDKIPSIEQQHYVMAMLIRGGVFGE

SEQ ID NO: 9897 - protein, 356 aa, Coxiella burnetii RSA 331
MAKKENIDIASVLSFEKKLIPSDGYMFGTSWDKKSEVTPLKLREKAVRGTISNRFNKNDSKTFLDDPMKLDADVERPNLQRVDACALDQNQDTLKLCFTLKVLGGITNPSACNNALFKQSYKAAAKIYIDTHGFTELATRYAENLANARFLWRNRFGAERIEVRVNASNKTVSQKWAFDATKFNLHTFDSSDTSVKELGTLIANAPSSEDDYLLLDVNCYVQVGSSQEVYPSEELVLDKSSSDKKGKKTKILYAVNDIAAMHSQKIGNAIRTIDTWYPDFTNQEQTAGPIAIEPYGAVTNLGRSYRTPKDKQDFYTFFDAWARGEQLARVEDEHYVMAVLVRGGVFGKSDKKESDK

SEQ ID NO: 9898 - protein, 334 aa, Yersinia pestis Angola; identical to SEQ ID NO: 55

SEQ ID NO: 9899 - protein, 331 aa, Actinobacillus pleuropneumoniae serovar 3 str. JL03
MTKLTTASVLAFERKLDISDATFTQKNSTSSEPEIAVTIREKSVRGTISNRLKNALANDPAKLDAEIEKANLQRVDVATLNDDYDTLVARFTCKVLPFEGKPNVCNDPEYQAKLLSTIQNYLTVHGMSELAKRYATNLANARWLWRNRISAETIQVSIKVADDVIVFENAKQLPLNSFEQADEKLQKIASYIEKGLKGEEFIILEVEAQAKMGRGQEVYPSQELVLDTGTRKSKILYEINHKAGMHSQKIGNAIRTIDTWYAENAPFPIAVEPYGAVTNLGTAFRQPKEKIDFYTLFDNWVLKDVAPELEQQHYVISVLIRGGVFGASGKE

SEQ ID NO: 9900 - protein, 334 aa, Yersinia pseudotuberculosis YPIII
MAKATIKTASVLAFERKLSNSDAMMYAGNWGQTDNWQPIIIKEKAVRGTISNRLKNALASDPVKLDAEIQKANLQRVDVAALPFDTDTLKMSFTLRVLGNLATPSVCNDQEYQAELASVINGYISEQSFSVLAARYAENLANGRFLWRNRVGAEDIKVCITSQTKSYQFDSNEFSLRQFSQPSKELTALAQEIEQGLAGNGFAFFTVDAFVRLGNGQEVFPSQELVLDSNSKKSKVLYQIDGIAALHSQKVGNALRTIDDWYPDATELALGPIAVEPYGSVTSRGKAYRQPKQKMDFYTLLDNWVTKGTVPAVEQQHYVMATLIRGGVFGEKGE

SEQ ID NO: 9901 - protein, 334 aa, Yersinia pseudotuberculosis PB1/+; identical to SEQ ID NO: 9900

SEQ ID NO: 9902 - protein, 318 aa, Pseudomonas aeruginosa
MSAGAWAQRDASQEWPAVTVREKSVRGTISNRLKTKDRDPAKLDASIQSPNLQTVDVANLPSDADTLKVRFTLRVLGGAGTPSACNDAAYRDKLLQTVATYVNEQGFAELARRYAHNLANARFLWRNRVGAEAVEVRINHIRQGEVARAWRFDALAIGLRDFKADAELDALAELIASGLSGSGHVLLEVVAFARIGDGQEVFPSQELILDKGDKKGQKSKTLYSVRDAAAIHSQKIGNALRTIDTWYPDEDGLGPIAVEPYGSVTSQGKAYRQPKQKLDFYTLLDNWVLRDEAPAVEQQHYVIANLIRGGVFGEAEEK

SEQ ID NO: 9903 - protein, 331 aa, Actinobacillus pleuropneumoniae serovar 7 str. AP76
MTKLTTASVLAFERKLDISDATFTQKNSTSSEPEIAVTIREKSVRGTISNRLKNALANDPAKLDAEIEKANLQRVDVATLNDDYDTLVARFTCKVLPFEGKPNVCNDPEYQAKLLSTIQNYLTAHGMSELAKRYATNLANARWLWRNRISAETIQVSIKVADDVIVFENAKQLPLNSFEQADEKLQKIASYIEKGLKGEEFIILEVEAQAKMGRGQEVYPSQELVLDTGTRKSKILYEINNKAGMHSQKIGNAIRTIDTWYAENAPFPIAVEPYGAVTNLGTAFRQPKEKIDFYTLFDNWVLKDVAPELEQQHYVISVLIRGGVFGASGKE

SEQ ID NO: 9904 - protein, 344 aa, Aliivibrio fischeri MJ11
MKLCNNLNYTRSLSPGKAVFYYESKDGQMNPIKCEQTHLRAPKAGFSEAFNSDYSTKNTAPQDLSFSNPQFIEECYVPVGIDEIKIRFSLRIEANSLQPDKCSDVQIREILQAFATKYKENGGYQELGERYAKNLLSGTWLWRNEHNLGTSISIKTTSNQEFNIDNAFKLSRKTSAKDKKTISKLGSEIASALSDPDHYYFADITATINVAFCQEIYPSQEFLDTKEKGKPSKVYAKTSLLTDEKTVALHAQKIGAAIQLIDDWWADDADIPLRVNEFGADHHNVIARRHPSHRNDFYTLIQNADNYCAQLDENSDITDDMHYVMAVLVKGGLFQKSASSKKGK

SEQ ID NO: 9905 - protein, 369 aa, Coxiella burnetii CbuG_Q212
MTNLVNLKLRRTTMAKKENIDIASVLSFEKKLIPSDGYMFGTSWDKKSEVTPLKLREKAVRGTISNRFNKNDSKTFLDDPMKLDADVERPNLQRVDACALDQNQDTLKLCFTLKVLGGITNPSACNNALFKKSYKAAAKIYIDTHGFTELATRYAENLANARFLWRNRFGAERIEVRVNASNKTVSQKWAFDATKFNLHTFDSSDTSVKELGALIANALSSEDDYLLLDVNCYVQVGSSQEVYPSEELVLDKSSSDKKGKKTKILYAVNDIAAMHSQKIGNAIRTIDTWYPDFTNQEQTAGPIAIEPYGAVTNLGRAYRTPKDKQDFYTFFDAWARGEQLARVEDEHYVIAVLVRGGVFGKSDKKESDK

SEQ ID NO: 9906 - protein, 342 aa, Coxiella burnetii CbuK_Q154
MTNLVNLKLRRTTMAKKENIDIASVLSFEKKLIPSDGYMFGTSWDKKSEVTPLKLREKAVRGTISNRFNKNDSKTFLDDPMKLDADVERPNLQPVDACALDQNQDTLKLCFTLKVLGGITNPSACNNALFKQSYKAAAKIYIDTHGFTELATRYAENLANARFLWRNRFGAERIEVRVNASNKTVSQKWAFDATKFNLHTFDSSDTSVKELGALIANALSSEDDYLLLDVNCYVQVGSSQEVYPSEELVLDKSSSDKKGKKTKILYAVNDIAAMHSQKIGNAIRTIDTWYPDFTNQEQTAGPIAIEPYGAVTNLGRAYRTPKDKQDFIPFLMRGREASSLQG

SEQ ID NO: 9907 - protein, 370 aa, Shewanella piezotolerans WP3
MELCNVLKYDRSLYPSKAVFFYKTAESNFVPLEAEINRIRGQKAGFTEAFTPQFKSKNLAPQDLAHCNPLILEECYVPPNVEHIYCRFSLRVQANSLKPAGCSEPTVFALLEEFAATFKACGGYKELATRYCKNVLLGTWLWRNQNTGNSQIEIKTSSGNCYQIANTRQLAWDSSWPADAQQVLEELSHEVHQALTDPAVFWHAKITAKIETAFCQEIYPSQSFGEKAAQGEASKQFAKVKCVDGRYAVSFNSVKIGAALQLIDDWWDVDGSKRLRIHEYGADKEIGVARRAPESKQSFYSLFVNAELYLAELKQQLAEGEYSISPNIYYLFAVLIKGGMFQKKAEAKSKSKAEPTTAKTTTSKATPVKA

SEQ ID NO: 9908 - protein, 275 aa, Acinetobacter baumannii AB0057
MKLNAEVEKANLQTVDACALGEHQDTLKVGFTLKVLGGIENPSACNNEIFLKSYQSVANNYIQQYGFTELAKRYALNIANARFLWRNRVGAEKVEVVVTINDQPAVTFNALEYPLHDFDHIDEKVQNLANQIAQALKGETPYLLIKVEAYALVGKAQEVYPSEELVLDKGKGDKSKILYQVKDVAAMHSQKIGNALRTIDTWYPEFDEKKAAIAIEPYGAVTNLGKAYRTPKDKKDFFSLFDKYALGESLENPEQEHYVMAVLVRGGVFGQSGKE

SEQ ID NO: 9909 - protein, 337 aa, Acinetobacter baumannii AB307-0294
MAKNEKAVASVLAFEKKLVPSDGYFYGTSWGNRKEQTALKLIQKSVRGTISNRLKPAVAGDPMKLNAEVEKANLQTVDACALGEHQDTLKVGFTLKVLGGIENPSACNNEIFLKSYQSVANNYIQQYGFTELAKRYALNIANARFLWRNRVGAEKVEVVVTINDQPAVTFNALEYPLHDFDHIDEKVQNLANQIAQALKGETPYLLIKVEAYALVGKAQEVYPSEELVLDKGKGDKSKILYQVKDVAAMHSQKIGNALRTIDTWYPEFDEKKAAIAIEPYGAVTNLGKAYRTPKDKKDFFSLFDKYALGESLENPEQEHYVMAVLVRGGVFGQSGKE

SEQ ID NO: 9910 - protein, 349 aa, Shewanella baltica OS223
MELCNVLKYDRSLYPSKAVFFYKTADSNFVPLEAEITRIRGQKAGFTEAFTPQFKSKNLAPQDLTHCNPLTIEECYVPPNVDHIYCRFSLRVQANSLKPSGCSDPEVSTLLEKLSAAFKKCDGYQELATRFCKNLLLGTWLWRNQNSGNTQIDVKTSTGKCYQISNTRQLAWNIWSDEAQTVLDELSKEMHLALTDPNVFWNADITAKIETVFCQEIYPSQTFGEKSAEGETSKQFTKVKCTDGRYAVSFNSVKIGAAIQSIDNWWDQDDVKRLRVHEYGADKELGIARRSPESALSFYTLFVNTELYLAELNQRAAEPGHSIHPNIYYLFAVLIKGGMFQKKAETKKA

SEQ ID NO: 9911 - protein, 290 aa, Laribacter hongkongensis HLHK9
MSKLENASVLAFERKLDPSDALFFAGNWADRKASEAWPHVEVRTKSVRGTISNRLKAKDQDPAKLDAAIENPNLQTVDVATLPHDADTLKVRFTLRVLAGVGEPFVCNKADYRAKLLATVAAYREAHGFGELAQRYAANLANGRYLWRNRIGAEQVEVHVEQLQDGKAVQDWTFDALALSLNELATGGKIAELGALIEDGLAGKAHVLLQITAFVRSGAGQEVFPSQELILDRGRGDKSKTLYFVAQKDRKIAAIHSQKIGNALRTIDTWYEDAATNGPIAIEPYGSVTT

SEQ ID NO: 9912 - protein, 339 aa, Tolumonas auensis DSM 9187
MAKNDIKTASVLAFERKLANSDALLYAGNWSELENKNAWQPIAIQSKDVRGTISNRLKNAVASDPAKLDAEIQKPNLQRVDVAALPFDADTLKVSFTLRVLGDLVTPSACNDQDYQAILSEKVGAYIHEQQFHELAARYAENLANGRFLWRNRVGAEAVTVKVNHLVDQKIKTSWSFDALAFNLRQFTKPQGDSAALAEVIRQGLLGDSFVLLQVDAFVRLGVGQEVFPSQELVLDGGRDSTKSKYLYQVGSVAAMHSQKIGNALRTIDTWYPDAECPIAVEPYGSVTSRGTAYRQPKAKMDFYTLLDGWMLKDQLPSVEQQHYVIATLIRGGVFGAAD

SEQ ID NO: 9913 - protein, 336 aa, Dickeya paradisiaca Ech703
MAKAATTLKTPTVLAFERKLANSDALMLAGNWQQENWQPVVIQEKSVRGTISNRQSGALVSDPGKFMKSIENPNIQPVDVAALPFEADTLKVVFTLRVLGNLALPSVCNNQDYQQALTELINGYAREPGFGVLAARYAENIASGRFLWRNRIGAEAVQVVVTHNDKRWVFNGEDYSLRQFSQPSGALAELAQAIEQALAGNDSAFFRVEAQVKLGNGQEVFPSQELVRSNESGRDRKSKVLYQVNGVAAMHSQKIGNALRTVDDWHPEAAETGPIAVEPYGSVTSRGRAYRQPKDKMDFYTLLDNWVIKGNVPEVAQQHYVIATLIRGGVFGEKGE

SEQ ID NO: 9914 - protein, 335 aa, Dickeya chrysanthemi Ech1591
MAKAATTLKTASVLAFERKLANSDALMLAGNWQQENWQPVVIQEKSVRGTISNRLKNAISSDPAKLDAEIQKPNLQTVDVAALPFDADTLKVAFTLRVLGNLALPSVCNDQDYQQALTDLINGYAREQGFGVLAARYAENIASGRFLWRNRIGAEAVQVVVTHDDKRWEFNGEDYSLRQFSQPSGALAELAHAIEQALAGSDSAFFRVEAQVKLGNGQEVFPSQELVLDERARNGKSKILYQVNGVAAMHSQKIGNALRTVDDWHPEAAETGPIAVEPYGSVTSRGRAYRQPKDKMDFYTLLDNWVIKGNVPDVAQQHYVIATLIRGGVFGEKGE

SEQ ID NO: 9915 - protein, 346 aa, Zymomonas mobilis subsp. mobilis NCIMB 11163; identical to SEQ ID NO: 9873

SEQ ID NO: 9916 - protein, 337 aa, Pectobacterium parmentieri WPP163
MAKATTALKTASVLAFERKLANSDALMYAGNWTQQDNWTAIAIQEKSVRGTISNRLKNALTSDTTKLDAEIQKANLQKVDVAALPFDADTLKVVFTLRVLGNLAQPSVCNDQDYQTALGNIITGYAQDQGFGTLAARYAENIANGRFLWRNRVGAEAIRVVVTRKGEKSWEFNGEDYSLRQFSQPTGDLAALAQAIEEGLAGDASALFTVEAYVQLGNGQEVFPSQELVLDEKARNGKSKILYQVNDVAAIHSQKIGNALRTIDDWYPAADEAGPIAVEPYGSVTSRGKAYRQPKEKMDFYTLLDNWVIKGDVPVPEQQHYVIATLIRGGVFGEKGE

SEQ ID NO: 9917 - protein, 334 aa, Yersinia pestis D106004; identical to SEQ ID NO: 55

SEQ ID NO: 9918 - protein, 334 aa, Yersinia pestis D182038; identical to SEQ ID NO: 55

SEQ ID NO: 9919 - protein, 335 aa, Dickeya zeae Ech586
MAKAATTLKTASVLAFERKLANSDALMLAGNWQQENWQPVVIQEKSVRGTISNRLKNAISSDPAKLDAEIQKPNLQTVDVAALPFDADTLKVAFTLRVLGNLALPSVCNDQDYQQALTDLINGYAREQGFGVLAARYAENIASGRFLWRNRIGAEAVQVVVTHDDKRWEFNGEDYSLRQFSQPSGALAELAHAIEQALAGSDSAFFRVEAQVKLGNGQEVFPSQELVLDERARNGKSKILYQVNGVAAMHSQKIGNALRTVDDWHPEAAETGPIAVEPYGSVTSRGRAYRQPKDKMDFYTLLDNWVIKGNVPEVAQQHYVIATLIRGGVFGEKGE

SEQ ID NO: 9920 - protein, 346 aa, Thioalkalivibrio sp. K90mix
MAKNAELHTASVLAFERKLDPSDALLFSGQWDHRDNPQQWAPVPVREKSVRGTISNRLKANKQDPAKLDAQIQNPNLQTVDVAALPADQDTLMCRFTLKVLGGTGKPSACNSAPYQEKLQTIVRGYVENHGFSTLARRYAQNIANARFLWRNRMAAEAVEIRVNRKEEGETNSSWTFDALQIPLRGFTAEGDAERALGELAEVIRQGLSGESFVLLEVTAFARMGAGQEVFPSQELILDRDQHKKSKTLYTVDGVAGIHSQKLGNALRTIDTWYPRAAEHDMGPIAVEPYGSVTTQGTAFRQPKEKADFYTLLDNWILKDQEPPEEQQHFVLATIVRGGVFGEKAD

SEQ ID NO: 9921 - protein, 352 aa, Nitrosococcus halophilus Nc 4
MASVQIPPLLNYTRSIIPSEGTFWVSNEANRPLLIQDKTVLGTIANYSSVYKKDKQRDEEAINKEMMAGANNIQRVDSCHLPADADTFEFRFTLKFLDNAKAPEACDDPAFREDLEDIAQAYAEKGGFTILAERYLANLLNGRFLWRNRYGTQRQITLRAPYNNLEATFEVTDHPEPALPQERMDKFKPWIDHIAGALSGEVPFFLIEVSAKVTIGLGQEVYPSQEFVDSGSRGQGKKSKTLFSVQVADQQVAAMHSQKIGNAIRTIDNWYPDASADRPLAVDPFTVDKRQARTVRLPDREKSDFYSLLKNLFDLKEGVERALDAKAIPGHAHYFMAVLIRGGVFSGEKKTK

SEQ ID NO: 9922 - protein, 334 aa, Yersinia pestis Z176003; identical to SEQ ID NO: 55

SEQ ID NO: 9923 - protein, 333 aa, Escherichia coli IHE3034; identical to SEQ ID NO: 9875

SEQ ID NO: 9924 - protein, 335 aa, Moraxella catarrhalis BBH18
MSKLTTATVLAFERNLDISDGFMAQKNSQNENSGIVPVRIQEKSIRGTISNRLKNTITNDPAKLDPKIEEANLQKVDSASLLEDNDTLIVSWTCKVLPFDGKPNVCNDPNYQAKLLQTVQGYLQEHGVKTLAHRYATNIANARWLWRNRIGSEKITVNVTCKLADQQQTLTFDAKSISIHNFDTQNPELMTLANWIEQGLTNQSFIILNITAEAVVGYGQEVYPSQELILDTGKTKSKVLYHINDKAGIHSQKIGNAIRTIDTWYPDAQFPIAVEPYGQVTTMGTAFRQPKQKQDFYSLFDGWILKDNKPSVENQHYVMAVLVRGGVFGASGKES

SEQ ID NO: 9925 - protein, 339 aa, Desulfurivibrio alkaliphilus AHT 2
MALKTASVLAFERKLANSDALMHAGNWTERENGSNWRPVTIIGKDVRGTISNRLKSSIQNDPAKLDAEIQKPNLQRVDVAALPFDADTLRVSFSLRVLGKIDQPSACNDSAYQEALATVIKSYADNHGLADLAHRYATNIANARFLWRNRVGAEQVEVRVRHIKDQQTMKEWIFSASQYELRDFANSGGELAEMAEVIRQGLAGESFSFLLIEAYALIGAGQEVFPSQELVLDSGGNSRKSKTLYQVDGVAALHSQKIGNALRTIDTWHPEADEIGPIAVEPYGSVTNRGKAYRQPKEKMDFYNLLDSWVIKNKVPPVEQQHYVIATLIRGGVFGEKSD

SEQ ID NO: 9926 - protein, 354 aa, Nitrosococcus watsonii C-113
MATVQLPSLLNYTRSIVPSEGTFWVANADNRPLLIQDKTVLGTIANYSSVYKKDKQRDEDAINKEMMAGDNNIQRVDSCHLPADVDTFELRFTLKFLANANGPEACEGAEFREDLESIAQAYADKGGFTVLAERYLANLLNGRFLWRNRYGAQRQITLRAPYNEEIKETTFEIIDRSEPTLPQGRMDKLKPWIEHITQALSGKIPYFLMEISARVTIGLGQEVYPSQEFVDKDSRGQGKKSKTLFSVQVADQQVAAMHSQKIGNAIRTIDNWYPNASADRPLAVDPFTVDKRRARTVRLPDHEKSDFYSFLKNLPALKDDIECAPDAKAIPGHAHYFMAVLIRGGVFSGEKKAK

SEQ ID NO: 9927 - protein, 39 aa, Acetohalobium arabaticum DSM 5501
MPGHDHDLCGCGCYIELILVVFLISCLCRGGVFGFFDAD

SEQ ID NO: 9928 - protein, 335 aa, Dickeya dadantii 3937
MAKVATTLKTASVLAFERKLANSDALMFAGNWQQEQWAPVTIQEKSVRGTISNRLKNAISSDPAKLDAEIQKANLQTVDVAALPFDADTLKVAFTLRVLGNLAQPSVCNDQDYQQALTEVINGYARDQGFGVLAARYAENIASGRFLWRNRIGAEAVQVVVTHDDKRWEFNGEDHSLRQFSQPNGALAELTHAIELALAGNDSAFFRVDAQVKLGNGQEVFPSQELVLDERARNGKSKILYQVNDVAAIHSQKIGNALRTVDDWHPEAAETGPIAVEPYGSVTSRGRAYRQPKDKMDFYTLLDNWVIKGSAPAVEQQHYVIATLIRGGVFGEKGE

SEQ ID NO: 9929 - protein, 333 aa, Escherichia coli UM146; identical to SEQ ID NO: 9875

SEQ ID NO: 9930 - protein, 333 aa, Escherichia coli O83:H1 str. NRG 857C
MAKAPVAIKTASVLAFERKLATSDAVMYAGNWQGNEWQPIEIQEKAVRGTISNRLKNAIVSDPTKLDAEIQKANLQRVDVASLPVDTDTLKVVFTLRVLGNLSTPSVCNDMAYQEALSGVIEGYISEHGFKELALRYALNLANGRFLWRNRIGAEQIQVKVTANETSWTFNSHDFSLRQFDQGQAAVTQLAAIIEQGLSAKEWVMLTVEAQVRLGAGQEVFPSQELVLDSNSSKSRVLYQVAGIAGIHSQKIGNALRTIDTWHPKVDELGAIAVEPYGSVTSRGVACRQPKEKLDFYTLLDNWVTKGMKPDVKQQHYVMAVLIRGGVFGEKSE

SEQ ID NO: 9931 - protein, 342 aa, Pseudoalteromonas sp. SM9913
MQLPRHLSYSRSLSPSKAVFFYKTPESDFEPLQIEQNKLVGQKSGFGDAYQKQNVAKNLAPQDLAFGNPQTIDVCYVPPTVKELFCRFSLRVEANSIEPHVCDDPKVIYWLKRFFETYKKHNGLNEVATRYAKNILMGNWLWRNRQSPNVDIEVLTEHAAPIVVEGIQKLKWQGNWQNNQTALITLSEAIQEGLSNPQSYCYLDITAKIKNAFSQEVHPSQKFVDTVEQGMSSKQLTYTQVGDKKAASLNSQKVGAAIQTIDDWYEGGYKPLRTHEYGADKQILVAHRTPKTHSDFYSLLPRIALHIKHMEKHGLEQSEQSNAVHFIAAVLIKGGLFQRSKG

SEQ ID NO: 9932 - protein, 327 aa, Shewanella baltica OS678; identical to SEQ ID NO: 9896

SEQ ID NO: 9933 - protein, 332 aa, Desulfurispirillum indicum S5
MAKLEASVLAFERKLANSDALMYAGNWDERDQSNSWEAIKIQEKAVRGTISNRLKTANEQDPTKLNQKIESPNPQIVDVAALPFEKDTLKLSFTLRILGDLSTPSACNNPDYQEALASKINQYIEEHGFGELASRYAENLANGRFLWRNRVGAEQVEVRIKHLDQEWVFDSHDFNLRQFSSNNSGLNPLTEVIKKGLTSESYVLLTVHAFVKLGQGQEVFPSQELILDKGKGDKSKVLYQVDGVAALHSQKVGNALRTIDTWYPDAGDLGPIAVEPYGSVTNRGKAYRQPTDKMDFYNLLDNWIGKDKTPDVKQQHYVIATLIRGGVFGKAD

SEQ ID NO: 9934 - protein, 334 aa, Yersinia pestis biovar Medievalis str. Harbin 35; identical to SEQ ID NO: 55

SEQ ID NO: 9935 - protein, 306 aa, Vibrio phage ICP1_2005_A
MTKLKAPAVLAYSRKINPTNALMFAVNWDDRNNTTPVMVGTKTIAGTQSVRGNPNDADKGNIQTVNFANLPHNKNTLLVKYNVKFVGDVFKAELGGGEYSNTLQTVLENTDFGTLAYRYVYNIAAGRTLWRNRVGAESIETVITVNNQTFTFSNLLVNEFDEDVDVAEIADLVAGVLSGEGFVTLKVEHYVLLGEGSEVFPSQEFVENSKLSKQLFDLNGQAAMHDQKVGNAIRTIDTWYEDATTPIAVEPYGSVVRNGVAYRAGNKTDLFTLMDGAVNGKSLTEEDQMFVTANLIRGGVFGGGKG

SEQ ID NO: 9936 - protein, 306 aa, Vibrio phage ICP1_2004_A
MTKLKAPAVLAYSRKINPTNALMFAVNWSDRDNTTAVMVGTKTVAGTQSVRGNPNDADKGNIQTVNFANLPHNKNTLLVKYNVKFVGDVFKAELGGGEYSNTLQTALENTDFGTLAYRYVYNIAAGRTLWRNRVGAESIETVITVNDQTFTFSDLLVNEFDEDVDVAEIADMVAGVLSGEGFVTLKVEHYMLLGEGSEVFPSQEFVENSKLSKQLFDLNGQAAMHDQKIGNAIRTIDTWYEDATTPIAVEPYGSVVRNGVAYRAGNKTDLFTLMDGAVNGKSLTEEDQMFVTANLIRGGVFGGGKD

SEQ ID NO: 9937 - protein, 345 aa, Marinomonas mediterranea MMB-1
MAKKDNNIASVLAFEKKLVPSDGYLYGTSWESRKDSSQVKPLNLQEKSVRGTISNRLKAAVKNDPAKLNAEVEKANLQRVDACSLGTDQDTLNLQFTLKVLGGIFKPSACNNALFKQSYETAAKAYIETHSFKELARRYAINLANGRFLWRNRVGAEQIEIIISARNGETNEEFTFNAFDFSTRHFDTTTADIDALAALIAKALASEDGFLLLDVNCFVQMGRAQEVYPSEELVLDKGKGEKSKILYHVGGVAAMHSQKLGNALRTIDTWYAEFQDSDLSVGPIAIEPYGAVTNLGKAFRTPKDKQDFYSFFDVWARGEQLSREEDEHYVMATLVRGGVFGESDK

SEQ ID NO: 9938 - protein, 344 aa, Sphaerochaeta coccoides DSM 17374
MAKNEKKVMPTVLAFEKKIVPSAGLFYGVNWENRTEEAMPLILNEKTVRGTISNLKKFQEDPLKLDAAVKNPNPQIVDGCALDFNHDTLKVHFTVKFLSGVGIPSACNNDDFRSELVSQVEKYIADTGFAELSHRYATNLANGRFLWRNRVGAEKIEVCIAAPASDKRWAFNAKSFSLKDDFTFRNGDLDELSSYIADTFLGKNEFLFLEVDAYVLVGKGQEVYPSEEFVLNKPKDKNQKSKILYQVDDVAALHSQKIGNALRTIDTWYPEYEENTFGPIAIEPYGVVTTLGKVFREPGKPKLDFFSLFDKFVFGESLVSQEAVDYVMAVLVRGGVFGKSGKDK

SEQ ID NO: 9939 - protein, 333 aa, Gallibacterium anatis UMN179
MSTITTATVLAFERRLDISDAVFSQKSSSTGQSTPVRITEKAVRGTISNRLKNAIANDPVKLDAEIQKANLQTVDIAALDHDKDTLIVSWSCKVLPFTGQPNVCNNPEYQKVLEETVQNYLNNTGLSELAYRYAYNIINARWLWRNRMNAEKINIKITFNNSDEMLEFKDVKPFSLNNFDYKDEKLTKLATYIEKGFKGEQFVLINIEAEVLMGKGQEVYPSQELILDNSSARKSKILYQINDIAGIHSQKIGNAIRTIDTWYEPNAAFPISVEPYGAVTTLGRAFRQPKQKLDFYTLFDDWILRGQAPTPEQQYFVIAVLIRGGIFGASGKE

SEQ ID NO: 9940 - protein, 342 aa, Delftia sp. Cs1-4
MSSTLKTASVLAFERKLDPSDAVFHAGNWDDRAASASWPSVKLREKSVRGTISNRLKTKDQDPAKLDAAIENPNLQTVDVAALPADADTLKVQFTLRVLSGAGTPSACNSAEYQARLAQTVQAYASAQGFAELANRYAANLANGRFLWRNRVGAESVQVQVVQLKDGKAGQAWAFDALAHNLRTLEQPDEKVAALGSVIAQGLEGKAHVLLQITAFVRLGAGQEVFPSQELILDKGSTKKSKTLYQIGEKGQEVAAIHSQKIGNALRTIDTWYDGAQDLGPIAVEPYGSVTTQGKAWRQPKQKQDFYTLLDDWLLKDKVPPVEQQHFVMAVLIRGGVFGDAS

SEQ ID NO: 9941 - protein, 338 aa, Methylomonas methanica MC09
MAVKNDATVLAFEKKLVPSDGYLYGTTWNDRSKVKPLTLTPKSVRGTISNRLKPALQNDPLKLNAEVEKPNLQTVDACALAEDQDTLKLSFTLKVLGGIDKPSASNGPEFNKSYHGVAQNYVAETGFTELAKRYAINIANGRYLWRNRVGAEKVEVVVSLNEGETLSFDAKQFSLRDFNADSPDLQKLAGKIAAALSGNLPYLLIRVEAYALVGSAQEVYPSEELVLDKGKGNKSKILYAVNGTAALHSQKIGNAIRTIDTWYPAFAEAGIGPIAIEPYGSVTNLGKAFRTPKDKADFYSLFDRFALGETLASKDQEHYVMAVLVRGGVFGQSGKEKE

SEQ ID NO: 9942 - protein, 347 aa, Zymomonas mobilis subsp. mobilis ATCC 10988
MSEEKNLKTASVLSFERKLDPSDALFFSGNWSDKDDDTAWQPIHLREKSVRGTISNRIPSKTGDDPIKLKAAIEKPNLQTVDVATLPFDSDTLKVEFTLRVLGGVGEPAACNSMEYRSKLVATISHYIDTHGLDILGNRYAANLANGRFLWRNRLGADAISIQITRLSGEESTLVGIFDALAHPLRQFEEKSVSEELEALAKLITAGLAGQEHVLLRVKAFIRMGAGQEVFPSQELLLDKGKSTKSRFLYSVGQDEKAIAAIHSQKIGNALRTIDTWYPDAEINGPIAVEPYGSVTTQGVAYRQPKAKKDFYNLLDAWVLKDKEPAIEDQHFVIAVLVRGGVFGDAS

SEQ ID NO: 9943 - protein, 345 aa, Xanthomonas campestris pv. raphani 756C
MATDLKTASVLAFERKLDPSDALLFSGQWAARAASADWRPVRLREKSVRGTISNRLKTKDQDPAKLDAAIENPNLQTVDVAALPLDADTLKVQFTLRVLGGTGTPSACNDTDYRNKLTTTVAAYVQQHGFDTLAQRYAANLANGRFLWRNRIGAEQVEVQVAHLKNGTPVAHWIFQAHDHSLRSLQAPAAEAADLAALSALIAAALAGSAHLLLQVTAFVRVGSGQEVFPSQELILDKGSSKKSKTLYAVGDGDNAVAAIHSQKIGNALRTIDTWYPDAEDNGPIAVEPYGSVTTQGKAYRQPKARLDFYNLLDGWVLKDKLPEPEQQHFVIATLIRGGVFGDAG

SEQ ID NO: 9944 - protein, 334 aa, Yersinia pestis A1122; identical to SEQ ID NO: 55

SEQ ID NO: 9945 - protein, 464 aa, Thermothielavioides terrestris NRRL 8126
MGPSKPAYAIYKPLANGDFLVRRTTDGAIFLGRPLVPDPTPTTPGRAKTAELIRRGAARPAANLLNHENLVSIHDELVTLSFRGPPPAPKSRSRPLSLPLFLSSPSTSADDPDPHPAAATATRMLLWDWNDAGTLQGVLDGYAAAGEEEVAATGGFLPESFVWHVALSLLRALQWLHEGIRETYDAVAVAPSGVSAAGGGDGGDRYDGRKRWWKRVRGTTAPEPDWMPVLHRDVTAANVFLQLPRGVETYGAVKLGNFARCWVSGSVSKSRETPVVAMESDDEVSLGELRESRARWMRDGLGLDKSHRPYTQGSELFALGALLYHMMCGRPLPPSEECPNCGCIHVTNNDAAEYSVCDHDCVEDVNTDEVFGPLASYTAGLKHLASLLLRLNRSEEWRASAVLDLAWVGFEHWAANTEDGRSYRDIFDDIWFRKQNLARLKKRHREAEKEEADLMEIDGDVLVV

SEQ ID NO: 9946 - protein, 342 aa, Pseudomonas aeruginosa M18; identical to SEQ ID NO: 9879

SEQ ID NO: 9947 - protein, 335 aa, Pasteurella multocida 36950
MSKLSTPSVLAFERNLDISDAIFAQKDSKNDKDAPVPLRIREKSVRGTISNRLKNTITNDPAKLDAETEKANLQRVDVATLDDDKDTLVATFSVKVLPFTGRPNVCNDQDYQHQVMTTVAQYLSEQGMDELAKRYATNIANARWLWRNRMGAEKIKIEVTCGENTLHFDDAKQFSLNHFDHQDDKIHQIAKEIKQGLLGEKFVILYVTAYANMGYGQEVYPSQELVLDNSTNNRKSKILYEINQKAGMHSQKVGNAIRTIDTWYAEEVAFPIAAEPYGAVTTLGTAFRQPKTKKNDFYTLFDNWLLKGEVPPVEQQHYVMSVLIRGGVFGASGKE

SEQ ID NO: 9948 - protein, 333 aa, Klebsiella michiganensis KCTC 1686
MAKAPVSIKTASVLAFERKLATSDAMMYAGNWLGDNWQPIEIQEKAVRGTISNRLKNAIASDSTKLDAEIQKANLQRVDTAALPADADTLKVLFTLRVLGNLATPSVCNDMAYQNAIQQTIEGYISEHGFAELARRYAANLANGRFLWRNRIGAEQVQVSVSAQEQTWVFNSHNYSLREFSQDDDAIASLAALLEQGLSGQTWVMLTVEAQVRLGAGQEVFPSQELVLDSNSSKSRVLYQVAGIAGIHSQKIGNALRTIDTWHPKVEELGAIAVEPYGSVTSRGMACRQPKDKMDFYTLLDNWVTKGVKPDVEQQHYVMAVLIRGGVFGEKSE

SEQ ID NO: 9949 - protein, 351 aa, Vibrio sp. EJY3
MELCRQLNYLRSISPGKAYFYYLASNGDRCPLAIDKTHIRAPKGGYAEAYQGSSFVKKNVAPQDLSYSNPQFIEECYVPPLTNEIICEFSLRIRANSLHPDVCSDEKVREQLMSLAKVYKELNGYQELAYRYAKNILLGSWLWRNKDCRGVTIQVMTSDGESIEVYDATKLSWYGHWDEQSTQSLEQLTSYLSRALSDRSQCFYMDVKAVMSVGRGDEVYPSQEFIDVKQEGIPTRQLAKVPLNYEQETAAFHAQKIGAALQSIDDWWHENADKPLRVNEYGADREYVIARRHSLLGNDFYQLIRRTEKWIEEMDKSKSIPNDVHFILSVLIKGGLFNCSKTKSKSKSKSK

SEQ ID NO: 9950 - protein, 339 aa, Rahnella aquatilis CIP 78.65 = ATCC 33071
MTKTTVKTASVLAFERKLANSDAQMFAGNWQDDKDARKWQPIEIQEKAVRGTISNRMKNAASTDPTKLDAEIQKPNLQRVDVAALPFDADTLKLRFTLRVLGNLSSPSVCNDQDYQAALKAVIDGYRTEHGFGTLAARYAENLANGRFLWRNRIGAEGIVVHVSHSTQRWEFEADGFNLRRFSQPSGDLAELATVIEKGLSGEGSVLLTVEAFVRLGAGQEVFPSQELVLDSSRDSKKSKILYQAGGIAALHSQKIGNALRTIDDWYPDAVTEELGPIAVEPYGSVTSKGKAYRQPKQKMDFYTLLDNWVTKDKKPDTEQQHYVIATLIRGGVFGEKGE

SEQ ID NO: 9951 - protein, 336 aa, Pasteurella multocida subsp. multocida str. HN06
MSKKLATPSVLAFERNLDISDAIFAQKDSKNDKDAPVPLRIREKSVRGTISNRLKNPITNDPAKLDAETEKANLQRVDVATLDDDKDTLVATFSVKVLPFTGRPNVCNDQDYQHQVMTTVAQYLSEQGMDELAKRYATNIANARWLWRNRMGAEKIKIEVTCGENTIHFDDAKQFSLNHFDHQDDKIHQIAKEIKQGLLGEKFVILYVTAYANMGYGQEVYPSQELVLDNSTNNRKSKILYEINQKAGMHSQKVSNAIRTIDTWYAEEVAFPIAAEPYGAVTTLGTAFRQPKTKKNDFYTLFDNWLLKGEVPPVEQQHYVMSVLIRGGVFGASGKE

SEQ ID NO: 9952 - protein, 343 aa, Spirochaeta africana DSM 8902
MAKSKETMASVLAYEKKIVPSDARMYGTIWEARHSERKPLNIIEKSIRGTISNRLSTALKNDPSKIDAEVEKANLQKVDSCGLAMEQDTLCIEFTLKVLSGVENPSACNNVQFLETYQIAAQDYIARENFTELGKRYAVNIANGRFLWRNRFGADSVEIRVEQLGSDEHEEPMIFNAFSYSVKSFDTDDTDVQKLGNEIAKVLSGKVSHKLFRISAYAKVGLGQEVYPSEELVLDKGKGNKGKVLFDINGVAGMHSQKIGNAIRTIDTWYPEYADSTVGPIAVEPYGAVTTLGKAFRTPKNKSDFYTLFDNFSRGGKLASIEEEHYVMAVLVRGGVFGESSKE

SEQ ID NO: 9953 - protein, 341 aa, Providencia stuartii MRSN 2154
MAKNNDVASVLAFEKKLVPSDGYFYGTSWDHKSQCTPLVLQEKSVRGTISNRLKGPVKNDPLKLNAEVEKANLQTVDACALGTQQDTLKHQFTLKILGGVETPSACNNASFKESYTKAAKEYIAREGFRELGRRYAHNIANARFLWRNRVGAEKIEVEVKVLNKGQEQQWTFDATQYSIRSFEKQDDKVNELGAKIAAALANSEGALLLEITTYAQLGQSQEVYPSEELVLDKGKGDKSKILYHVNGHAAMHSQKIGNALRSIDTWYPDYNDEVNSAGAIAIEPYGAVTNLGRAYRTPSDKQDFYTHFDKWARGEKLARLEDEHYVMAVLVRGGVFGESDK

SEQ ID NO: 9954 - protein, 336 aa, Pasteurella multocida subsp. multocida str. 3480; identical to SEQ ID NO: 9951

SEQ ID NO: 9955 - protein, 336 aa, Aggregatibacter actinomycetemcomitans D7S-1
MRKLTTPTVLAFERNLDISDAVFTQFNSQDKNPVEEEVKIREKSVRGTISNRLKNTITNDPTKLDAEIQKPNLQRVDVATLNDKNDILVARFTCKVLPFDGKPCVCNDQDYQSKIIGVVESYIKTQGFSELAKRYATNIANARWLWRNRMSAETIKIEVSFNGETLTFDNAKALSLNTFDDSSTQLQVLTGHIEDGLSGKHFVILNITAYVKMGYGQEVYPSQELVLDAGANNRKSKVLYKLDDSGKAAMHSQKVSNAIRTIDTWYKSNAEFPIATEPYGAVTTLGTAFRQPKEKLDFYTLFDNWLLNDKVPDVEQQHYVMSVLIRGGVFGASGKE

SEQ ID NO: 9956 - protein, 337 aa, Pectobacterium parmentieri
MAKATTALKTASVLAFERKLANSDALMYAGNWTQQDNWTAIAIQEKSVRGTISNRLKNALTSDTTKLDAEIQKANLQKVDVAALPFDADTLKVVFTLRVLGNLAQPSVCNDQDYQTALGNIITGYAQDQGFGTLAARYAENIANGRFLWRNRVGAEAIRVVVTRKGEKSWEFNGEDYSLRQFNQPTGDLAALAQAIEEGLAGDASALFTVEAYVQLGNGQEVFPSQELVLDEKARNGKSKILYQVNDVAAIHSQKIGNALRTIDDWYPAADEAGPIAVEPYGSVTSRGKAYRQPKEKMDFYTLLDNWVIKGDVPVPEQQHYVIATLIRGGVFGEKGE

SEQ ID NO: 9957 - protein, 341 aa, Methylophaga frappieri
MAKKENTASVLAFEKKLVPSDGYMYGCQWDNKSEAAPLSLNEKSVRGTISNRLKPALQKDPAALNNEVEKPNLQTVDACSLGTEQDTLKLHFTLKVLGGLKQPSACNNAAFKEGYQQAVSSYLETQGMRELAKRYALNIANARFLWRNRFGAEAILVQVKALNKGAEQSWEFDALELNPRDMEVTTADVESLADRIASALSSDNDFLMLDITCYAKVGKAQDVYPSEELVLDKGKGNKSKILYSVDGMAAMHSQKLGNAMRTIDTWYPEHDDAVASAGPIAIEPYGAVTNLGKAFRTPADKQDFYTFFDSWARGGELARVEDEHYVMGVLVRGGVFGESDK

SEQ ID NO: 9958 - protein, 342 aa, Pseudomonas aeruginosa DK2
MSKPILSTASVLAFERKLDPSDALMSAGAWAQRDASQEWPAVTVREKSVRGTISNRLKTKDRDPAKLDASIQSPNLQTVDVANLPSDADTLKVRFTLRVLGGAGTPSACNDAAYRDKLLQTVATYVNEQGFAELARRYAHNLANARFLWRNRVGAEAVEVRINHIRQGEVARTWRFDALAIGLRDFKADAELDALAELIASGLSGSGHVLLEVVAFARIGDGQEVFPSQELILDKGDKKGQKSKTLYSVRDAAAIHSQKIGNALRTIDTWYPDEDGLGPIAVEPYGSVTSQGKAYRQPKQKLDFYTLLDNWVLRDEAPAVEQQHYVIANLIRGGVFGEAEEK

SEQ ID NO: 9959 - protein, 346 aa, Zymomonas mobilis subsp. mobilis ATCC 29191
MSEEKKLKTASVLSFERKLDPSDALFFSGNWSDKDDDTAWQPIHLREKSVRGTISNRLKKGEGDPAKLNAAIEKPNLQTVDVATLPFDSDTLKVEFTLRVLGGAGEPAACNSMEYHSKLVATISHYIDTHGLDILGNRYAANLANGRFLWRNRLGADAISIQITRLSGEESTLVGVFDALAHPLRQFEEKSASEELEALAKLITAGLAGQEHVLLRVKAFIRMGAGQEVFPSQELLLDKGKSTKSRFLYSVGQDGKAIAAIHSQKIGNALRTIDTWYPGAEINGPIAVEPYGSVTTQGVAYRQPKAKKDFYSLLDAWVLKDKEPAIEDQHFVIAVLVRGGVFGDAS

SEQ ID NO: 9960 - protein, 336 aa, Pectobacterium carotovorum subsp. carotovorum PCC21
MAKASTSLKTASVLAFERKLANSDAVMYAGNWAQQDNWTPIAIQEKSVRGTISNRLKNALTSDPAKLDAEIQKANLQTVDVAALPFGADTLKVVFTLRVLGNLAQPSVCNDQDYQTALGNIITGYAQDQGFGTLAARYAENIANGRFLWRNRVGAEAIRVVVTTGEQRWEFNGEDYSLRAFSQPTGDLAALAQAIEQGLAGDTSVLFTVEAYVQLGNGQEVFPSQELVLDEKARNGKSKILYQVNDVAAIHSQKIGNALRTVDDWYPAADEAGPIAVEPYGSVTSRGKAYRQPKEKMDFYTLLDNWVIKGDVPAPEQQHYVIATLIRGGVFGEKGE

SEQ ID NO: 9961 - protein, 345 aa, Alcanivorax dieselolei B5
MAKNDKLKTASVLAFERKLDPSDALFFAGQWSRRDQAGEWPAVTIREKSVRGTISNRLKAKDQDPAKLDARIESPNPQTVDVAALPSEADTLMARFTLRVLSGAGKPSACNDADYQAKLDQAVRGYVATHGFAELASRYAYNLANGRFLWRNRVGAEQVEVQVRLMEQGEPAEIWTFDALSLSLRGFEPTEEAKTSLHALAGCITDGLSGGRHVLLEVVAFARLGAGQEVFPSQELILDRGRGDKSKTLYRVGETAGMHSQKLGNAIRTIDTWYPKDEDENLGPIAVEPYGSVTTQGKAYRQPKQKADFYSLLDSWMLKDQAPTVEQQHFVMAILIRGGVFGDAG

SEQ ID NO: 9962 - protein, 346 aa, Thioalkalivibrio nitratireducens DSM 14787
MAKNTELHTASVLAFERKLDPSDALLYSGQWSDRGNPDQWIAIPVREKSVRGTISNRLKANKQDPAKLDAAIQNPNLQTVDVAMLPNDRDTLMARFTLKVLGGAGKPSACNSAPYQAKLESVVSGYVDRHGFSALARRYAQNIANARFLWRNRMGAEAVEVRVERKENGATTQTWAFNALEIPVREFTAQGDAETDLQELAEVIRQGLAGESFVLLEVTAFARMGAGQEVFPSQELILDRGQGNKSKTLYTVDQIAGIHSQKLGNAIRTIDTWYPDATERGTGPIAVEPYGSVTTQGTAFRQPKEKADFYSLLDNWILKDQEPAEEQQHFVLATIVRGGVFGEKAD

SEQ ID NO: 9963 - protein, 347 aa, Vibrio parahaemolyticus BB22OP
MKLPNGLSYMKSIEASDVIFLVNWPDGRKTPLPYTSRVALGMKEGSKSAYKDDGQIDADVTAYSLAQGNPHEIDFCCVPYGAESIECEFSVSFASSLRKPFKCSDPEVKRTLVQLIKLYEEKVGWEELANRFLENICNGRWLWRNNECTYSTSIGIKPWPWEDEKAISPFHDIRKNYAGTNHFRDHKDWDNLIKLITDAFSQPNGLCIFEVSATFRLGTNAPIYPSQVFKDSVKGEKNRIYQSTDVDGESSPILGCYKTGAAIATIDDWYPDADKPIRISHYGAHREDVYCYRHPNTGKDLFTLLEKADQYLEQLQATDVLPDEMINDLHFIVANLIKGGLLQQKGT

SEQ ID NO: 9964 - protein, 333 aa, Serratia sp. FGI94
MAKATIKTASVLAFERKLANSDAMMYAGQWQQDEWQPVKIQEKAVRGTISNRLKNALTSDPAKLDAEIQKANLQRVDVAALPFNTDTLKVSFTLRVMGNLATPSVCNDQDYQAALAQSINGYIAEHGCAALAARYAENLANGRFLWRNRVGAEAIKICVSSNDKRWEFNGEDYSLRAFSQPEGALTELAQAIERGLSGDSFAFFRVDAYVRLGQGQEVFPSQELVLDSNSKKSKILYQVNEVAALHSQKVGNALRTIDTWYPDAVELDLGPIAVEPYGSVTSRGKAYRQPKQKMDFYTLLDNWVTKGQVPEVEQQHYVMAILVRGGVFGEKGE

SEQ ID NO: 9965 - protein, 306 aa, Vibrio phage ICP1_2006_E; identical to SEQ ID NO: 9935

SEQ ID NO: 9966 - protein, 306 aa, Vibrio phage ICP1_2011_A; identical to SEQ ID NO: 9936

SEQ ID NO: 9967 - protein, 260 aa, Morganella morganii subsp. morganii KT
MLEAEQNVIIFSFSLKITGGLKYPAACNNEIFRQRYQAVITDYLEREHCREPARRYAHNIACGRFLWRNLVGAEHIEVVVDNLSAEKKQQWVFDARKYSLRHFEQTDNIAGDLGRHIAAALSCDDGALLLAVSARVITGKGQEIYPSCEFVMNKRKGGSSRILCHIDGTAGMHSQKIGNALRSVDTWYPAFSDLTAGAGVIAADPYGAVTHLGAVFRPPGSGQDFYTLFEKWVSGKKLAEHEENYVVAVLIRGGVFGGGG

SEQ ID NO: 9968 - protein, 320 aa, Psychrobacter sp. G
MSKITLPTMLAFERKIENSDALMFSGNWDNKENTGKWQPIAIIPRLNRSTQSAQGIADAKKIMPNPVAASNDDANLPLEHDTLKLSFTLRIIGNLGLPFACNSPDFETAITAKVNTFKDTDIMGELAKRYAYNIANGRFLWRNRVGAEDITVIVKINNEETLTFNAYDYSLNSFDQADDKVKKLANAIKRGLSNDTFVLLTVNAFVKLGNGQHVFPSQEMNMGEKRKALFKIKDQAAMHNVKIGNALRTVDDWYSDDAQFPIAAEPYGSVTQRGQAYRKSKNDLYTLMVEWINDHELSPEQQAYVVSNLIRGGVFSKGGD

SEQ ID NO: 9969 - protein, 347 aa, Vibrio parahaemolyticus O1:Kuk str. FDA_R31
MKLPNNLSYIKSIEPSDVIFLVNWPDGRKTPLPYTSRVALGMKEGSKSAYKDDGQIDMDATAHSLAHGNAHEIDFCCVPYGAESIECEFSVSFASSLRKPFKCSDPEVKRTLVQLIKLYEEKVGWEELANRFLENICNGRWLWRNNECTYSTSIGIKPWPWEDEKAISPFHDIRKNYAGTNHFRDHKDWDKLIKLITDAFSQPNGLCIFEVSATFRLGTNAPIYPSQVFKDSVKGEKNRIYQSTNVDGESSPILGCYKTGAAIATIDDWYPDADKPIRISHYGAHKEDVYCYRHPNTGKDLFTLLEKADQYLEQLQATEVLPDEMINDLHFIVANLIKGGLLQRKGT

SEQ ID NO: 9970 - protein, 352 aa, Vibrio campbellii ATCC BAA-1116; identical to SEQ ID NO: 9894

SEQ ID NO: 9971 - protein, 345 aa, Desulfovibrio gigas DSM 1382 = ATCC 19364
MSTALKTASVLAFERKLEPSDAILFSGNWETRNTEKAWGAIAIREKSVRGTISNRLHLKDKDKEKDAAKLDAAIENPNLQTVDVATLAAGQDTLKVSFTVRVLPGTGQPSACNEPAYRAKLLATVEAYAREHTFAELGRRYAFNLANGRFLWRNRMGAEQVEVCIQRLENGQPSVTWTVDALQFPLRSFDAPAAGNAAVDELGALIAQGLRGETHVLLQVTAFARLGMGQEVFPSQELILDRGRGDKSKTLYDVSGVAGIHSQKVGNAIRSIDTWYPGADELGPIAVEPYGSVTTQGKAYRQPKDKVDFYTLLDNWMLKDKVPALEQQHFVMAVLIRGGVFGDKE

SEQ ID NO: 9972 - protein, 345 aa, Candidatus Symbiobacter mobilis CR
MATTNPLKTASVLAFDRKLDPSDALFAAGTWAHRANSAAWPPVAVRAKSVRGTISNRLKTKDQDPAKLDAAIENPNLQTVDVATLPAEADTLQVSFTLRVLGGTGTPSACNNADYQRVLVDTVNGYVATHGFAELARRYAANLANGRFLWRNRLGAEQIEVQVARLVDGRAANTWTFDALAHSLRGFDAPETMHPDLGAVSTLLAQGLAGKSHVLLQVTAFVRMGSGQEVYPSQELILDKDKANKSKTLYTVNGIAGMHSQKLGNAIRTIDTWYTGAADNGPIAVEPYGSVTTQGKAYRQPKQKEDFYTLLDNWVTKGQAPALEQQHFVVATLIRGGVFGDTDKG

SEQ ID NO: 9973 - protein, 346 aa, Zymomonas mobilis subsp. mobilis str. CP4 = NRRL B-14023
MSEEKNLKTASVLSFERKLDPSDALFFSGNWSNKSDDKAWQPIHLREKSVRGTISNRLKKGEADPAKLNAAIEKPNLQTVDVATLPFDSDTLKVEFTLRVLGGVGEPAACNSMEYRSKLVATISHYIDTHGLDILGNRYAANLANGRFLWRNRLGADAISIQITRLSGDESTLVGVFDALAHPLRQFEEKSVSEELEALAKLITAGLAGQEHVLLRVKAFIRMGEGQEVFPSQELLLDKGKSTKSRFLYSVGQDEKAIAAIHSQKIGNALRTIDTWYPDAEINGPIAVEPYGSVTTQGVAYRQPKAKKDFYSLLDAWVLKDKEPAIEDQHFVIAVLVRGGVFGDAS

SEQ ID NO: 9974 - protein, 342 aa, Pseudomonas aeruginosa SCV20265
MSKPILSTASVLAFERKLDPSDALMSAGAWAQRDASQEWPAVTLREKSVRGTISNRLKTKDRDPAKLDASIQSPNLQTVDVANLPSDADTLKVRFTLRVLGGAGTPSACNDAAYRDKLLQTVATYVNEQGFAELARRYAHNLANARFLWRNRVGAEAVEVRINHIRQGEVARAWRFDALAIGLRDFKADAELDALAELIASGLSGSGHVLLEVVAFARIGDGQEVFPSQELILDKGDKKGQKSKTLYSVRDAAAIHSQKIGNALRTIDTWYPDEDGLGPIAVEPYGSVTSQGKAYRQPKQKLDFYTLLDNWVLRDEAPAVEQQHYVIANLIRGGVFGEAEEK

SEQ ID NO: 9975 - protein, 335 aa, Pasteurella multocida subsp. multocida str. HB03; identical to SEQ ID NO: 9947

SEQ ID NO: 9976 - protein, 346 aa, Thioalkalivibrio paradoxus ARh 1
MAKNTELHTASVLAFERKLDPSDGLLYSGQWSDRDNPDQWIAIPVREKSVRGTISNRLKANKQDPAKLDAAIQNPNLQTVDVAMLPNDRDTLMARFTLKVLGGTGKPSACNSAPYQAKLESVVSGYVDRHGFTTLARRYAQNIANARFLWRNRMGAEAVEVRVERKENGATTQTWAFNALDIPLREFTAQGDAETDLQGLAEVIRQGLAGESFVLLEVTAFARMGAGQEVFPSQELILDRGQGNKSKTLYTVDQIAGIHSQKLGNAIRTIDTWYPAATERGTGPIAVEPYGSVTTQGTAFRQPKEKADFYSLLDNWILKDQEPAEEQQHFVLATIVRGGVFGEKAD

SEQ ID NO: 9977 - protein, 342 aa, Thiomicrospira aerophila AL3
MSKKLTASVLAFEKKLVPSDAFMYGTNWDNKDVEKTPLALQEKSVRGTISNRLKKALQSDPAKLDAEVEKANLQRVDSCALAPDQDTLGLSFTLKVLSGVEQPSACNSEEFLSSYQQAAKNYIETFAFTELAKRYATNLANGRFLWRNRVGAEQIEVQVKLLNKDSNESWTFNALNLSTRDFDHGDPQVAELADKIAQALSGQTDFILLQINAFAQVGQAQDVYPSEELVLDKSNAKGQKSKILYAVNGQAAMHSQKIGNAIRAIDTWYPGFEEVNTGAIAIEPYGAVTNLGKAYRTPKAKADFYTLFDRFANGEELDREEDQHYVMAVLVRGGVFGESGKE

SEQ ID NO: 9978 - protein, 345 aa, Vibrio parahaemolyticus UCM-V493
MELCSQLNYVRSLSAGKACFYYLTPSGDMCPLSIDKTRLRAPKGGYSEAYRGSQFHQKNVAPQDLAYANPQFIEECYVPPSTDEIVCEFSLRVKANSLHPEVCNDDSVREQLALLAATYKNLNGYQELAYRYAKNILLGTWLWRNRECRGVAIEVTTSDGEIILISDATRLSWYGHWDEKSTESLERLTSYLSRALSDNAQYFYMDVKAVLAVGRGDEVYPSQEFLDDKQEGVPTKQLAKVRLDDGRETAAFHAQKIGAALQSIDDWWHEEADKPLRVNEYGADREYVIARRHTQSGNDFYQLIRRTEAWTEEMEKLKSIPNDVHFIMSVLIKGGLFNSSKSTAK

SEQ ID NO: 9979 - protein, 347 aa, Vibrio parahaemolyticus RIMD 2210633
MKLPNGLSYMKSIEASDVIFLVNWPDGRKTPLPYTSRVALGMKEGSKSAYKYDGQIDADVTAYSLAQGNPHEIDFCCVPYGAESIECEFSVSFASSLRKPFKCSDPEVKRTLVQLIKLYEEKVGWEELANRFLENICNGRWLWRNNECTYSTSIGIKPWPWEDEKAISPFHDIRKNYAGTNHFRDHKDWDNLIKLITDAFSQPNGLCIFEVSATFRLGTNAPIYPSQVFKDSVKGEKNRIYQSTDVDGESSPILGCYKTGAAIATIDDWYPDADKPIRISHYGAHREDVYCYRHPNTGKDLFTLLEKADQYLEQLQATDVLPDEMINDLHFIVANLIKGGLLQQKGT

SEQ ID NO: 9980 - protein, 347 aa, Vibrio parahaemolyticus
MKLPNNLSYIKSIEPSDVIFLVNWPDGRKTPLPYTSRVALGMKEGSKSAYKDDGQINVDATAHSLAHGNAHEIDFCCVPYGAESIECEFSVSFASSLRKPFKCSDPEVKRTLVQLIKLYEEKVGWEELANRFLENICNGRWLWRNNECTYSTSIGIKPWPWEDEKAISPFHDIRKNYAGTNHFRDHKDWDNLIKLITDAFSQPNGLCIFEVSATFRLGTNAPIYPSQVFKDSVKGEKSRIYQSTDVDGESSPILGCYKTGAAIATIDDWYPDADKPIRISHYGAHKEDVYCYRHPNTGKDLFTLLEKADQYLEQLQATQVLPDEMINDLHFIVANLIKGGLLQRKGT

SEQ ID NO: 9981 - protein, 341 aa, Desulfovibrio magneticus RS-1
MATLKTASVLAFERKMDPSDGLFFAGNWNDRSQCNRWKPVEVREKSVRGTISNRLKAGEQDPAKLDAQIEKPNLQTVDVATLSPATDTLMVRFTLRVLGGVGVPSACNNADYHQKLQSTVAGYVKSNGLGILARRYACNLANGRFLWRNRIGAEAVEVVVCHLVNGETQSTWTFDSLALSLRSFASDTPVGDGLDTLAAVIESGLSGTGHVLLEVTAFTRMGAGQEVFPSQELILDRGRGDKSRTLYTVNAVAGMHSQKIGNAIRTIDDWHPEAEIIGPIAVEPYGSVTTMGKACRQPQQKQDFYNLLDAWVIKDKVPTLEDQHYVMAVLIRGGVFGEKDA

SEQ ID NO: 9982 - protein, 336 aa, Selenomonas ruminantium subsp. lactilytica TAM6421
MAKKAADIASVLAFEKKLVVSDGYMYGTCWDDEHKVKAEPLKLVEKSVRGTISNRLKPAVQNDPAKLNAEVEKPNLQQVDSCALGMEQDTLKLAFTIKVLSGVEKPSACNNAAFAQSYAAAAKGYIEKTGFKELSYRYAYNIASARFLWRNRLGAEKIDVCVKVGSWEQKFDAYTYSLRDFTEHEEIKALAGKIAAALSGEEPYQFIEVEAYTKLGVGQEVYPSEELVFDKGNSRKSKILYHVEGVAAMHSQKLGNALRTIDTWYPEFESPEGAGPIAVEPYGAVTNLGKAFRNPKEKVDFYTLFDKFALGEPLANAEEEHYVMAVLVRGGVFGKG

SEQ ID NO: 9983 - protein, 337 aa, Photorhabdus laumondii subsp. laumondii TTO1
MSKSTIKTASVLAFERKLSNSDALMFAGNWKQIDGEWKPIAIQEKAVRGTISNRLKNALTSDPAKLDAEIQKANLQRVDVAALPFDADTLKVSFTLRVLGNLSTPSVCNDQDYQAELANVINGYIAEHGFKTLAARYAENLANGRFLWRNRVGAEEIKVRVSGKSGKWWEFDCEDFSLREFGKVEGKLAELAAEIEEGLAGDRSTLFNVEAFVRLGHGQEIFPSQELVLDSNSKKSKVLYQVNEIAALHSQKVGNALRTIDTWYPDATELGLGPIAVEPYGSVTSRGKAYRQPKAKMDFYTLLDNWVVKGKAPEEVEQQHYVIATLIRGGVFGEKGE

SEQ ID NO: 9984 - protein, 353 aa, Acinetobacter baylyi ADP1
MTIFKKLPGSLSLQRGTVVSDGAFFNLFEDGKQEPLHVMYHGIRGTQNVAGNKEKGAATGNSLAREVTNIQLTESAKLQPNAKLLVKWDFRFIDLSYVLFASASKAGADKTEEYNFRQAFLNFVNRAKESDGLKEVVRRYVRNIVNGRWLWRNRIVAESITIQVTAQDYPETFSFDALSYNLKSFAEPSEQEQKLAGILLKGITGESTNAALHIEAIVDFGMGGVEVFPSQNYLEDKPKGFSRSLYQLTPKKPDHKANDNQYLGQAALRDQKIGNALRTIDTWYPSFKENDEKPIAIEPNGANLEGQIFYRVGKDKVSAFDILKEIDELDPSSEKGMFLISCLIRGGVYSEGE

SEQ ID NO: 9985 - protein, 337 aa, Pectobacterium atrosepticum SCRI1043
MAKAATTLKTASVLAFERKLANSDALMYAGNWAQQDNWTAIAIQEKSVRGTISNRLKNALTSDPAKLDAEIQKANLQKVDVAALPFGADTLKIVFTLRVLGNLAQPSVCNDQDYQTALGDIITGYAQEQGFSTLAARYAENIANGRFLWRNRVGAEAIRVVVTKKGERSWEFNGEDYSLRQFSQPAGDLAALTQAIEKGLAGDASALFTVEAYVQLGNGQEVFPSQELVLDEKARNGKSKILYQVNDVAAIHSQKIGNALRTIDDWYPAADEAGPIAVEPYGSVTSRGKAYRQPREKMDFYTLLDNWVIKGDVPMPEQQHYVIATLIRGGVFGEKGE

SEQ ID NO: 9986 - protein, 341 aa, Legionella pneumophila str. Lens
MTKKEHIASVLAFEKKLVPSDGYMYGCKWEHKDKATPLRLNEKSVRGTISNRLKPALQRDPAALNNEVEKPNLQTVDTCSLGSEEDTLKLYFTLKVLGGLKHPSACNNAAFKQSYQLAVSNYLETKGMRELAKRYALNIANARFLWRNRFGAENIQVEVRALNEGAEKSWNFNALDFNPRDLETTTNEVDSLADRIADALASDNDFLMLQITCYARIGKAQDVYPSEELVLDKGKGKKSKILYAVDGIAAMHSQKIGNALRTIDTWYPEFSDPVSSAGPIAIEPYGAVTNLGKAFRTPADKQDFYTFFDTWARGGELSRVEDEHYMMAVLVRGGVFGESDK

SEQ ID NO: 9987 - protein, 341 aa, Legionella pneumophila str. Lens
MTKKEHIASVLAFEKKLVPSDGYMYGCKWEHKDKATPLRLNEKSVRGTISNRLKPALQKDPAALNNEVEKPNLQTVDTCSLGSEEDTLKLYFTLKVLGGLKHPSACNNAAFKQSYQQAVSNYLETKGMRELAKRYALNIANARFLWRNRFGAENIQVEVMALNEGAEKSWNFNALDFNPRDLETTTNEVDSLADRIADALASENDFLMLQITCYARIGKAQDVYPSEELVLDKGKGKKSKILYAVDGIAAMHSQKIGNALRTIDTWYPEFSDPVSSAGPIAIEPYGAVTNLGKAFRIPADKQDFYTFFDTWARGGELSRVEDEHYMMAVLVRGGVFGESDK

SEQ ID NO: 9988 - protein, 334 aa, Yersinia pseudotuberculosis IP 32953; identical to SEQ ID NO: 9900

SEQ ID NO: 9989 - protein, 334 aa, Yersinia pestis CO92; identical to SEQ ID NO: 55

SEQ ID NO: 9990 - protein, 337 aa, Acinetobacter baumannii AYE; identical to SEQ ID NO: 9909

SEQ ID NO: 9991 - protein, 334 aa, Erwinia tasmaniensis Et1/99
MAKSAIKTASVLAFERKLSNSDAIMLAGKWQDKQNWTPIKIQEKAVRGTISNRLKNAIASDPQKLDAEIQKPNLQRVDVAALPYNCDSLKVCFTLRVLGGLATPAVCNDRAYQAALAAVIDGYIARHGFSTLAARYAENIANGRFLWRNRLGAGRVAVQVTSGEKRWQFDGHNYSLRAFSQPQGDLLELAQAIEQGLSGDSFALFNVEAQVYLGNGQEVFPSQELVLDSNSKKSKLLYQIDDTAAIHSQKIGNALRTIDSWYPDADELDVGPISVEPYGSVTSRGIAYRQPIKKMDFYTLLDNWVTKDKQPDLEQQHYVMAILIRGGVFGEKSE

SEQ ID NO: 9992 - protein, 333 aa, Escherichia coli LF82; identical to SEQ ID NO: 9930

SEQ ID NO: 9993 - protein, 337 aa, Photorhabdus asymbiotica
MSKSTIKTASVLAFERKLSNSDALMFAGNWKQIDGEWQPIAIQEKAVRGTISNRLKNALTSDPAKLDAEIQNANLQRVDVAALPFDSDTLKVSFTLRVLGNLSTPSVCNDQDYQVELANIINGYIAEHGFKTLAARYAENLANGRFLWRNRVGAEEIKVRVKGKDSKWWEFNGEDFSLREFGKVEGDLAELAAEIEEGLSGNGSTFFNVEAFVRLGYGQEIFPSQELVLDSNSKKSKVLYQVNGIAALHSQKVGNALRTIDSWYPDATELGLGPIAVEPYGSVTSRGKAYRQPKVKMDFYTLLDNWVVKGKKPEEVDQQHYVMAILIRGGVFGEKGE

SEQ ID NO: 9994 - protein, 333 aa, Escherichia coli S88; identical to SEQ ID NO: 9875

SEQ ID NO: 9995 - protein, 333 aa, Escherichia coli ED1a
MAKAPVAIKTASVLAFERKLATSDAVMYAGNWQGNEWQPIEIQEKAVRGTISNRLKNAIVSDPTKLDAEIQKANLQRVDVASLPVDTDTLKVVFTLRVLGNLSTPSVCNDMAYQEALSGVIEGYISEHGFKELTLRYALNLANGRFLWRNRIGAEQIQVKVTANETSWTFNSHDFSLRQFDQGQAAVTQLAAIIEQGLSAKEWVMLTVEAQVRLGAGQEVFPSQELVLDSNSSKSRVLYQVAGIAGIHSQKIGNALRTIDTWHPKVDELGAIAVEPYGSVTSRGVACRQPKEKLDFYTLLDNWVTKGMKPDVKQQHYVMAVLIRGGVFGEKSE

SEQ ID NO: 9996 - protein, 334 aa, Erwinia pyrifoliae Ep1/96
MAKSAIKTASVLAFERKLSNSDAIMLAGKWQDEQNWTPIKIQEKAVRGTISNRLKNAIASDPLKLDAEIQKPNLQRVDVAALPYNCDSLKVCFTLRVLSGLATPAVCNDRAYQAALAAVIDGYIARHGFSTLAARYAENIANGRFLWRNRLGAGRIAVQVTSGEKCWQFDSYDYSLQAFSQPQGDLLELAQAIEQGLSGNSFALFNVEARVYLGNGQEVFPSQELVLDGNSKKSKLLYQIDGTAAIHSQKIGNALRTIDSWYPDADELDEGPISVEPYGSVTSRGIAYRQPIKKMDFYNLLDNWVTKDKEPDTEQQHYVMAILIRGGVFGEKSE

SEQ ID NO: 9997 - protein, 334 aa, Erwinia pyrifoliae DSM 12163; identical to SEQ ID NO: 9996

SEQ ID NO: 9998 - protein, 349 aa, Xanthomonas albilineans GPE PC73
MAHDTLKTASVLAFERKLDPSDALFFSGSWSARHTARDWQPVRIREKSVRGTISNRLKDKSKEQSDPAKLDAAIQNPNLQTVDVAALPLEADTLKVQFTLRVLDGTGEPSACNDTDYRKKLLGTVSDYLQQHGFSELARRYAANLANGRFLWRNRIGAEQVEVHVAHLRDGNPVTQWTFQALDHALRTLSAPSDAAESLNALAATIADGLTGKTHVLLQVTAFVRIGAGQEVFPSQELILDRGRGDKSKTLYAVGEGDKAVAAIHSQKIGNALRTIDTWYPGVEENGAIAVEPYGSVTTQGKAYRQPKDKQDFYNLLDAWVIKDKVPSVEQQHFVIATLIRGGVFGESN

SEQ ID NO: 9999 - protein, 361 aa, Arsenophonus nasoniae
MAKINDLASVLAFEKKLVPSDGYFYGTCWNNKKEAFPLALQEKSVRGTISNRLKNAVQNDPMKLNAEVEKANLQTVDACALGTEQDTLKHHFTLKILGGVQYPSACNNANFKQSYEQAATDYIEREGCQELGRRYAHNIANARFLWRNRVGAEKIEVQVSVLNQGQEQEWTFDATQYSIRDFDQQDAAINELGNKIAATLASKDGALLLNITTYALLGNAQEVYPSEELVLDKGKSKKSKILYHVNRPAARHEGFSASSEVEPNVIRHAAMHSQKIGNALRSIDTWYPAYQDPERSAGAITIEPYGAVTNLGIAFRTPKEKQDFYSHFDKWARSSKLDNIEDEHYVMAVLIRGGVFGESEK

SEQ ID NO: 10000 - protein, 343 aa, Halomonas elongata DSM 2581
MAKKDDALKTASVLAFERKLDPSDALLYAGQWSQRDALEDWQAVSVREKSVRGTISNRLKAKEQDPAKLDAAIENPNLQTVDVATLSHDADTLMARFTLRVLGGAGTPSACNNADYQAKLQQAVADYVKTEGFSELARRYAHNLANGRFLWRNRVGAEQVEVRIRRMEKGHVDKEWTFDALSLSLRGFESDTHTAELAQDIADALAGERHLILEVIAFAHVGNGQEVFPSQELILERGRGDKSKTLYSVDGVAAIHSQKLGNAIRTIDTWYPAPEDGSDLGPIAVEPYGSVTTQGTAYRQPKQKVDFYSLLDNWMLKDQVPETEQQHFVMATLIRGGVFGEAG

SEQ ID NO: 10001 - protein, 234 aa, Desulfobacterium sp.
MAIKENTASVLAFEKKLVPSDGRMYGTKWEDRKSAIPLKLQEKSVRGTISNRLKSSIQNDPAKLNAEVEKPNLQTVDVSALGTEEDTLKLHFTLKVLGGVENPSACNNAAFNQSYKTAVKDYISREKFSELAKRYTTNIANARFLWRNRVGAENIEVQVNALNKGSEQSWVFDATKFSTRNFDLNDAKVSSLAEHIAYALSSENDFSDAGNYLLCQSWKSARSLSQRRTGVRQG

SEQ ID NO: 10002 - protein, 156 aa, Desulfobacterium sp.
MLKCLHWQNISPMHYQAKTIFLMLEIICYAKVGKAQEVYPSEELVLDKGKGKKSKVLYSVDGIAAMHSQKIGNALRTIDTWYPEFGDPATSAGPIAIEPYGAVTNLGKAYRTPRDKQDFYTFFDKFARGEKLERIEDEHYVMAVLVRGGVFGESDK

SEQ ID NO: 10003 - protein, 340 aa, Megasphaera elsdenii DSM 20460
MAKKTTDIASVLAFEKKMVASDAYMYSTTWENKEAVPIQLVEKSVRGTISNRLNKAAVRNDPLKLNAEVQKPNLQTVDSAALPLEQDTLKLCFTLKFLAGVQNPSACNNSTHYAGIQKMGQGYIEKYGFKEVAKRYAMNLANGRFLWRNRIGAEKIEIVVSMDEENKSWTFDAYQYDLKSFDQDDEQVDELSGYIADALCGKRNYAFFKVTAYVLLGSGQDVYPSEELILDKGRGKKSKVLYSVNGIAAMHSQKISNALRTIDTWYPDYEDGIGPIAIETYGSVTALGRAYRTPKDKKDFYTLFDAWSTGNELSCEEDEHYVMAVLVRGGVFGQSGKDDE

SEQ ID NO: 10004 - protein, 341 aa, Taylorella equigenitalis 14/56
MALPSVLAFEKKIVPSDGLLFGSSWDSPEKLIPLKIIEKSIRGTISHFIETESKDSLKLIANVENANLQTIDTCYLPFDCDTLVMKFTLKFLGKISTPSSCNNPEFSTNLQNKVKAIEEKDISELSTRYAINIANSRYLWRNRLGAEEIKVNIKAIFVSKSGSKSESKNFEFDSFDFAMNSFDTEDEHIKDLARLISLAFLDKLHYLILEVECRAKIGSSQEVYPSEELVPNKEDTKKLKNTKSKILFEILGQAGMHSQKIGNAIRTIDTWYPNYNDFNFPIAIEPYGSVTTRSIALRNNRSNFYDLFKKFLDGKKIEKNDELYILAILIRGGILGGKKQS

SEQ ID NO: 10005 - protein, 341 aa, Taylorella asinigenitalis 14/45
MVLPTVLAFEKKIVPSDGLLFGSSWDSPEKLIPLKIIEKSVRGTISNFISNRSKDPLKRFANVENANLQTVDSCYLPFDCDTLVMKFTLKFLGKISTPSSCNNPEFSTNLQNKVRVIQEENIPELSTRYAINIANSRYLWRNRLGAEDIKVNVKAIYVSKSSSKSESKNFEFDSFDFGINSFDTEDEHIKDLAKLISLAFLDKLHYLILEVECRGKIGSSQEVYPSEELVPNKVDTKELKNTKSKILFEILGQAGMHSQKIGNAIRTIDTWYPNYNDFNFPIAIEPYGSVTSRSIALRNNKSNFYDLFIKFLDGKKIDKNDELYILAILIRGGILGGKKQS

SEQ ID NO: 10006 - protein, 334 aa, Erwinia piriflorinigrans CFBP 5888
MAKSAIKTASVLAFERKLSNSDAIMLAGKWQDKQNWTPIKIQEKAVRGTISNRLKNAIASDPLKLDAEIQKPNLQKVDVAALPYNCDSLKVCFTLRVLGDLATPAVCNDRAYQAALAAVIDGYIAQHGFSTLAARYAENIANGRFLWRNRLGAGRVAVQVTSGEKRWKFDGHNYSLLAFSQPQGDLLELAQAIEQGLSGNSFALFNVEAQVYLGNGQEVFPSQELVLDGNSKKSKLLYQIDDTAAIHSQKIGNALRTIDSWYPDADELDVGPISVEPYGSVTSRGIAYRQPIKKMDFYTLLDNWVTKDKQPDMEQQHYVMAILIRGGVFGEKSE

SEQ ID NO: 10007 - protein, 339 aa, Pseudomonas pseudoalcaligenes CECT 5344
MTTTPLKTASVLAFERKLDPSDALFHAGDWQTRDTWQPLAVREKSVRGTISNRLKAKDQDPAKLDAAIENPNLQTVDVAALPHDADTLRVSFTLRVLGGAGTPSACNDAAYRQKLLDTVQSYVASHGFAELARRYAHNLANGRFLWRNRIGAEQVEVQIAHLVDGKAAKQWSFDALSLSLRNFDASGPAATALDELAKLIAAGLSGERHLLLGITAYVRMGAGQEVFPSQELILDRGKGDKSKTLYSVDGVAGMHSQKLGNALRTIDTWYPDAGELGPIAVEPYGSVTTEGRAYRQPKAKADFYNLLDNWLLKDKVPNIGDQHFVMATLIRGGVFGEAG

SEQ ID NO: 10008 - protein, 332 aa, Cronobacter dublinensis 582
MAKASASLKTASVLAFERKLAVSDALMYAGNWEGDNWQPIQIQEKAVRGTISNRLKNAATTDPAKLDADIQKPNLQRVDVAVLAAQTDTLKIVFTLRVLGGLATPSVCNDQAYQDALKEVIEGYGEEHGFGELAHRYATNLANGRFLWRNRVGAEQLRVVVKGSNTWSFDCHEFSQRDFTVRNAALNELAQEIERGLNSESFVLLTVEAYVRLGAGQEVFPSQELVLDSNSSKSRLLYQVNGVAGIHSQKIGNALRTIDTWHPQVAELGAIAVEPYGSVTSRGIACRQPKEKMDFYTLLDNWVTKGVKPDGDQQHYVMAVLIRGGVFGEKAE

SEQ ID NO: 10009 - protein, 342 aa, Desulfovibrio hydrothermalis
MIMAAKKTKIELPSVLAFERKLDVSDGLFKSGIWADRENHQNWEPVLVREKSIRGTVSNRTNKIKEIEKNTQNANLQRVDVASISCEHDSFSLQFTCKILGGVGNPSVCNQPAYQQKIEEKVSEYISKHGFTELGARYAVNLANGRFLWRNRFGAEELEVCVQHLKQGEICKEWTFEGHEFSLNDFTIPDSAKTGIAELTEVIANGLGGALAVLKVTAFARIGAGQELYPSEELILDKGNAKGQKSKTLYSVGGVAGFHSQKISNALRTIDTWYEGGNSSKPIAVEPYGSVTSQGVAYRLSKNDFFTIIDQLIIKDKELDRLEDQHFMMANLIRGGVFGGKD

SEQ ID NO: 10010 - protein, 342 aa, Desulfovibrio hydrothermalis AM13 = DSM 14728; identical to SEQ ID NO: 10009

SEQ ID NO: 10011 - protein, 301 aa, Pseudomonas aeruginosa 18A
MTVREKSVRGTISNRLKTKDRDPAKLDASIQSPNLQTVDVANLPSDADTLKVRFTLRVLGGAGTPSACNDAAYRDKLLQTVATYVNEQGFAELARRYAHNLANARFLWRNRVGAEAVEVRINHIRQGEVARAWRFDALAIGLRDFKADAELDALAELIASGLSGSGHVLLEVVAFARIGDGQEVFPSQELILDKGDKKGQKSKTLYSVRDAAAIHSQKIGNALRTIDTWYPDEDGLGPIAVEPYGSVTSQGKAYRQPKQKLDFYTLLDNWVLRDEAPAVEQQHYVIANLIRGGVFGEAEEK

SEQ ID NO: 10012 - protein, 161 aa, Dialister invisus CAG:218
MKDFDKNREKVEELASFIAETLCGKRSSLLIEVEAFALMGKGQEIYPSEELILDKGKGKKSKVLYQVDGTAAMHSQKLSNAIRTVDTWYPQEEGRRIPIAIEPYGAVTTLGKAYRTPKEKKDFYTLFDQWSTGSEPDDENDKNYVMAVLVRGGVFGQSEKE

SEQ ID NO: 10013 - protein, 343 aa, Dialister sp. CAG:357
MAKKGEVLAFEKKLVVSDGYMYGTTWEDRSGKAVPVRLQEKSVRGTISNRLKGAVKNDPAKLNEEIQKANLQTVDSASLTMDEDTLKLEFTVKVLSGVQYPSACNDPKHYESIKKMGEDFIAENGFKELSRRYALNLANGRFLWRNRVGAEKIEVHVVALKEDGVEKEWIFDAYDFSLKDFGDTSDDVEELAGLIAEALCGERNYLLLKVTAFAFEGQGQEVYPSEEMILNKDKVEGREKKSKILYQVNDIAAMHSQKLGNAIRAIDTWYPSFDEVETGPIAVEPYGAVTNMGMAYRTPKEKKDFYTLFDDYSNGVDLDSDDDKNYVMAVLVRGGVFGKNDEE

SEQ ID NO: 10014 - protein, 340 aa, Megasphaera elsdenii CAG:570
MAKSSTKGLATVLSFEKKIVLSDGLMYGTTWENRQKQATALPLHEKSVRGTISNRLKSAVANDPAKLNAEVEKPNLQTVDAASLTMEQDTLKVTFTMKVLPGAAVPAACNVENHKEEILKMGKRYAEQYGFGELAKRYALNLANGRLLWRNRVGAEDLEVQVKAGNTQWLFHSYDYSLKDFDHVDEKVEALSEQIESALDGKLPYLLLEVTAFAKIGKGQEVYPSEELILDKGKGKKSKVLYEVNGTAAMHSQKLGNAIRTIDTWYNEYKTGNGVGPISVEPYGAVTNLGKAFRNPKEKCDFYTLFDKYSLGADFDSPEAAHYVMAMLIRGGVFGASGKE

SEQ ID NO: 10015 - protein, 337 aa, Acinetobacter baumannii 107m
MAKNEKAVASVLAFEKKLVPSDGYFYGTSWGNRKEQTALKLIQKSVRGTISNRLKPAVAGDPMKLNAEVEKANLQTVDACALGEHQDTLKVGFTLKVLGGIENPSACNNEIFLKSYQSVANNYIQQYGFTELAKRYALNIANARFLWRNRVGAKKVEVVVTINDQPAVTFNALEYPLHDFDHIDEKVQNLANQIAQALKGETPYLLIKVEAYALVGKAQEVYPSEELVLDKGKGDKSKILYQVKDVAAMHSQKIGNALRTIDTWYPEFDEKKAAIAIEPYGAVTNLGKAYRTPKDKKDFFSLFDKYALGESLENPEQEHYVMAVLVRGGVFGQSGKE

SEQ ID NO: 10016 - protein, 333 aa, Escherichia coli PMV-1; identical to SEQ ID NO: 9875

SEQ ID NO: 10017 - protein, 343 aa, Marinomonas sp. MED121
MAKNKDIASVLAFEKKLVPSDGYFYGTKWNDKEQSSPLKLQEKSVRGTISNRQKAAVQNDPAKLNAEVEKANLQRVDACALEPEQDTLKLHFTLKVLGGLATPSACNNAQFKQTYSAAVKNYIEKHSCYELAKRYATNLANGRFMWRNRVGAEEIEVQIKALNKGAEQSWTFDATQLSTRHFDHNDEQVHSLADRIAQVLSSESNHLMLEINCFAKVGKAQEVYPSEELVLDKGNSKNKKSKILYSVNEQAAMHSQKLGNALRSIDTWYPEFDDEEATAGPIAIEPFGAVTNLGKAYRTPKEKQDFYTHFDKWARGEELQRDEDEHYVMAVLVRGGVFGESDK

SEQ ID NO: 10018 - protein, 345 aa, Photobacterium angustum S14
MNICRHLTYTRSLSPGKAVFFYQTTESDFVPLQLETNKIRAPKSGSTEAYDRNGHPKELSPHALAYSNPQCIQACYVPPNVTSVHCRFSLRVEANSLEPDTCEDLKVRRYLSMLSSLYAQKRGYKELAKRYCRNLLMGTWLWRNKHTLGTTIEVVTSNGSHYEVSDTRLLSWSGEWSEQDSQTLTELASEMEEALINDDKYWLIDVHAILKTGFCQEIHPSQKFIEHGEGEASKQYATTFCGNGEETVCFHAEKVGAALQLIDDWWSEDAYKPLRAHEYGADRNYLLARRYPAIANDFYTLIKYIAVYIRSLRKVSSPEQIHPNIHYVMSILCKGGLYQRGRGNG

SEQ ID NO: 10019 - protein, 343 aa, Vibrio alginolyticus 12G01
MELCTQLNYVRSLSAGKAYFYYLSKSGEMCPLEIDRTRLRAPKGGYAEAYKGSKFVEKNVAPQDLAYSNPQFIEECYVKPGVDDIYCAFPLRIRANSLTPGICSDDEVRSKLSLLANTYKELNGYQELAHRYAKNILLGTWLWRNRECRQLSIEVTTSDSQTLIVENATRLSWYGHWDEASAECLEKLTAYLMRALSDPTEYFYMDVKAKIGVGWGDEVYPSQEFLDDREDGAPTKQLATVELLSGEETVAFHGQKVGAALQSIDDWWHEEADKLLRVNEYGADREYVIARRHVSYGNDFYQLVRNTENWIETMTASQSIPNDVHFIMSVLNKGGLFNCSKAK

SEQ ID NO: 10020 - protein, 341 aa, delta proteobacterium MLMS-1
MAIKTASVLAFERKMANSDALMRAGKWEQRDDSSQWHPVTIKGKDVRGTISNRLKTALQSDPAKLDAEIQKPNLQRVDVAALPFDTDTLKLVFSLRVLGNLGQPSACNDSEYQAALAETVKGYVDEHGFKELAMRYATNIANGRFLWRNRVGAEKIAIHVKHIKNQEVAAEWQFDGTGYSLRKFDHSDPDLAAMAEVIRQGLAGESFAFLQIEGFALIGTGQEVFPSQELILDSSRDSKGKKSKTLYQVGDVAALHSQKIGNALRTIDDWHPHADEMGPIAVEPYGSVTNRGKAYRQPKDKVDFYTLLDSWIIKGKKPAAEQQHYVMATLVRGGVFGEKAD

SEQ ID NO: 10021 - protein, 348 aa, Chlorobium ferrooxidans DSM 13031
MADIKTASVLAFERKLDPSDALFFAGKWAERSDSHKWPPITIREKAVRGTISNRLKAKDSDPAKLDAAIENPNLQRVDVATLPNDCDTLKVRFTLRVLGGAGTPSACNNSAYREKLSQIVQGYVQEKGFGELSLRYAYNLANGRFLWRNRLGAEAIEVLVSNRDGENAKTWDFDALKFGLRNFDVPPVSNEAIKDLSTVIESGLGGDGYVLLDVVAFVRIGDGQEVYPSQELILDKGSSGKGQKSKTLYAIADIAAMHSQKIGNALRTIDTWYPNANDPDSVGPIAVEPYGSVTTVGKAYRQPKEKADFYSLLDAWATRDKAPAEEGAQHFVMATLIRGGVFGESEKE

SEQ ID NO: 10022 - protein, 329 aa, Coxiella burnetii 'MSU Goat Q177'
MAKKENIDIASVLSFEKKLIPSDGYMFGTSWDKKSEVTPLKLREKAVRGTISNRFNKNDSKTFLDDPMKLDADVERPNLQPVDACALDQNQDTLKLCFTLKVLGGITNPSACNNALFKQSYKAAAKIYIDTHGFTELATRYAENLANARFLWRNRFGAERIEVRVNASNKTVSQKWAFDATKFNLHTFDSSDTSVKELGALIANALSSEDDYLLLDVNCYVQVGSSQEVYPSEELVLDKSSSDKKGKKTKILYAVNDIAAMHSQKIGNAIRTIDTWYPDFTNQEQTAGPIAIEPYGAVTNLGRAYRTPKDKQDFIPFLMRGREASSLQG

SEQ ID NO: 10023 - protein, 342 aa, Pseudomonas aeruginosa C3719
MSKPILSTASVLAFERKLDPSDALMSAGAWAQRDASQEWPAVTLREKSVRGTISNRLKTKDRDPAKLDASIQSPNLQTVDVANLPSDADTLKVRFTLRVLGGAGTPSACNDAAYRDKLLQTVATYVNEQGFAELARRYAHNLANARFLWRNRVGAEAVEVRINHIRQGEVARTWRFDALAIGLRDFKADAELDALAELIASGLSGSGPVLLEVVAFARIGDGQEVFPSQELILDKGDKKGQKSKTLYSVRDAAAIHSQKIGNALRTIDTWYPDEDGLGPIAVEPYGSVTSQGKAYRQPKQKLDFYTLLDNWVLRDEAPAVEQQHYVIANLIRGGVFGEAEEK

SEQ ID NO: 10024 - protein, 342 aa, Pseudomonas aeruginosa 2192
MSKPILSTASVLAFERKLDPSDALMSAGAWAQRDASQEWPAVTVREKSVRGTISNRLKTKDRDPAKLDASIQSPNLQTVDVANLPSDADTLKVRFTLRVLGGAGTPSACNDAAYRDKLLQTVAAYVNDQGFAELARRYAHNLANARFLWRNRVGAEAVEVRINHIRQGEVARAWRFDALAIGLRDFKADAELDALAELIASGLSGSGHVLLEVVAFARIGDGQEVFPSQELILDKGDKKGQKSKTLYSVRDAAAIHSQKIGNALRTIDTWYPDEDGLGPIAVESYGSVTSQGKAYRQPKQKLDFYTLLDNWVLRDEAPAVEQQHYVIANLIRGGVFGEAEEK

SEQ ID NO: 10025 - protein, 343 aa, Vibrionales bacterium SWAT-3
MELCTQLNYVRSLSAGKAYFYHLSKSGEMCPLEIDRTRLRAPKGGYAEAYKGGKFVKKNVAPQDLAHSNPQFIEECYVKPGVDDIYCAFPLRIRANSLTPDICSDDEVRSKLSLLANTYKELNGYQELAHRYAKNILLGSWLWRNRECRRLSIEVTTSDSQTLIVENATKLSWYGHWDKASAECLEKLTAYLMRALSDPTEYFYMDVKAKIGVGWGDEVYPSQEFLDSREDGVPTKQLATVELLNGKETVAFHGQKIGAALQSIDDWWHENADKPLRVNEYGADREYVIARRHVSHGNDFYQLLRNTENWIESMTASQVIPNDVHFIMSVLIKGGLFNCSKAK

SEQ ID NO: 10026 - protein, 334 aa, Yersinia pestis CA88-4125; identical to SEQ ID NO: 55

SEQ ID NO: 10027 - protein, 347 aa, Vibrio parahaemolyticus AQ3810; identical to SEQ ID NO: 9963

SEQ ID NO: 10028 - protein, 345 aa, Moritella sp. PE36
MIKVIPYSQLSYSRTLSPSQGVFYYESEDNEFNALIIESHKTTPSKSGFGDAYNTDGSIKNITPQSLVYANIHELEMCYVPIGVKEVKCRFSLGIEANSLSPTVCDNPQILTLLEELAEEYKARGGYLELATRICKNIFEGNWLWRNQNAGPTSISFITENGSQFIIGNTRDLANKLPEEWPDEDQGMLEGIAKELANAMSDKSIFWSAEITATLKARSTLDIHPSQLFTDQKSSRTLLKTQLPNGDKTTSFSGFKIGAALQSIDNWWSENADYYIRVNEYGADRKRIISLRNPTNKNDFYTYLNQKLETYKSDLEDKSKPIKPEIHYFMSVLLKGGLFQPTKEH

SEQ ID NO: 10029 - protein, 314 aa, Moritella sp. PE36
MDEHALAQASIHRVESCFVPISIQEVYCRFSLRVNAHSLSPEVCNSDINRQELSQLAELYKDKGGYKVLALKIAINILRCNWLWRNKNTCPTSLRIRTTNDNIYHILDCLDLLTLKVSDWESDAQVVLDQFSDEIAHALSHDGKYWSADIKAKLLPTFSHEIFPSQKFIENKGNSKEQGKKSRILATTLTPSGYETVCMTGYKVGAALQFIDTWWDDNADYAVRVNEYGIDQKKVIPLRTPAKGNDFYTYFNHQVPNFIEEFMQVGDADTIPPSIHYFMSVLVRGGMFQTKSEKVEKKKLSASKTKKVSAKEAK

SEQ ID NO: 10030 - protein, 340 aa, Shewanella benthica KT99
MAKKENIASVLAFEKKLVPSDGYMYGTCWEDRSVVTPLTLIEKSVRGTISNRLKPAVQKDPVKLNAEVEKANLQRVDACALAPEQDTLKLNFSLKILGGLAKPSACNNALFKESYSAAVNDYLGSEGCKELARRYALNIANARFLWRNRVGAENIEVQVNALNKNAPQSWTFDATKFSTRHFNDSSSAVDELAARIAEALASEDDFLMLDINCFVQVGKAQDIYPSEELVLDKGKGTKGKILYSVNDIAAMHSQKIGNALRTIDTWYPEFDSGSSAGPIAIEPYGAVTNLGKAFRTPVAKQDFYTFFDSWARGGQLERIEDQHYVMAVIVRGGVFGESDK

SEQ ID NO: 10031 - protein, 334 aa, Yersinia pestis biovar Orientalis str. IP275; identical to SEQ ID NO: 55

SEQ ID NO: 10032 - protein, 334 aa, Yersinia pestis biovar Orientalis str. F1991016; identical to SEQ ID NO: 55

SEQ ID NO: 10033 - protein, 334 aa, Yersinia pestis biovar Antiqua str. E1979001; identical to SEQ ID NO: 55

SEQ ID NO: 10034 - protein, 334 aa, Yersinia pestis biovar Orientalis str. MG05-1020; identical to SEQ ID NO: 55

SEQ ID NO: 10035 - protein, 334 aa, Yersinia pestis biovar Mediaevalis str. K1973002; identical to SEQ ID NO: 55

SEQ ID NO: 10036 - protein, 341 aa, Providencia stuartii ATCC 25827; identical to SEQ ID NO: 9953

SEQ ID NO: 10037 - protein, 333 aa, Escherichia coli B7A
MAKAPVAIKTASVLAFERKLATSDAVMYAGNWQGNVWQPIEIQEKAVRGTISNRLKNTITSDSTKLDAEIQKANLQRVDVASLPVDADTLKVVFTLRVLGNLSTPSVCNDMAYQEALSGVIEGYISEHGFKELALRYALNLANGRFLWRNRIGAEQIQVKVTANDTFWTFNSHDFSLRQFDQGQAAVTQLAAIIEQGLSAKEWVMLTVEAQVRLGGGQEVFPSQELVLDSNSSKSRVLYQVAGIAGIHSQKIGNALRTIDTWHPKVDELGAIAVEPYGSVTSRGVACRQPKEKLDFYTLLDNWVTKGVKPDVDQQHYVMAVLIRGGVFGEKSE

SEQ ID NO: 10038 - protein, 357 aa, Nitrosococcus oceani AFC27; identical to SEQ ID NO: 9874

SEQ ID NO: 10039 - protein, 102 aa, Ixodes scapularis
MHTPQRKRYRCDICNKSFLWRNNVYAHKRKIHNVPSSRGNKAAAARKQDTLAALATSSSEPHWTSVMQQSMLAPTGFSASPSLLLLQAASAAWSDSREAHDK

SEQ ID NO: 10040 - protein, 345 aa, Vibrio sp. 16
MDLCSQLNYVRSLSPGKAYFYYLSKDGEMCPVGIDRTRLRAPKAGYSEAYKGNNFFAKNVAPQDLAYANPQYIEECYVTPGVDDIYCAFSLRIRANSLFPEVCNNDDVRNALVSLSSVYKELNGYQELAHRYAKNILSGAWLWRNKECRALSIEVTTSEEERIIVNDALRLSWYGHWDEESTLSLELLMAYLSRALSDRSESFYMDIRAKLSVGWGDEVYPSQEFLDTKEDGIPTKQLATVKLSNGKETVAFHGQKVGAALQSIDDWWHEDPDKVLRVNEYGADREYVIARRHVALENDFYHLIKNTESWVKEMNKTKVIPNDVHFIMSVLVKGGLFNGASGKAK

SEQ ID NO: 10041 - protein, 333 aa, Escherichia coli; identical to SEQ ID NO: 9875

SEQ ID NO: 10042 - protein, 357 aa, Oxalobacter formigenes OXCC13
MKKLPGVLSFQRCMFPTDALFYNLYSGKDKTALPVIRHGIRGTQNINKTWSEKATEATVASAKRDEVSNIQTTDSAKLDVSANALSVQFDLRFIDLSDALFACAAGKGDSMDDIKTFRDNVAQFIDKAKNGKGIVEVACRYARNIANGRFLWRNRTIAESIQIRVDDSDEKSASGFSVTFNALDVPLNTFDNISEDEKKLADVIVKGLKGDRQARLRISARVDFGMQGPLEVFPSQNYLENKSRGFARSLYFVGGIPSKQEAHTIEYLGQAAIRDQKISNALRTIDTWYPGFENRNIPIPVEPNGASLDAQQFFRADNKSSGFRLMEKITDLDPDTEDGMFLLACIIRGGVYSGSDN

SEQ ID NO: 10043 - protein, 334 aa, Yersinia pestis Nepal516; identical to SEQ ID NO: 55

SEQ ID NO: 10044 - protein, 334 aa, Yersinia pestis biovar Orientalis str. India 195; identical to SEQ ID NO: 55

SEQ ID NO: 10045 - protein, 334 aa, Yersinia pestis biovar Orientalis str. PEXU2; identical to SEQ ID NO: 55

SEQ ID NO: 10046 - protein, 334 aa, Yersinia pestis Pestoides A; identical to SEQ ID NO: 55

SEQ ID NO: 10047 - protein, 334 aa, Yersinia kristensenii ATCC 33638
MAKATIKTASVLAFERKLSNSDATMFAGHWEQKDSWQPIVIKEKSVRGTISNRLKNAIASDSGKVDAEIQKANLQRVDMAALPFDADTLKMSFTLRVLGNLATPSVCNDQEYQAELASVINGYIAEQGFGVLAARYAENLANGRFLWRNRVGAEQIKVCVTGKTKSWQFESGDFSLRQFIQPSGDLAELAQEIEQGLAGNGFTFLTIDAFVRLGNGQEVYPSQELVLDSNSKKSKVLYQVDGIAALHSQKIGNALRTIDDWYPDAVELELGPIAVEPYGSVTSRGKAYRQPKQKMDFYTLLDNWVTKGNAPDVSQQHYVMAILIRGGVFGEKAE

SEQ ID NO: 10048 - protein, 335 aa, Yersinia rohdei ATCC 43380
MATITLKTASVLAFESKLACSDAIMAAGNWEERTDVTCWQPILVQEKAVRGTISNRLKAAISSDSTKLDAEIQKANLQTVDVAALPFDCDTLKVSFTLRVLGDLATPSTCNDPDYQAALAAVIQGYVARQGFSELARRYATNIASGRFLWRNRVGAEQVEVRVSCGGRPWVFDGYAHGLHEFPPVTGDLLELSKAIEAGLQGQQYTFIEVQAFVRLGQGQAVYPSQELVMGGGKGDKSKFLFQLNQVAAMHSQKIGNALRTIDTWHPESAEVGAIAVEPYGSVTNRGKAYRQPREKLDFYNLLDAWVLKGKEPDLAQQNYVIAMLIRGGVFGDAS

SEQ ID NO: 10049 - protein, 98 aa, Clostridiales bacterium 1_7_47FAA
MEYIKLFGEDAPEGEPSVILYEVDTENERLALRSIDIFADGRTRNIPDLYDGAIEITPIPTVEELNAHVWGEEFHACVIEQAEFEAAWESHTYDGALK

SEQ ID NO: 10050 - protein, 241 aa, Treponema vincentii ATCC 35580
MGFQKTLFKPPHPIFGDINIKYIYGVVENAGQLYILLDVDRIFAARTVTDAKPVVVEEEAVPAAADTVTKAVVSDVTQSNDALDIRFIGDTLAALGQFYASPVNNAWLEKRYYEWRDMRVASSIQIQSEDQAREFLSNFLSPDTRRFWSDSYMNTVLAALPDNDAKIITVWNVGCDAGYETYSLAVLLKQKYPRSAIRIYANDADLLAISNAPMLTVPEDQVINRFKPYLVKGVNDSYSFK

SEQ ID NO: 10051 - protein, 353 aa, Enhydrobacter aerosaccus SK60
MATFKKLPASLALQRGTVISDGAFFHLIDGKTESLKVMYHGIRGTQNVAGNKSKGSASGESVAREVSNIQQTESAKLLPNAKLLVTWDFRLIDLADILFASATKAGADKSDEQAFRKAFQGFVARAKDSDGLKTVVGRYVRNVVNGRWLWRNRLVAESIVITVTPSQNSEKSYTFKALDYNLNSFDNPSADEQALAEILLTGAKGDATNAGLHIEAVVDFGMGGVEVFPSQNYLEDKPKGFSRSLYQLNPVRPQRGADNNQFLGQAALRDQKIGNAIRTIDTWYPNAEEYNHKPIAVEPNGANLEHQFFYRVGKEKMSAFDILKEIDDLDPNSEKGMFLIACLIRGGVYSEGD

SEQ ID NO: 10052 - protein, 343 aa, Vibrio mimicus VM603
MAKNNDIASVLAFEKKLVPSDGYLFGCQWETKEQATPLTLQEKSVRGTISNRLKAAVQNDPAKLNAEVEKANLQRVDACALGQDHDTLKLHFTLKVLGGLAQPSACNNALFKQSYSAAVSQYITKYGCFELAKRYATNLANARFLWRNRVGAEEIEVQVKALNKGAEQTWTFNAKQFSTRHFDHNDPQINSLADRIAQALASETDHLMLQIDCYAKVGKAQEVYPSEELVLDKGNSKTKKSKILYAVNEHAAMHSQKIGNALRSIDTWYPDYVSEEQSAGAIAIEPYGAVTNLGKAFRTPKDKQDFYTFFDKWARGESLPREEDEHYVMAVLVRGGVFGESDK

SEQ ID NO: 10053 - protein, 359 aa, Dialister invisus DSM 15470
MKKPINYIFVKIRNDQEEMKMAKKESNLASVLSFEKKLVLSDGYMYGTTWEKRNETARPVMLVEKSVRGTISNRLKDSVKNDPMKLNAEVEKANLQTVDSASISLNDDTLKLSFTIKVLSGVEHPSACNNETHHKKIEEIGKKFIEQNGFKELSARYAMNIANGRFLWRNRVGAEKAEVIVSIKEENKKWIFNIYDFSLKDFDKNREKVEELASFIAETLCGKRSSLLIEVEAFALMGKGQEIYPSEELILDKGKGKKSKVLYHVDGTAAMHSQKLSNAIRTVDTWYPQEEGRRIPIAIEPYGAVTTLGKAYRTPKEKKDFYTLFDQWSTGSEPDDENDKNYVMAVLVRGGVFGQSEKE

SEQ ID NO: 10054 - protein, 353 aa, Acinetobacter baumannii ATCC 19606 = CIP 70.34 = JCM 6841
MTIFKKLPGSLSLQRGTVVSDGAFFNLFEDGKQEPLHVMYHGIRGTQNVAGNKEKGAATGNSLAREVTNIQLTESAKLQPKAKLLVKWDFRFIDLSYVLFASASKAGADKTEEYNFRQAFLNFVNRAKESDGLKEVVRRYVRNIVNGRWLWRNRIVAESITIQVTAQDYPEIFSFDALSYNLKSFDQPSEQEQKLAEILLKGITGESTSAALHIEAIVDFGMGGVEVFPSQNYLEDKPKGFSRSLYQLTPKKPDHQANDNQYLGQAALRDQKIGNALRTIDTWYPLFKENDEKPIAVEPNGANLEGQIFYRVGKDKVSAFDILKEIDELDPNSEKGMFLIACLIRGGVYSEGE

SEQ ID NO: 10055 - protein, 334 aa, Pasteurella dagmatis ATCC 43325
MSKLVTPSVLAFERNLDISDAIFTQKDSQNDKDEPIALRIREKSVRGTISNRLKNAITNDPAKLDAETEKANLQRVDVVTLDNDKDTLIATFSIKVLPFTGRPNVCNEQDYQQKVMETVQQYLNESGVDELAKRYAANIANARWLWRNRMGAETIKIDVKCGEKLVTFDNAKQFSLNHFDYSDSKIDEIASEIKQGLLGEKFVILYVTAYANMGYGQEVYPSQELVLDSSSNNRKSKVLYEINQKAGMHSQKVGNAIRTIDTWYADEVAFPIAAEPYGAVTTLGTAFRQPKVKNDFYTLFDNWLLKDEVPPVEQQHYIMSILIRGGVFGASGKE

SEQ ID NO: 10056 - protein, 340 aa, Mitsuokella multacida DSM 20544
MAKSNTKGLATVLSFEKKIVLSDGLMYGTTWEERQAEATALPLHEKSVRGTISNRLKQAVANDPAKLNAEVEKPNLQTVDAASLSMDQDTLKVTFTMKVLRGAAVPAACNNAEHKAKILEMGNRYVEQYGFGELAKRYALNLANARFLWRNRVGAEELEVQVKANDKQWLFHSYDYSLQDFDHSDEMVDTLAEQIESALSGKIPYLLLEVTAFAKIGRGQDVYPSEELILDKGKGKKSKVLYEVDGTAAMHSQKLSNAIRTIDTWYEEYGTDTGVGPIAVEPYGAVTNLGKAFRTPKAKSDFYTLFDKYSLGDDFESPEAAHYVMAVLIRGGVFGASAKE

SEQ ID NO: 10057 - protein, 343 aa, Vibrio mimicus VM223
MELCTQLNYVRSLSAGKAYFYYLSESGEMCPLNVDRTRLRAPKGSYSEAYKGNKFVDKNVAPQDLAYSNPQFIEECYVKPGVDEIYCAFSLRIRANSLTPDICSDDEVRSKLSMFAKIYKELNGYKELANRYAKNILLGTWLWRNRECRNITIEVTTSELDTFVVEHAQKLSWYGHWDGDSTECLERLTAYLERALSDPTEYFYMDVKAKMRVGWGDEVYPSQEFLDSREDGIPTKQLATVELLSGKETVAFHGQKVGAALQSIDDWWHEEADKPLRVNEYGADREYVIARRHVAYGNDFYQLLRNTENWIESMTASESIPNDVHFIMSVLIKGGLFNCAKAN

SEQ ID NO: 10058 - protein, 366 aa, Acinetobacter lwoffii SH145
MSSVENFKKLPGSLSLQRGTLISDAAFYHLHADGKEEALHVMYHGIRGTQNVAGNKEKGSASGISAAREVSNIQMTESAKLLPNAKLLVKWDLRFIDLQHILFASASKAGANKQDEKDFRTAFKDFVEKAKESEGLQDVARRYVRNIINGRWLWRNRSVAEHILVKVSQTIEHDQSQTAKSYKLIAEFNALDYSLKSFDDVSEQEQQIADILVKGMQGDISSGLHIEAIVDFGMGGIEVFPSQNYLEDKPKGFSRSLYQLNPIRPERQANDNQFLGQAAIRDQKIGNALRTIDTWYATYLENDSKPIPVEPNGASLDAQDFFRVNKKNKDSAFDILKEIRNLDPNSDKGKFLIACLIRGGVYSEGE

SEQ ID NO: 10059 - protein, 343 aa, Vibrio sp. RC586
MELCTQLNYVRSLSAGKAYFYYLSESGDMCPLNVDRTRLRAPKGSYSEAYKGNKFVDKNVAPQDLAYSNPQFIEECYVKPGVDEIYCAFSLRIRANSLTPDICSDDEVRSKLSMFAKIYKELNGYKELANRYAKNILLGTWLWRNRECRNITIEVTTSELDTFVVEHAQKLSWYGHWDGDSTECLERLTAYLERALSDPTEYFYMDIKAKLRVGWGDEVYPSQEFLDSREDGIPTKQLATVELLSGKETVAFHGQKVGAALQSIDDWWHEEADKPLRVNEYGADREYVIARRHVAYGNDFYQLLRNTENWIESMTASESIPNDVHFIMSVLIKGGLFNCAKVN

SEQ ID NO: 10060 - protein, 304 aa, Yersinia pestis KIM D27
MAKATIKTASVLAFERKLSNSDAMMYAGNWGQTDNWQPIIIKEKAVRGTISNRLKNALASDPAKLDAEIQKANLQRVDVAALPFDTDTLKMSFTLRVLGNLATPSVCNDQEYQAELASVINGYISEQSFSVLAARYAENLANGRFLWRNRVGAEDIKVCITSQTKSYQFDSNEFSLRQFSQPSKELTALAQEIEQGLAGNGFAFFTVDAFVRLGNGQEVFPSQELVLDSNSKKSKVLYQIDGIAALHSQKVGNALRTIDDWYPDATELALGPIAVEPYGSVTSRGKAYRQPKQKWISTPYWTTG

SEQ ID NO: 10061 - protein, 333 aa, Enterobacter cancerogenus ATCC 35316
MAKAPTAVKTASVLAFERKLATSDAVMYAGNWQGTDWQPIRLQEKAVRGTISNRLKNALLNDPAKLDAEIQKANLQRVDVAALPAEADTLQVRFTLRVLGNLSVPSVCNDRTYQDALQQVIEGYIAEHGFSVLAHRYATNLANGRFLWRNRIGAEKIEITVKKGSETWTFNAHDYPLRDFTTQDERLQTLSREIEKGLRGESFVLLEVSANVLLGNGQEVFPSQELVLDSNSAKSRLLYQVDNVAGMHSQKIGNAVRTIDTWHPRVDELGAIAVEPYGSVTSRGIACRQPKEKTDFYTLLDNWVTKGHKPEVDQQHYVMAILIRGGVFGEKSE

SEQ ID NO: 10062 - protein, 40 aa, Yersinia pestis KIM D27
MDFYTLLDNWVTKGTVPAVEQQHYVMATLIRGGVFGEKGE

SEQ ID NO: 10063 - protein, 99 aa, Clostridium hathewayi DSM 13479
MMEYIKLFWEDAPEGEPSVILYEVDTENERLALHSIDIFADGRTRNIPDLYDGAIEITPIPTVEELNAHVWGEEFHACVIEQAEFEAAWESHTYDGALK

SEQ ID NO: 10064 - protein, 333 aa, Neisseria sp. oral taxon 014 str. F0314
MAKPETPSLLAFERKLDCSDAVFSQTDGNNPEAQEQPVTVSEKSVRGTISNRLKNAIANDPAKLDAEIEKANLQTVDVAALSSGCDTLIARFTLKVLPFDGSPYVCNGAQYRGRLLETATQYLQTEGMQALAERYAANIANGRWLWRNRMGAENIRITVSNKNDSITVDNAKALPLDRFDRPSENVAKIAEWIRQGLSGEAFTLLSVEARVQAGYGQEVYPSQELILDTGKSNKSKVLYQTGGKAGMHSQKIGNAIRTIDTWYAQDAAFPIAAEPYGAVTTLGTAFRQPKQKNDFYTLFDNWILKGEQPSAEQQHYVIGVLIRGGVFGASGKE

SEQ ID NO: 10065 - protein, 354 aa, Desulfonatronospira thiodismutans ASO3-1
MSIGNLPKLLSFQRGVAVSDGLMYNYTSKPQNGYSKVRVVRHGIRGTQNVSDASKEKLYQVQVTESAKTEANAEGLVIRFSFGLLPLKNLLFSSSEKSFSDHCQAFAERFGGSEELMEISCRYARNVLNGRWFYRNSELESGRQITVKFLPPGSETKDLPEADGVTVQSATSLGFRNDYTADEKKLGAEICKCLKGESKTRFHVEGVIKFGMKGVFEVFPSQNYVSSKPKGFARPLYKVGVVDSRELSDILKDSDPSSFRADMISMGHAALRDQKIGNALRVIDTWYERGDDMTPIAVEPNGASLKDNHYYRKKNGSAFVLMKKIDEMQPGNGELNKDAMFLLATMIRGGVFSG

SEQ ID NO: 10066 - protein, 331 aa, Actinobacillus pleuropneumoniae serovar 2 str. 4226
MTKLTTASVLAFERKLDISDATFTQKNSMSDAPEIAVTIREKSVRGTISNRLKNALANDPAKLDAEIEKANLQRVDVATLNDDYDTLVARFTCKVLPFEGKPNVCNDPEYQAKLLSTIQNYLTAHGMSELAKRYATNLANARWLWRNRISAETIQVSIKVADDVIVFENAKQLPLNSFEQADEKLQKIASYIEKGLKGEEFIILEVEAQAKMGRGQEVYPSQELVLDTGTRKSKILYEINHKAGMHSQKIGNAIRTIDTWYAENAPFPIAVEPYGAVTNLGTAFRQPKEKIDFYTLFDNWVLKDVAPELEQQHYVISVLIRGGVFGASGKE

SEQ ID NO: 10067 - protein, 331 aa, Actinobacillus pleuropneumoniae serovar 6 str. Femo
MTKLTTASVLAFERKLDISDATFTQKNSTSSEPEIAVTIREKSVRGTISNRLKNALANDPAKLDAEIEKANLQRVDVATLNDDYDTLVARFTCKVLPFEGKPNVCNDPEYQAKLLSTIQNYLTAHGMSELAKRYATNLANARWLWRNRISAETIQVSIKVADDVIVFENAKQLPLNSFEQADEKLQKIASYIEKGLKGEEFIILEVEAQAKMGRGQEVYPSQELVLDTGTRKSKILYEINNKAGMHSQKIGNAIRTIDTWYAENAPFPIAAEPYGAVTNLGAAFRQPKEKIDFYTLFDNWVLKDIAPELEQQHYVISVLIRGGVFGASGKE

SEQ ID NO: 10068 - protein, 490 aa, Prevotella marshii DSM 16973 = JCM 13450
MKKKTWVRHHRYFGLVLAFFIIMFCLSGLVLNHPSVFSDVNVSRSLLPTDYRYKQWNGGLLRGTLLWRNSVLVYGNSGIWLTDARASAFKDFNAGLPEGADMRNIRGLAILPSGNLFAAGAYGLYEYRHPDGWQERILPRDENERLSDISTLGDTLIITGRSHIYMSLPPYRTFHKIILPATDDADGKVSLFKTIWQLHSGELFGLAGRLVVDAIALVLIFLSLSGVLYWLFPHVMKHRPARLMRKLFSWHDAVGRITIVLTLFICITGWLLRPPALIAIASAKIPPIPGSALDSDNPWHEKLRTLRYDKNEGDWLLYTSDGFFSLKHFMDAPWPVEPAPPVSVMGINVQQRDEHGNWLIGSFNGLYVWQRKTGQVFDYRNHQPAGKVSRIPDLSNAVAGYTADFAGGHRMVDYYSGTPSLSMPARMTDLPISLRALALEVHTGRIYTFLGGSNNILYIFLIGLAIAWCLWTGWKLRTKPHKRKTTNLNR

SEQ ID NO: 10069 - protein, 333 aa, Escherichia coli NC101; identical to SEQ ID NO: 9930

SEQ ID NO: 10070 - protein, 331 aa, Actinobacillus pleuropneumoniae serovar 1 str. 4074; identical to SEQ ID NO: 10066

SEQ ID NO: 10071 - protein, 331 aa, Actinobacillus pleuropneumoniae serovar 2 str. S1536; identical to SEQ ID NO: 10066

SEQ ID NO: 10072 - protein, 331 aa, Actinobacillus pleuropneumoniae serovar 4 str. M62; identical to SEQ ID NO: 10067

SEQ ID NO: 10073 - protein, 331 aa, Actinobacillus pleuropneumoniae serovar 6 str. Femo; identical to SEQ ID NO: 10067

SEQ ID NO: 10074 - protein, 331 aa, Actinobacillus pleuropneumoniae serovar 9 str. CVJ13261; identical to SEQ ID NO: 10066

SEQ ID NO: 10075 - protein, 331 aa, Actinobacillus pleuropneumoniae serovar 10 str. D13039; identical to SEQ ID NO: 10066

SEQ ID NO: 10076 - protein, 331 aa, Actinobacillus pleuropneumoniae serovar 11 str. 56153; identical to SEQ ID NO: 10066

SEQ ID NO: 10077 - protein, 331 aa, Actinobacillus pleuropneumoniae serovar 12 str. 1096
MTKLTTASVLAFERKLDISDATFTQKNSMSDAPEIAVTIREKSVRGTISNRLKNALANDPAKLDAEIEKANLQRVDVATLNDDYDTLVARFTCKVLPFEGKPNVCNDPEYQAKLLSTIQNYLTTHGMSELAKRYATNLANARWLWRNRISAETIQVSIKVADDVIVFENAKQLPLNSFEQADEKLQKIASYIEKGLKSEEFIILEVEAQAKMGRGQEVYPSQELVLDTGTRKSKILYEINNKAGMHSQKIGNAIRTIDTWYAENAPFPIAAEPYGAVTNLGAAFRQPKEKIDFYTLFDNWVLKDIAPELEQQHYVISVLIRGGVFGASGKE

SEQ ID NO: 10078 - protein, 331 aa, Actinobacillus pleuropneumoniae serovar 13 str. N273; identical to SEQ ID NO: 9903

SEQ ID NO: 10079 - protein, 347 aa, Vibrio parahaemolyticus Peru-466; identical to SEQ ID NO: 9979

SEQ ID NO: 10080 - protein, 347 aa, Vibrio parahaemolyticus AN-5034; identical to SEQ ID NO: 9979

SEQ ID NO: 10081 - protein, 347 aa, Vibrio parahaemolyticus K5030; identical to SEQ ID NO: 9979

SEQ ID NO: 10082 - protein, 333 aa, Escherichia coli MS 145-7; identical to SEQ ID NO: 10037

SEQ ID NO: 10083 - protein, 339 aa, Caenorhabditis remanei
MAKKPKSATESAKVPSVLAFNRKIEPSDALMQAGLWSNRDQVSTWKNIDLHQKRNRGTKSQYGVPDAEKTDPNLVWGDDARLPFDADTLKVFFTVKFLGNIAEPTTHNRPEFENKLNEKFQEYSEKIGFLTLAQRYIYNLVNARFLWRNRLGAEKISIQIKNSETGKIWNFEDAYQFGLNTFDSIQDSQLMEIANLVSNSFKEDHYLLLEVTAFAKVGEGQHVFPSQEMVMDPPKGQKSKYLYEIKTKEGFCAGIHSEKIGNAIRTIDNWYVDETNDLKPAIAIEPYGSVPNRGRAYRINQTDFYTLLINWLEDKEILEDDQHFIVANLIRGGVFGGND

SEQ ID NO: 10084 - protein, 169 aa, Pyrenophora teres f. teres 0-1
MVNTTHSTSVRGTLSNPKTTAAKQSSKPIPGLGDSTSLKPERDDKPLPSNDSAPPAHGNNDTPSSHSYSYASSAPVVSDPYRVAGTSAGGGDKKAIGNGGSAQKGGSDKKEELPHSKTVRGTLANKDGNKVNRTQLGDPASLKAETSLTNHMNRQTEREGTDKERTSKL

SEQ ID NO: 10085 - protein, 333 aa, Escherichia coli MS 110-3; identical to SEQ ID NO: 9875

SEQ ID NO: 10086 - protein, 353 aa, Bilophila wadsworthia 3_1_6
MAKKMNKLPGVLSFQRCLLVTDGLFYNELDNGNLSPLWVMRHGIRGTQNINKASKEGQAASASAKRDEVSNIQTTDSAKLDANASALQVRFNLRGMDIQKALFACAPGQKDSMDDLNAFKADLAAFVDRAKESEALVHLACRYVRNIANGRFLWRNRTVASSATVEVLLPDGTKKMFDALATPFNHFEEVSDDERTVAEVLARGWKGDPTTELRVTAHVDLGVGGAVEVFPSQNYLENKARGFARPLYCVGGAPDGQDQHSVRIMGQAALRDQKIGNALRTIDTWYPAYEERRVPLPVEPNGASLDAQEFFRNKGDASGFKLMLRVSELDPMTPDGLFLLACIIRGGVFSGSE

SEQ ID NO: 10087 - protein, 114 aa, Actinobacillus ureae ATCC 25976
MSELAKRYATNLANARWLWRNRISAETIQVSIKVADDVVVFENAKQLPLNSFEQADEKLQKIASYIEKGLKGEEFIILEIEAQAKIGGGQEVYPSQELVLDTGTRKSKILGAVV

SEQ ID NO: 10088 - protein, 333 aa, Escherichia coli H252; identical to SEQ ID NO: 9875

SEQ ID NO: 10089 - protein, 333 aa, Escherichia coli H263; identical to SEQ ID NO: 9875

SEQ ID NO: 10090 - protein, 333 aa, Escherichia coli MS 57-2; identical to SEQ ID NO: 9995

SEQ ID NO: 10091 - protein, 159 aa, Enterococcus casseliflavus ATCC 12755
MKPIIKETLQKKTTTSAKLRYLAYAYKEWLIAITLFVVFAGSITYSLTRPQEEVVNAAIVTETAMDPAVQSELEAAVEAWAIDQGYQKEELRISLVSYAEPAAVQAFTTRLAAGAIQMVVFPASEAQTWQERFGSQELAQEIITVGENEFILQVTNKEK

SEQ ID NO: 10092 - protein, 335 aa, Moraxella catarrhalis 46P47B1
MSKLTTATVLAFERNLDISDGFMAQKNSQNENSGIVPVRIQEKSIRGTISNRLKNTITNDPAKLDAEIEKANLQKVDSASLLEDNDTLIVSWTCKVLPFDGKPNVCNDPNYQAKLLQTVQGYLQEHGVKTLAHRYATNIANARWLWRNRIGSEKITVNVTCKLADQQQTLTFDAKSISIHNFDTQNPELMTLANWIEQGLTNQSFIILNITAEAVVGYGQEVYPSQELILDTGKTKSKVLYHINDKAGIHSQKIGNAIRTIDTWYPDAQFPIAVEPYGQVTTMGTAFRQPKQKQDFYSLFDGWILKDNKPSVENQHYVMAVLVRGGVFGASGKES

SEQ ID NO: 10093 - protein, 298 aa, Moraxella catarrhalis 7169
MRIQEKSIRGTISNRLKNTITNDPAKLDAEIEKANLQKVDSASLLEDNDTLIVSWTCKVLPFDGKPNVCNDPNYQAKLLQTVQGYLQEHGVKTLAHRYATNIANARWLWRNRIGSEKITVNVTCKLADQQQTLTFDAKSISIHNFDTQNPELMTLANWIEQGLTNQSFIILNITAEAVVGYGQEVYPSQELILDTGKTKSKVLYHINDKAGIHSQKIGNAIRTIDTWYPDAQFPIAVEPYGQVTTMGTAFRQPKQKQDFYSLFDGWILKDNKPSVENQHYVMAVLVRGGVFGASGKES

SEQ ID NO: 10094 - protein, 335 aa, Moraxella catarrhalis 103P14B1
MSKLTTATVLAFERNLDISDGFMAQKNSQNENSGIVPVRIQEKSIRGTISNRLKNTITNDPAKLDPKIEEANLQKVDSASLLEDNDTLIVSWTCKVLPFDGKPNVCNDPNYQAKLLQTVQGYLKEHGVKTLAHRYATNIANARWLWRNRIGSEKITVNVTCKLADRQQTLTFDAKSISIHNFETQSKELNELADWIEQGLTNQAFIILNITAEAVVGYGQEVYPSQELILDTGKTKRKVLYHINDKAGIHSQKIGNAIRTIDTWYPEAQFPIAVEPYGQVTTMGTAFRQPKQKQDFYSLFDGWILKDNKPSVENQHYVMAVLVRGGIFGASGKES

SEQ ID NO: 10095 - protein, 335 aa, Moraxella catarrhalis 12P80B1
MSKLTTATVLAFERNLDISDGFMAQKNSQNENSGIVPVRIQEKSIRGTISNRLKNTITNDPAKLDAEIEKANLQKVDSASLLEDNDTLIVSWTCKVLPFDGKPNVCNDPNYQAKLLQTVQGYLQEHGVKTLAHRYATNIANARWLWRNRIGSEKITVNVTCKLADQQQTLTFDAKSISIHNFDTQNPELMTLANWIEQGLTNQSFIILNITAEAVVGYGQEVYPSQELILDTGKTKSKVLYHINDKAGIHSQKIGNAIRTIDTWYPEAQFPIAVEPYGQVTTMGTAFRQPRQKQDFYSLFDGWVLKDNKPSVENQHYVMAVLVRGGVFGASGKES

SEQ ID NO: 10096 - protein, 335 aa, Moraxella catarrhalis BC1; identical to SEQ ID NO: 10092

SEQ ID NO: 10097 - protein, 335 aa, Moraxella catarrhalis BC7; identical to SEQ ID NO: 10094

SEQ ID NO: 10098 - protein, 335 aa, Moraxella catarrhalis BC8; identical to SEQ ID NO: 10095

SEQ ID NO: 10099 - protein, 335 aa, Moraxella catarrhalis CO72; identical to SEQ ID NO: 10094

SEQ ID NO: 10100 - protein, 335 aa, Moraxella catarrhalis 101P30B1; identical to SEQ ID NO: 10094

SEQ ID NO: 10101 - protein, 335 aa, Moraxella catarrhalis O35E; identical to SEQ ID NO: 10095

SEQ ID NO: 10102 - protein, 347 aa, Vibrio parahaemolyticus 10329
MKLPNSLSYMKSIEASDVIFLVNWPDGRKTPLPYTSRVALGMKEGSKSAYKDDGQIDADVTAYSLAQGNPHEIDFCCVPYGAESIECEFSVSFASSLRKPFKCSDPEVKRTLVQLIKLYEEKVGWEELANRFLENICNGRWLWRNNECTYSTSIGIKPWPWEDEKAISPFHDIRKNYAGTNHFRDHKDWDNLIKLITDAFSQPNGLCIFEVSATFRLGTNAPIYPSQVFKDSVKGEKNRIYQSTDVDGESSPILGCYKTGAAIATIDDWYPDADKPIRISHYGAHKDDVYCYRHPNTGKDLFTLLEKADQYLEQLQATDVLPDEMINDLHFIVANLIKGGLLQRKGT

SEQ ID NO: 10103 - protein, 400 aa, Pseudomonas amygdali pv. lachrymans str. M301315
MSTHISKNKIPSLFTYTGSIALSDATMSIVDAQGDEHPVRISNQGVLGIKGSDNNATALRAFMAANPGKPYEAQMNPQRVDKAIIDQEGAQTLVVRYRMIINANSLRPHTCNNMEIANMAMEFIQRYYALGGSQYLANRYISNILKGLWLHRNLEFRHEGQINVKAWAFGVEPFEFTYGGMSTFTDFAPIGGAEPLVDLMSRALDGNLKGADGVPTPGFFDIEARINVCQGMTVYPSQILNMDEQGKRLAYLATRQGERQAILHSQKVGNAIRRIDNWYVNPLLKEVEAGNEHFKDLRALMPKIVDGTLELEPLPVEPLGIERRLNQAYRLALGTDLFSLLRTLIHTTSVDLASIDDFTKVKDDMHYLAACFIRGGLFNSEKDAAEAPKDKNKPAGKKAK

SEQ ID NO: 10104 - protein, 333 aa, Escherichia coli D9; identical to SEQ ID NO: 10037

SEQ ID NO: 10105 - protein, 337 aa, Acinetobacter baumannii 6013150; identical to SEQ ID NO: 9909

SEQ ID NO: 10106 - protein, 337 aa, Acinetobacter baumannii 6013113; identical to SEQ ID NO: 9909

SEQ ID NO: 10107 - protein, 334 aa, Rheinheimera sp. A13L
MTTTLKTASVLAFEAKLANSDAIMASGNWDERGNAKSFLPVTVKEKAVRGTISNRLKSALASDPAKVDAEVQKANLQTVDNAALPFEHDTLRVSFTLRIIGDLATPSTCNDPEYQQALATIINGYAEQTQFTELANRYAANIANGRFLWRNRVGAEAVEVQVTHGKELWIFDSQQFDLHRFAEPTGDVAKLAQVIKLGLTGESFALIKVHAFVKLGAGQAVYPSQELVMGGGKGDKSKFLYQLDGVAAMHSQKIGNALRTIDTWHPETAEVGAIAVEPYGSVTNRGKAYRQPKDSMDFYKLLDGWVLKGKTPALEQQHYIMAMFIRGGVFGEAG

SEQ ID NO: 10108 - protein, 46 aa, Pasteurella multocida subsp. gallicida str. Anand1_poultry
MEVKCGENTIHFDDAKQFSLNHFDHQDDKIHQIAKEIKQGLLGENS

SEQ ID NO: 10109 - protein, 47 aa, Pasteurella multocida subsp. gallicida str. Anand1_poultry
MGYGQEVYPSQELVLDNSTNNRKSKFCMKINQSGDAFTKSGECHSHD

SEQ ID NO: 10110 - protein, 48 aa, Pasteurella multocida subsp. gallicida str. Anand1_poultry
MHSQKVGNAIRTIDTWYAEEVAFPIAAEPYGAVTTLGTAFPSTENQKE

SEQ ID NO: 10111 - protein, 108 aa, Pasteurella multocida subsp. gallicida str. Anand1_poultry
MRGTISNRLKNTITNDPAKLDAETEKANLQRVDVATLDDDKDTLVATFSIKVLPFTGRPNVCNDQDYQHQIMTTVAQYLSEQGIDELAKRYATNIANARWLWRNRMSA

SEQ ID NO: 10112 - protein, 335 aa, Pasteurella multocida subsp. multocida str. Anand1_goat
MSKKLATPSVLAFERNLDISDAIFAQKDSKNDKDAPVPLRIREKSVRGTISNRLKNTITNDPAKLDAETEKANLQRVDVATLDDDKDTLVATFSIKVLPFTGRPNVCNDQDYQHQIMTTVAQYLSEQGIDELAKRYATNIANARWLWRNRMSAEHKIEVKCGENTIHFDDAKQFSLNHFDHQDDKIHQIAKEIKQGLLGEKFVILYVTAYANMGYGQEVYPSQELVLDNSTNNRKSKILYEINQKAGMHSQKVGNAIRTIDTWYAEEVAFPIAAEPYGAVTTLGTAFRQPKTKKNDFYTLFDNWLLKGEVPSVEQQHYVMSVLIRGGVFGASGKE

SEQ ID NO: 10113 - protein, 343 aa, Vibrio cholerae HC-02A1
MAKNNDIASVLAFEKKLVPSDGYLFGCQWETKEQATPLTLQEKSVRGTISNRLKAAVQNDPAKLNAEVEKANLQRVDACALGQDHDTLKLHFTLKVLGGLAQPSACNNALFKQSYSAAVSQYITKYGCFELAKRYATNLANARFLWRNRVGAEEIEVQVKALNKGAEQTWTFNAKQFSTRHFDHNDSQLNSLADRIAQALASETDHLMLQIDCYAKVGKAQEVYPSEELVLDKGNSKTKKSKILYAVNEHAAMHSQKIGNALRSIDTWYPDYASEEQSAGAIAIEPYGAVTNLGKAFRTPKDKQDFYTFFDKWARGESLPREEDEHYVMAVLVRGGVFGESDK

SEQ ID NO: 10114 - protein, 353 aa, Bilophila sp. 4_1_30
MAKKLNKLPGVLSFQRCLLVTDGLFYNELDNGNLSPLWVIRHGIRGTQNINKASKEGQAASASAKREEVSNIQTTDSAKLDANASALQVRFNLRGMDIKKALFACAPGQKDSIDDLNAFKADLAAFVDRAKESETLVHLACRYVRNIANGRFLWRNRAVASSATVEVLLPDGTKKMFDALATPFNHFEEVSDDERAVAEVLARGWKGDPATELRVTAHVDLGVGGAVEVFPSQNYLENKARGFARPLYCVGGAPDGQDQHSVRIMGQAALRDQKIGNALRTIDTWYPAYEERRVPLPVEPNGASLDAQEFFRNKGDASGFKLMLRVSELDPMTPDGLFLLACIIRGGVFSGSE

SEQ ID NO: 10115 - protein, 333 aa, Escherichia coli 3030-1
MAKAPVAIKTASVLAFERKLATSDAVMYAGNWQGNVWQPIEIQEKAVRGTISNRLKNTITSDSTKLDAEIQKANLQRVDVASLPVDADTLKVVFTLRVLGNLSTPSVCNDMAYQEALSGGIEGYISEHGFKELALRYALNLANGRFLWRNRIGAEQIQVKVTANDTFWTFNSHDFSLRQFDQGQAAVTQLAAIIEQGLSAKEWVMLTVEAQVRLGGGQEVFPSQELVLDSNSSKSRVLYQVAGIAGIHSQKIGNALRTIDTWHPKVDELGAIAVEPYGSVTSRGVACRQPKEKLDFYTLLDNWVTKGVKPDVDQQHYVMAVLIRGGVFGEKSE

SEQ ID NO: 10116 - protein, 336 aa, Aggregatibacter actinomycetemcomitans serotype a str. H5P1; identical to SEQ ID NO: 9955

SEQ ID NO: 10117 - protein, 336 aa, Aggregatibacter actinomycetemcomitans serotype d str. I63B; identical to SEQ ID NO: 9955

SEQ ID NO: 10118 - protein, 208 aa, Aggregatibacter actinomycetemcomitans serotype e str. SCC393
MVARFTCKVLPFDGKPCVCNDQDYQSKIIGVVESYIKTQGFSELAKRYATNIANARWLWRNRMSAETIKIEVSFNGETLTFDNAKALSLNTFDDSSTQLQVLTGHIEDGLSGKHFVILNITAYVKMGYGQEVYPSQELVLDAGANNRKSKVLYKLDDSGKAAMHSQKVSNAIRTIDTWYKSNAEFPIATEPYGAVTTLGTAFRQPKEN

SEQ ID NO: 10119 - protein, 80 aa, Aggregatibacter actinomycetemcomitans serotype e str. SCC393
MRKLTTPTVLAFERNLDISDAVFTQFNSQDKNPVEEEVKIREKSVRGTISNRLKNTITNDPTKLDAEIQKLIYNALMLLH

SEQ ID NO: 10120 - protein, 336 aa, Aggregatibacter actinomycetemcomitans serotype f str. D18P1; identical to SEQ ID NO: 9955

SEQ ID NO: 10121 - protein, 336 aa, Aggregatibacter actinomycetemcomitans D17P-3; identical to SEQ ID NO: 9955

SEQ ID NO: 10122 - protein, 99 aa, Clostridium sp. 7_3_54FAA; identical to SEQ ID NO: 10063

SEQ ID NO: 10123 - protein, 333 aa, Escherichia coli cloneA_i1; identical to SEQ ID NO: 9875

SEQ ID NO: 10124 - protein, 341 aa, Halomonas boliviensis LC1
MAKNDTLKTASVLAFERKLDPSDALLYASNWEKRQDEQQWQPVEVREKSVRGTISNRLKAKDQDPAKLDAAIENPNLQTVDVATLPHDADTLVTRFTLRVLAGAGTPSACNNAEYQAKLEQAVAEYKQAQGFGELAHRYANNLANGRFLWRNRMGAEQVEVSVRQLAQGKTTKEWTFDALSLSLRAFDNTAELKELADVIAAALAGEQHLLLEVVAYVRVGSGQEVFPSQELILDRGRGDKSKTLYHVSKIAGIHSQKLGNAIRTIDTWYPNENDEDLGPIAVEPYGSVTTQGKAYRQPKQKADFYSLLDNWMIKDQVPSKEDQHFVMATLIRGGVFGEAG

SEQ ID NO: 10125 - protein, 349 aa, Halomonas sp. GFAJ-1
MMNSFRHLSYERSLNPGKAVFYYRTDSSEFEPLQAEVTRFRGPKATFSDGYMASGTARAKETSDLGFSNPIMLETCYVPPLVDTLYCRFSLRIIANSLEPNICDNAEATKALKEFSDTYRNLGGYQELATRYAKNILSAEWLWKNKVARGIAVEVSTSNLKNYCIKDAQYKEWGSSWEGDELKSLEGLAVEFEEALSCPQKFLFADVAAKIKTEFCQEIFPSQLFVEKDDRGNGSASRQFMKSTMNDGRQAVSFGAYKVGAAIQKIDDWWLDEGAEYPLRVSEYGADRSRVLAMREPVTKKDFYSLLNEITNITEEMIKTRQASPNAHYVMSVLVKGGMFQKGIKKGEK

SEQ ID NO: 10126 - protein, 99 aa, Subdoligranulum sp. 4_3_54A2FAA; identical to SEQ ID NO: 10063

SEQ ID NO: 10127 - protein, 315 aa, Anaeroglobus geminatus F0357
MTKKKDGVASVLAFEKKLVFSDGYMYGTTWEERESKASPIKLMEKAVRGTISNRLKKAITDDPVKLNAEVEKANLQLVDAAALDLAQDTLKLVFTLKILPGIEFPSACNDKTHQENIYKMVISYIENYGFDILAKRYAINIANARFLWRNRVGAEKIETCIRVLNNSSQEWKFDSYNFQLNDFDVRISNLSELAEIIAKTLSGKNETVLLEVTSYAKVGKGQEIYPSEELVLDKGRGRKSKILYSIDGIAAMHSQKLGNAVRTIDTWYPECESNEGRAIAVETYGAVTNLGCAYRRTSDKKDFYTLFDKQSKVES

SEQ ID NO: 10128 - protein, 341 aa, Hafnia alvei ATCC 51873
MAIKTASVLAFERKLANSDAFMFAGRWDDINSGVWQPIHVQEKAVRGTISNRQPEAKIQNANLQLVDVAALPMDADTLKVTFTLRVLGNLSTPSACNDQEYQVALQNVIEGYISEHGFTELAARYAVNLANGRFLWRNRVGAEAIKVHISSGEQRWTFDAQHYSLREFRQPDGDLQALAQVIESGLRGDSFALLTVEAFVQLGAGQEVFPSQELLQSSDNNNKSDKSHKSDKSDHDSKSKKSKVLYQVSDVAAMHSQKIGNALRTIDTWHPMVDSLGAIAVEPYGSVTNRGVACRQPKEKMDFYTLLDKWVIKGDKPAVEQQHYVMAVLIRGGVFGGGKDD

SEQ ID NO: 10129 - protein, 333 aa, Escherichia coli H397; identical to SEQ ID NO: 9875

SEQ ID NO: 10130 - protein, 99 aa, Erysipelotrichaceae bacterium 6_1_45
MMEYIKLFGEDAPEGEPSVILYEVDTENERLALRSIDIFADGRTRNIPDLYDGAIEITPIPTVEELNAHVWGEEFHACVIEQAEFEAAWESHTYDGALK

SEQ ID NO: 10131 - protein, 333 aa, Escherichia coli SCI-07; identical to SEQ ID NO: 9995

SEQ ID NO: 10132 - protein, 390 aa, Thiorhodovibrio sp. 970
MTTLLPPIFTKLPGVISIQRCLAISDGLFYSRKADGAEEPVMVIRHGIRGTQNVAEGKTKKGKAKAGETSAEQRMLFEQSNEPAAVDSTTKEAARDVSNIQITESAKIDADTTRLVVRFGLRYIDLEESIFAVAGAKGQDVAEVRQYRESAENFIARAKSSEGLRHVAERMARNIVNGRWLWRNRTMANGITIAVSDNDKNLLGFADALTVPLNNFDNVSDLEQKIAERIVSGLQGETDCAMVVTADVDLGILGGVEVFPSQNYLDSKPKGFARPLYFVSPVDPARTDRLIHLDTVRPMGHAALRDQKLSNALRTIDTWYPSFSHHQRPIPVEPMGANLDAQDFFRDKKTSAFEYARRFNELEPNSPEGQFMIAILIRGGVLSGQKDGEA

SEQ ID NO: 10133 - protein, 343 aa, Methylomicrobium album BG8
MAKNSIVSASVLAFEKKLVPSDGRLYGTTWERRAEQATSLKLQEKSVRGTISNRLKKALQDDPAKLDAEVEKPNLQTVDSCALGSDQDTLKLTFTLKILSGVEKPSACNSAEFNASYAKSAKAYIDSEGFRDLALRYAANIANGRFLWRNRVGTEKIEVAVKVLNQGDRSAWLFDAKAVSTRYFDNPDPQIAELAGKIADALSGKTEFLLLEVNAYAQVGLAQDVYPSEELVLDKGSSKSKKSKILYEIDGIAGMHSQKIGNALRTIDTWYPGYDEAQIGPIAIEPYGAVTNLGKAYRTPKDKADFYTLFDRFARGEKLAENDEHYVMAVLVRGGVFGESGKD

SEQ ID NO: 10134 - protein, 342 aa, Pseudomonas aeruginosa PADK2_CF510; identical to SEQ ID NO: 9958

SEQ ID NO: 10135 - protein, 334 aa, gamma proteobacterium BDW918
MTLTTATVLAFERNLDISDALFSQVDSAVSAAQFRPVKIQTKSVRGTISNRLKSAIANDPVKLDAEIEKPNLQTVDVASLDHDCDTLVVKWSCKVLPFTGKPSVCNDQAYQAKLQGVVQGYLQESGVAELSRRYATNIANSRWLWRNRLGAESIRLTVSLSPDGAGTIAVIEDAKQLSLTDFSQNNNAVSELATRIEQGLKGDAFVILYIKAEAKVGYGQEVYPSQELILDTGKEKSKVLYQKNDIAGMHSQKISNAIRTIDNWYPDAQFPVAAEPYGAVTTLGTAFRQPKQKQDFYSLFDNWVLKDSVPSVEQQHYVMAVLIRGGVFGASGKE

SEQ ID NO: 10136 - protein, 345 aa, Cellvibrio sp. BR
MAKNKNSIASVLSFEKKLVPSDGYMFGTTWDKRNEFTALTLTEKSVRGTISNRLKPAVQNDPLKLNAEVEKPNLQRVDTCSLLPEQDTLKLQFTLKILGGVQKPSACNSSEFKQSYRAAVAGYIEEHGFAELAKRYATNIANARFLWRNRLGAEHIIVQVKALNENAQQSWEFDATKVPLRDFSVQDEKINSLAKRIAEVLVSEDQFLMLEVTCFAKVGKAQEVYPSEELVLDKSNSKEKKSKILYSNNGIAAMHTQKIGNALRTIDTWYADFSNPEQSAGPIAVEPYGAVTNLGKAFRTPKDKQDFYTFFDSFALGEKLARVEDEHYVMATLIRGGVFGASDKE

SEQ ID NO: 10137 - protein, 333 aa, Escherichia coli KD1; identical to SEQ ID NO: 9930

SEQ ID NO: 10138 - protein, 333 aa, Escherichia coli HM605; identical to SEQ ID NO: 9875

SEQ ID NO: 10139 - protein, 342 aa, Rhodanobacter sp. 115
MANELKTASVLAFERKFDPSDALLSSGNWATREASQDWAPIALREKSVRGTISNRLPAKDQDPLKLNAKIESPNLQTVDVATLPADADTLKVQFTLRVLGGTGQPSACNDAAYRQKLLATVGSYVQQHGFAELAKRYAANLANGRFLWRNRIGAEQVEVTVAQIKDGKAAASWTFNALAHDMNALVASGTEQANVQALADVIAAGLGGTSHVLLQITAFVRVGAGQEVFPSQELILDKGSSKKSKTLYDVGGVAAMHSQKIGNALRTIDTWYPEASVNGPIAVEPYGSVTTQGRAYRQPKEKQDFYNLLDGWVIKDKVPDADQQHFVMATLIRGGVFGDADK

SEQ ID NO: 10140 - protein, 334 aa, Yersinia pestis PY-01; identical to SEQ ID NO: 55

SEQ ID NO: 10141 - protein, 334 aa, Yersinia pestis PY-02; identical to SEQ ID NO: 55

SEQ ID NO: 10142 - protein, 334 aa, Yersinia pestis PY-03; identical to SEQ ID NO: 55

SEQ ID NO: 10143 - protein, 334 aa, Yersinia pestis PY-04; identical to SEQ ID NO: 55

SEQ ID NO: 10144 - protein, 334 aa, Yersinia pestis PY-05; identical to SEQ ID NO: 55

SEQ ID NO: 10145 - protein, 334 aa, Yersinia pestis PY-06; identical to SEQ ID NO: 55

SEQ ID NO: 10146 - protein, 334 aa, Yersinia pestis PY-07; identical to SEQ ID NO: 55

SEQ ID NO: 10147 - protein, 334 aa, Yersinia pestis PY-08; identical to SEQ ID NO: 55

SEQ ID NO: 10148 - protein, 334 aa, Yersinia pestis PY-09; identical to SEQ ID NO: 55

SEQ ID NO: 10149 - protein, 334 aa, Yersinia pestis PY-10; identical to SEQ ID NO: 55

SEQ ID NO: 10150 - protein, 334 aa, Yersinia pestis PY-11; identical to SEQ ID NO: 55

SEQ ID NO: 10151 - protein, 334 aa, Yersinia pestis PY-12; identical to SEQ ID NO: 55

SEQ ID NO: 10152 - protein, 334 aa, Yersinia pestis PY-13; identical to SEQ ID NO: 55

SEQ ID NO: 10153 - protein, 334 aa, Yersinia pestis PY-15; identical to SEQ ID NO: 55

SEQ ID NO: 10154 - protein, 334 aa, Yersinia pestis PY-14; identical to SEQ ID NO: 55

SEQ ID NO: 10155 - protein, 334 aa, Yersinia pestis PY-16; identical to SEQ ID NO: 55

SEQ ID NO: 10156 - protein, 334 aa, Yersinia pestis PY-19; identical to SEQ ID NO: 55

SEQ ID NO: 10157 - protein, 334 aa, Yersinia pestis PY-25; identical to SEQ ID NO: 55

SEQ ID NO: 10158 - protein, 334 aa, Yersinia pestis PY-29; identical to SEQ ID NO: 55

SEQ ID NO: 10159 - protein, 334 aa, Yersinia pestis PY-34; identical to SEQ ID NO: 55

SEQ ID NO: 10160 - protein, 334 aa, Yersinia pestis PY-32; identical to SEQ ID NO: 55

SEQ ID NO: 10161 - protein, 334 aa, Yersinia pestis PY-36; identical to SEQ ID NO: 55

SEQ ID NO: 10162 - protein, 334 aa, Yersinia pestis PY-42; identical to SEQ ID NO: 55

SEQ ID NO: 10163 - protein, 334 aa, Yersinia pestis PY-45; identical to SEQ ID NO: 55

SEQ ID NO: 10164 - protein, 334 aa, Yersinia pestis PY-46; identical to SEQ ID NO: 55

SEQ ID NO: 10165 - protein, 334 aa, Yersinia pestis PY-47; identical to SEQ ID NO: 55

SEQ ID NO: 10166 - protein, 334 aa, Yersinia pestis PY-48; identical to SEQ ID NO: 55

SEQ ID NO: 10167 - protein, 334 aa, Yersinia pestis PY-52; identical to SEQ ID NO: 55

SEQ ID NO: 10168 - protein, 334 aa, Yersinia pestis PY-53; identical to SEQ ID NO: 55

SEQ ID NO: 10169 - protein, 334 aa, Yersinia pestis PY-54; identical to SEQ ID NO: 55

SEQ ID NO: 10170 - protein, 334 aa, Yersinia pestis PY-55; identical to SEQ ID NO: 55

SEQ ID NO: 10171 - protein, 334 aa, Yersinia pestis PY-56; identical to SEQ ID NO: 55

SEQ ID NO: 10172 - protein, 334 aa, Yersinia pestis PY-58; identical to SEQ ID NO: 55

SEQ ID NO: 10173 - protein, 334 aa, Yersinia pestis PY-60; identical to SEQ ID NO: 55

SEQ ID NO: 10174 - protein, 334 aa, Yersinia pestis PY-59; identical to SEQ ID NO: 55

SEQ ID NO: 10175 - protein, 334 aa, Yersinia pestis PY-61; identical to SEQ ID NO: 55

SEQ ID NO: 10176 - protein, 334 aa, Yersinia pestis PY-63; identical to SEQ ID NO: 55

SEQ ID NO: 10177 - protein, 334 aa, Yersinia pestis PY-64; identical to SEQ ID NO: 55

SEQ ID NO: 10178 - protein, 334 aa, Yersinia pestis PY-65; identical to SEQ ID NO: 55

SEQ ID NO: 10179 - protein, 334 aa, Yersinia pestis PY-66; identical to SEQ ID NO: 55

SEQ ID NO: 10180 - protein, 334 aa, Yersinia pestis PY-71; identical to SEQ ID NO: 55

SEQ ID NO: 10181 - protein, 334 aa, Yersinia pestis PY-72; identical to SEQ ID NO: 55

SEQ ID NO: 10182 - protein, 334 aa, Yersinia pestis PY-76; identical to SEQ ID NO: 55

SEQ ID NO: 10183 - protein, 334 aa, Yersinia pestis PY-88; identical to SEQ ID NO: 55

SEQ ID NO: 10184 - protein, 334 aa, Yersinia pestis PY-89; identical to SEQ ID NO: 55

SEQ ID NO: 10185 - protein, 334 aa, Yersinia pestis PY-90; identical to SEQ ID NO: 55

SEQ ID NO: 10186 - protein, 334 aa, Yersinia pestis PY-91; identical to SEQ ID NO: 55

SEQ ID NO: 10187 - protein, 334 aa, Yersinia pestis PY-93; identical to SEQ ID NO: 55

SEQ ID NO: 10188 - protein, 334 aa, Yersinia pestis PY-92; identical to SEQ ID NO: 55

SEQ ID NO: 10189 - protein, 334 aa, Yersinia pestis PY-94; identical to SEQ ID NO: 55

SEQ ID NO: 10190 - protein, 334 aa, Yersinia pestis PY-95; identical to SEQ ID NO: 55

SEQ ID NO: 10191 - protein, 334 aa, Yersinia pestis PY-96; identical to SEQ ID NO: 55

SEQ ID NO: 10192 - protein, 334 aa, Yersinia pestis PY-98; identical to SEQ ID NO: 55

SEQ ID NO: 10193 - protein, 334 aa, Yersinia pestis PY-100; identical to SEQ ID NO: 55

SEQ ID NO: 10194 - protein, 334 aa, Yersinia pestis PY-101; identical to SEQ ID NO: 55

SEQ ID NO: 10195 - protein, 334 aa, Yersinia pestis PY-102; identical to SEQ ID NO: 55

SEQ ID NO: 10196 - protein, 334 aa, Yersinia pestis PY-103; identical to SEQ ID NO: 55

SEQ ID NO: 10197 - protein, 334 aa, Yersinia pestis PY-113; identical to SEQ ID NO: 55

SEQ ID NO: 10198 - protein, 96 aa, Bacteroides cellulosilyticus CL02T12C19; identical to SEQ ID NO: 9887

SEQ ID NO: 10199 - protein, 337 aa, Acinetobacter baumannii OIFC143; identical to SEQ ID NO: 10015

SEQ ID NO: 10200 - protein, 352 aa, Vibrio cholerae HE-45
MKLPTNLAYERSIDPSDVCFFVVWPDDRKTPLTYNSRTLLGQMEAASLAYDVSGQPIKSATAEALAQGNPHQVDFCHVPYGASHIECSFSVSFSSELRQPYKCNSSKVKQTLVQLVELYETKIGWTELATRYLMNICNGKWLWKNTRKAYCWNIVLTPWPWNGEKVGFEDIRTNYTSRQDFKNNKNWSAIVEMIKTAFSSTDGLAIFEVRATLHLPTNAMVRPSQVFTEKESGSKSKSKTQNSRVFQSTTIDGERSPILGAFKTGAAIATIDDWYPEATEPLRVGRFGVHREDVTCYRHPSTGKDFFSILQQAEHYIEVLSANKTPAQETINDMHFLMANLIKGGMFQHKGD

SEQ ID NO: 10201 - protein, 334 aa, Alishewanella aestuarii B11
MTTTLKTASVLAFEAKLANSDAIMASGNWEERANGNSFLPVAVKEKAVRGTISNRLKSALASDPAKVDAEVQKANLQTVDNAALPFEHDTLKVSFTLRIIGNLATPSTCNDPAYQQALANLINGYAEQTQFTELANRYAANIANGRFLWRNRVGAEAVEVQVTHGKELWIFDAQQFDLRSFAEPKGDLAKLAQVIKQGLAGESFALLKVSAFVKLGAGQAVYPSQELVMGGGKGDKSKFLYQLDGVAAMHSQKIGNALRTIDTWHPETAEVGAIAVEPYGSVTNRGKAYRQPKDNMDFYKLLDGWVLKGKTPPLEQQHYIMAMFIRGGVFGEAG

SEQ ID NO: 10202 - protein, 337 aa, Acinetobacter baumannii Canada BC-5; identical to SEQ ID NO: 9909

SEQ ID NO: 10203 - protein, 307 aa, Acinetobacter baumannii Naval-18
MAKNEKAVASVLAFEKKLVPSDGYFYGTSWGNRKEQTALKLIQKSVRGTISNRLKPAVAGDPMKLNAEVEKANLQTVDACALGEHQDTLKVGFTLKVLGGIENPSACNNEIFLKSYQSVANNYIQQYGFTELAKRYALNIANARFLWRNRVGAKKVEVVVTINDQPAVTFNALEYPLHDFDHIDEKVQNLANQIAQALKGETPYLLIKVEAYALVGKAQEVYPSEELVLDKGKGDKSKILYQVKDVAAMHSQKIGNALRTIDTWYPEFDEKKAAIAIEPYGAVTNLGKAYRTPKDKKDFLVYLINMH

SEQ ID NO: 10204 - protein, 335 aa, Pasteurella multocida subsp. multocida str. P52VAC
MSKLSTPSVLAFERNLDISDAIFAQKDSKNDKDAPVPLRIREKSVRGTISNRLKNTITNDPAKLDAETEKANLQRVDVATLDDDKDTLVATFSVKVLPFTGRPNVCNDQNYQQQVMATVAQYLSEQGMDELAKRYATNIANARWLWRNRMGAEKIKIEVTCGENTIHFDDAKQFSLNHFDHQDDKIHQIAKEIKQGLLGEKFVILYVTAYANMGYGQEVYPSQELVLDNSTNNRKSKILYEINQKAGMHSQKVGNAIRTIDTWYAEEVAFPIAAEPYGAVTTLGTAFRQPKTKKNDFYTLFDNWLLKGEVPPVEQQHYVMSVLIRGGVFGASGKE

SEQ ID NO: 10205 - protein, 177 aa, Pasteurella multocida subsp. multocida str. Anand1_buffalo
VTCGENTIHFDDAKQFSLNHFDHQDDKIHQIAKEIKQGLLGEKFVILYVTAYANMGYGQEVYPSQELVLDNSTNNRKSKILYEINQKAGMHSQKVGNAIRTIDTWYAEEVAFPIAAEPYGAVTTLGTAFRQPKTKKNDFYTLFDNWLLKGEVPPVEQQHYVMSVLIRGGVFGASGKE

SEQ ID NO: 10206 - protein, 180 aa, Pasteurella multocida subsp. multocida str. Anand1_cattle
EQGMDELAKRYATNIANARWLWRNRMGAEKIKIEVTCGENTIHFDDAKQFSLNHFDHQDDKIHQIAKEIKQGLLGEKFVILYVTAYANMGYGQEVYPSQELVLDNSTNNRKSKILYEINQKAGMHSQKVGNAIRTIDTWYAEEVAFPIAAEPYGAVDDIRYGFPSTENQKNDFYTLFDNW

SEQ ID NO: 10207 - protein, 52 aa, Pasteurella multocida subsp. multocida str. Anand1_cattle
MSKLSTPSVLAFERNLDISDAIFAQKDSKNDKDAPVPLRIRENPCEARSLIA

SEQ ID NO: 10208 - protein, 337 aa, Pectobacterium wasabiae CFBP 3304
MAKAATTLKTASVLAFERKLANSDALMYAGNWAQQDNWAAIAIQEKSVRGTISNRLKNALTSDPAKLDAEIQKANLQKVDVAALPFGADTLKVVFTLRVLGNLAHPSVCNDQDYQTALGDIITGYAQEQGFSTLAARYAENIANGRFLWRNRVGAEAIRVVVTKKGEQSWEFNGEDYSLRQFSQPTGDLAALALAIEEGLAGDASALFTVEAYVQLGNGQEIFPSQELVLDEKARNGKSKILYQVNAVAAIHSQKIGNALRTIDDWYPAADEAGPIAVEPYGSVTSRGKAYRQPKEKMDFYTLLDNWVIKGDAPMPEQQHYVIATLIRGGVFGEKSE

SEQ ID NO: 10209 - protein, 335 aa, Pasteurella multocida subsp. gallicida X73
MSKLSTPSVLAFERNLDISDAIFAQKDSKNDKDAPVPLRIREKSVRGTISNRLKNTITNDPAKLDAETEKANLQRVDVATLDDDKDTLVATFSVKVLPFTGRPNVCNDQDYQHQVMTTVAQYLSEQGMDELAKRYATNIANARWLWRNRMGAEKIKIEVTCGENTIHFDDAKQFSLNHFDHQDDKIHQIAKEIKQGLLGEKFVILYVTAYANMGYGQEVYPSQELVLDNSTNNRKSKILYEINQKAGMHSQKVGNAIRTIDTWYAEEVAFPIAAEPYGAVTTLGTAFRQPKTKKNDFYTLFDNWLLKGEVPPVEQQHYVMSVLIRGGVFGASGKE

SEQ ID NO: 10210 - protein, 342 aa, Pseudomonas aeruginosa CI27; identical to SEQ ID NO: 9879

SEQ ID NO: 10211 - protein, 342 aa, Pseudomonas aeruginosa E2
MSKPILSTASVLAFERKLDPSDALMSAGAWAQRDASQEWPAVTVREKSVRGTISNRLKTKDRDPAKLDASIQSPNLQTVDVANLPSDADTLKVRFTLRVLGGAGTPSACNDAAYRDKLLQTVATYVNEQGFAELARRYAHNLANARFLWRNRVGAEAVEVRINHIRQGEVARAWRFDALAIGLRDFKADAELDALAELIASGLSGSGHVLLEVVAFARIGDGQEVFPSQELILDKGDKKGQKSKTLYSVRDAAAIHSQKIGNALRTIDTWYPDEDGLGPIAVEPYGSVTSQGKAYRQPKQKLDFYTLLDNWVLRDEAPAVEQQHYVIANLIRGGVFGEAEEK

SEQ ID NO: 10212 - protein, 335 aa, Pasteurella multocida subsp. gallicida P1059
MSKLSRPSVLAFERRLDVSDAIFWQKNGQNDECSPVEVREKYLKGTKSHELTSLKEAKDANLQQVDVATLDHDKDILVATFSLKVLPVKGEPCVCNDEIYKQKVVEKVQQYINEKAFRELALRYATNIANARWLWRNRMGAEKIKIEVKFGDKTINFDDAKQFSLNDFNQQNSKINEIAEEIRKGLLGDTFIILYITAYAHMGYGQEVYPSQEFVQKDKMDKTSKENEAPKSKVLYRVKQNAGMHSQKVGNALRTIDTWYSDDVLFPIPVEPYGTMTSQACAFRETEDTHFYDLFDKWICKDEQLNDNEQHYVISMLIRGGVFGSTKKKSKGKSS

SEQ ID NO: 10213 - protein, 337 aa, Acinetobacter baumannii IS-58; identical to SEQ ID NO: 9909

SEQ ID NO: 10214 - protein, 96 aa, Bacteroides fragilis HMW 616; identical to SEQ ID NO: 9887

SEQ ID NO: 10215 - protein, 96 aa, Bacteroides fragilis HMW 615
MKTCRKDFQGRKSTAVLKLLCRNIAAGRFNWRRYCTPQTYFGQEICVTPLHCSYGQIGYTVHFPYSNMPEVEYDWEMGKLTVDEENWKEYFRHSEQ

SEQ ID NO: 10216 - protein, 96 aa, Bacteroides fragilis HMW 610; identical to SEQ ID NO: 9887

SEQ ID NO: 10217 - protein, 335 aa, Moraxella catarrhalis RH4; identical to SEQ ID NO: 10095

SEQ ID NO: 10218 - protein, 343 aa, Vibrio cholerae HC-50A1; identical to SEQ ID NO: 10113

SEQ ID NO: 10219 - protein, 343 aa, Vibrio cholerae HC-52A1; identical to SEQ ID NO: 10113

SEQ ID NO: 10220 - protein, 343 aa, Vibrio cholerae HC-56A1; identical to SEQ ID NO: 10113

SEQ ID NO: 10221 - protein, 343 aa, Vibrio cholerae HC-55A1; identical to SEQ ID NO: 10113

SEQ ID NO: 10222 - protein, 343 aa, Vibrio cholerae HC-57A1; identical to SEQ ID NO: 10113

SEQ ID NO: 10223 - protein, 343 aa, Vibrio cholerae HC-51A1; identical to SEQ ID NO: 10113

SEQ ID NO: 10224 - protein, 337 aa, Acinetobacter baumannii IS-235; identical to SEQ ID NO: 9909

SEQ ID NO: 10225 - protein, 337 aa, Acinetobacter baumannii IS-251; identical to SEQ ID NO: 9909

SEQ ID NO: 10226 - protein, 343 aa, Vibrio cholerae HC-1A2; identical to SEQ ID NO: 10113

SEQ ID NO: 10227 - protein, 343 aa, Vibrio cholerae HC-55C2; identical to SEQ ID NO: 10113

SEQ ID NO: 10228 - protein, 343 aa, Vibrio cholerae HC-60A1; identical to SEQ ID NO: 10113

SEQ ID NO: 10229 - protein, 343 aa, Vibrio cholerae HC-59A1; identical to SEQ ID NO: 10113

SEQ ID NO: 10230 - protein, 343 aa, Vibrio cholerae HC-61A2; identical to SEQ ID NO: 10113

SEQ ID NO: 10231 - protein, 337 aa, Acinetobacter baumannii OIFC074; identical to SEQ ID NO: 9909

SEQ ID NO: 10232 - protein, 337 aa, Acinetobacter baumannii Naval-83; identical to SEQ ID NO: 9909

SEQ ID NO: 10233 - protein, 343 aa, Vibrio cholerae HC-02C1; identical to SEQ ID NO: 10113

SEQ ID NO: 10234 - protein, 343 aa, Vibrio cholerae HC-55B2; identical to SEQ ID NO: 10113

SEQ ID NO: 10235 - protein, 343 aa, Vibrio cholerae HC-59B1; identical to SEQ ID NO: 10113

SEQ ID NO: 10236 - protein, 78 aa, Acinetobacter baumannii Naval-82
MWIEQKFYSKEKKAAIAIEPYGAVTNLGKAYRTPKDKKDFFSLFDKYALGESLENPEQEHYVMAVLVRGGVFGQSGKE

SEQ ID NO: 10237 - protein, 337 aa, Acinetobacter baumannii Naval-21; identical to SEQ ID NO: 9909

SEQ ID NO: 10238 - protein, 337 aa, Acinetobacter baumannii Canada BC1; identical to SEQ ID NO: 9909

SEQ ID NO: 10239 - protein, 334 aa, Yersinia pestis INS; identical to SEQ ID NO: 55

SEQ ID NO: 10240 - protein, 343 aa, Providencia burhodogranariea DSM 19968
MAKKDDVASVLAFEKKLVPSDGYFYGTSWENKAQFTPLALQEKSVRGTISNRLKGPVKNDPLKLNAEVEKANLQTVDACALGPQQDTLKHQFTLKVLGGVESPSACNNALFKESYSKAAKEYIEKEGFRELGRRYAHNIANARFLWRNRVGAEKIEVIVKILNTGQEQQWTFDATQYSIRSFDQQDEKVLTLGDKIAAALANSQGALLLEITTYALLGQAQEVYPSEELVLDKSKGKGSKSKILYHVNGHAAMHSQKVGNALRSIDTWYPAYDDEINSAGAIAIEPYGAVTNLGTAYRTPSAKQDFYTYFDKWARGDKLARIEDEHYVMAVLVRGGVFGESDK

SEQ ID NO: 10241 - protein, 353 aa, Acinetobacter sp. WC-323
MTIFKKLPGSLSLQRGTVVSDGAFFNLFEDGKQEPLHVMYHGIRGTQNVAGNKEKGAATGNSLAREVTNIQLTESAKLQPKAKLLVKWDFRFIDLSYVLFASASKAGADKSEEYNFRQAFLNFVNRAKESDGLKEVVRRYVRNIVNGRWLWRNRIVAESITIQVTAQDHPETLSFDALSYNLKSFDQPSEQEQKLADILLKGITGESTSAALHIEAIVDFGMGGVEVFPSQNYLEDKPKGFSRSLYQLTPKRPDHKANDNQYLGQAALRDQKIGNALRTIDTWYPQFKENDEKPIAVEPNGANLEGQIFYRVGKDKVSAFDILKEIDELDPNSEKGMFLIACLIRGGVYSEGE

SEQ ID NO: 10242 - protein, 336 aa, Aggregatibacter actinomycetemcomitans Y4; identical to SEQ ID NO: 9955

SEQ ID NO: 10243 - protein, 333 aa, Escherichia coli KTE4; identical to SEQ ID NO: 9875

SEQ ID NO: 10244 - protein, 333 aa, Escherichia coli KTE5; identical to SEQ ID NO: 9875

SEQ ID NO: 10245 - protein, 333 aa, Escherichia sp. KTE11
MAKAPVAIKTASVLAFERKLATADAAMYAGNWQGNEWQPIEIQEKAVRGTISNRLKDAISSNELKLNAEIQKANLQRVDVAALPVDADTLKVMFTLRVLGNLSSPSVCNDMAYQEALSDVIDGYISEHGFKELALRYALNLANGRFLWRNRIGAEQIQVKVTANDSSWTFNSHDFSLRQFDQGQSSVTELATIIEQGLSGKEWVMLTVEAQVRLGAGQEVFPSQELVLDSNSSKSRVLYQVAGIAGIHSQKIGNALRTIDTWHPKVDELGAIAVEPYGSVTSRGVACRQPKEKLDFYTLLDNWVTKGMKPDVDQQHYVMAVLIRGGVFGEKAE

SEQ ID NO: 10246 - protein, 333 aa, Escherichia coli KTE16; identical to SEQ ID NO: 9930

SEQ ID NO: 10247 - protein, 333 aa, Escherichia coli KTE15; identical to SEQ ID NO: 9930

SEQ ID NO: 10248 - protein, 333 aa, Escherichia coli KTE224; identical to SEQ ID NO: 9930

SEQ ID NO: 10249 - protein, 333 aa, Escherichia coli KTE47; identical to SEQ ID NO: 9995

SEQ ID NO: 10250 - protein, 333 aa, Escherichia coli KTE55; identical to SEQ ID NO: 9875

SEQ ID NO: 10251 - protein, 333 aa, Escherichia coli KTE58; identical to SEQ ID NO: 9875

SEQ ID NO: 10252 - protein, 333 aa, Escherichia coli KTE62; identical to SEQ ID NO: 9875

SEQ ID NO: 10253 - protein, 333 aa, Escherichia coli KTE72; identical to SEQ ID NO: 9930

SEQ ID NO: 10254 - protein, 333 aa, Escherichia coli KTE86; identical to SEQ ID NO: 9930

SEQ ID NO: 10255 - protein, 333 aa, Escherichia coli KTE93; identical to SEQ ID NO: 9930

SEQ ID NO: 10256 - protein, 333 aa, Escherichia coli KTE169; identical to SEQ ID NO: 9930

SEQ ID NO: 10257 - protein, 333 aa, Escherichia coli KTE45; identical to SEQ ID NO: 9995

SEQ ID NO: 10258 - protein, 333 aa, Escherichia coli KTE43; identical to SEQ ID NO: 9930

SEQ ID NO: 10259 - protein, 333 aa, Escherichia coli KTE22; identical to SEQ ID NO: 9875

SEQ ID NO: 10260 - protein, 333 aa, Escherichia coli KTE46; identical to SEQ ID NO: 9995

SEQ ID NO: 10261 - protein, 333 aa, Escherichia coli KTE59; identical to SEQ ID NO: 9875

SEQ ID NO: 10262 - protein, 333 aa, Escherichia coli KTE65; identical to SEQ ID NO: 9875

SEQ ID NO: 10263 - protein, 333 aa, Escherichia coli KTE118; identical to SEQ ID NO: 9875

SEQ ID NO: 10264 - protein, 333 aa, Escherichia coli KTE123; identical to SEQ ID NO: 9875

SEQ ID NO: 10265 - protein, 333 aa, Escherichia coli KTE194; identical to SEQ ID NO: 9930

SEQ ID NO: 10266 - protein, 333 aa, Escherichia coli KTE183; identical to SEQ ID NO: 9930

SEQ ID NO: 10267 - protein, 333 aa, Escherichia coli KTE207; identical to SEQ ID NO: 9930

SEQ ID NO: 10268 - protein, 333 aa, Escherichia coli KTE215; identical to SEQ ID NO: 9930

SEQ ID NO: 10269 - protein, 333 aa, Escherichia coli KTE227; identical to SEQ ID NO: 9875

SEQ ID NO: 10270 - protein, 333 aa, Escherichia coli KTE229; identical to SEQ ID NO: 9875

SEQ ID NO: 10271 - protein, 333 aa, Escherichia coli KTE113; identical to SEQ ID NO: 9930

SEQ ID NO: 10272 - protein, 333 aa, Escherichia coli KTE133; identical to SEQ ID NO: 9930

SEQ ID NO: 10273 - protein, 333 aa, Escherichia coli KTE145; identical to SEQ ID NO: 9930

SEQ ID NO: 10274 - protein, 333 aa, Escherichia coli KTE168; identical to SEQ ID NO: 9930

SEQ ID NO: 10275 - protein, 333 aa, Escherichia coli KTE176; identical to SEQ ID NO: 9875

SEQ ID NO: 10276 - protein, 333 aa, Escherichia coli KTE179; identical to SEQ ID NO: 9875

SEQ ID NO: 10277 - protein, 333 aa, Escherichia coli KTE180; identical to SEQ ID NO: 9875

SEQ ID NO: 10278 - protein, 333 aa, Escherichia coli KTE88; identical to SEQ ID NO: 9930

SEQ ID NO: 10279 - protein, 45 aa, Pyricularia oryzae Y34
MCQMVFVRTYLQVRCNDEDVAAQPLCLMRRQRTGAAIRAHSLKTP

SEQ ID NO: 10280 - protein, 45 aa, Pyricularia oryzae P131; identical to SEQ ID NO: 10279

SEQ ID NO: 10281 - protein, 343 aa, Vibrio cholerae HC-78A1; identical to SEQ ID NO: 10113

SEQ ID NO: 10282 - protein, 295 aa, Aggregatibacter actinomycetemcomitans serotype a str. A160
MRKLTTPTVLAFERNLDISDAVFTQFNSQDKNPVEEEVKIREKSVRGTISNRLKNTITNDPTKLDAEIQKTNLQRVDVATLNDKNDILVARFTCKVLPFDGKPCVCNDQDYQSKIIGVVESYIKTQGFSELAKRYATNIANARWLWRNRMSAETIKIEVSFNGETLTFDNAKALSLNTFDDSSTQLQVLTGHIEDGLSGKHFVILNITAYVKMGYGQEVYPSQELVLDAGANNRKSKVLYKLDDSGKAAMHSQKVSNAIRTIDTWYKSNAEFPIATEPYGAVTTLGTAFRQPKEN

SEQ ID NO: 10283 - protein, 343 aa, Vibrio campbellii CAIM 519 = NBRC 15631
MELCTQLNYVRSLSAGKAYFYYLSKSGEMCPLEIDRTRLRAPKGGYAEAYKGSKFVEKNVAPQDLAHSNPQFIEECYVKPGIDDIYCAFPLRIRANSLTPDTCSDDEVRSKLSLLANTYKELNGYQELAHRYAKNILLGTWLWRNRECRKLSIEVTTSDSQTLIVENATKLSWYGHWDEASAECLEKLTAYLMRALSDPTEYFYMDVKAKIGVGWGDEVYPSQEFLDDREDSAPTKQLATVELFNGKETVAFHGQKIGAALQSIDDWWHEEADKPLRVNEYGADREYVIARRHVSYGNDFYQLVRNTENWIETMIASQTIPNDVHFIMSVLIKGGLFNCSKAK

SEQ ID NO: 10284 - protein, 353 aa, Acinetobacter baumannii Naval-57; identical to SEQ ID NO: 10054

SEQ ID NO: 10285 - protein, 349 aa, Halomonas titanicae BH1
MMNSFRHLSYERSLNPGKAVFYYRTDSSEFEPLQAEVTRFRGPKATFSDGYMASGTARAKETSDLGFSNLIMLEACYVPPLVDTVYCRFSLRIIANSLEPNISDNAEATKALREFSDTYRSLGGYYELATRYAKNILSAEWLWRNKVARGVVVEVSTSNLKNYCVKDVQYKEWGSSWGGDDLKSLEGLAAELEEALSCPQKFLFADVTAKIKTEFCQEIFPSQLFVEKDDRGNESAARQFVKSTMSDGRQAVSFGAYKVGAAIQKIDDWWLTEGAEYPLRVSEYGTDRSRVLAMREPTTKRDFYSLLDEIISMTEEMNKSKQPSYSAHYLMSVLVKGGMFQKGIKKGEK

SEQ ID NO: 10286 - protein, 353 aa, Acinetobacter baumannii MSP4-16; identical to SEQ ID NO: 10054

SEQ ID NO: 10287 - protein, 333 aa, Rhodopirellula maiorica SM1
MLAFERKLAPSDARMYSTTWEQRNDDNEQPLCLVEKSVRGTISNRLKTGKGDDPAKIDAGMKSPNLQKVDACSLPEEHDTLIVRFSLKVHSNLGDPTACNSAEFRESLLSQVNAYLQETEAEELGKRYATNLANGRFLWRNRVGAEEVEINVKALAGTDDQHWDFDAMSIPLNNFDIDVAEVASLGHQIAQTLRGEKDFLLLQVTAKVKVGSAQEVFPSQEIVQDAPSGKGAKSKFLYSVGGIAAMHSQKVGNAIRTIDTWYSDDAEKPIAVEAYGAVTTEGKAYRDGSMAPHFYKLFDSWSIGKEVDSEQRHYLMAMLVRGGVFGQSEKESS

SEQ ID NO: 10288 - protein, 338 aa, Morganella morganii SC01
MTGLRNIPSVLSFSKKLIPSDGIFSGTSQHPDSRVTPLTIQTRTVRGTFAFRRKNGRGNEKISGQNINDPNIQYMDYCMLEAEQNVIIFSFSLKITGGLKYPAACNNEIFRQRYQAVITDYLEREHCREPARRYAHNIACGRFLWRNLVGAEHIEVVVDNLSAEKKQQWIFDARKYSLRHFEQTDNIAGDLGRHIAAALSCDDGALLLAVSARVITGKGQEIYPSCEFVMNKRKGGSSRILCHIDGTAGMHSQKIGNALRSVDTWYPAFSDLTAGVGVIAADPYGAVTHLGAVFRPPGSGQDFYTLFEKWVSGKKLAEHEENYVVAVLIRGGVFGGGG

SEQ ID NO: 10289 - protein, 337 aa, Acinetobacter baumannii ABNIH6; identical to SEQ ID NO: 9909

SEQ ID NO: 10290 - protein, 72 aa, Acinetobacter baumannii ABNIH7
MAKNEKAVASVLAFEKKLVPSDGYFYGTSWGNRKEQTALKLIQKSVRGTISNRLKPAVAGDPMKLNAEVEKA

SEQ ID NO: 10291 - protein, 33 aa, Acinetobacter baumannii ABNIH11
MAKNEKAVASVLAFEKKLVPSDGYFYGTSWGNR

SEQ ID NO: 10292 - protein, 156 aa, Acinetobacter baumannii ABNIH10
HIDEKVQNLANQIAQALKGETPYLLIKVEAYALVGKAQEVYPSEELVLDKGKGDKSKILYQVKDVAAMHSQKIGNALRTIDTWYPEFDEKKAAIAIEPYGAVTNLGKAYRTPKDKKDFFSLFDKYALGESLENPEQEHYVMAVLVRGGVFGQSGKE

SEQ ID NO: 10293 - protein, 304 aa, Acinetobacter baumannii ABNIH11
KEQTALKLIQKSVRGTISNRLKPAVAGDPMKLNAEVEKANLQTVDACALGEHQDTLKVGFTLKVLGGIENPSACNNEIFLKSYQSVANNYIQQYGFTELAKRYALNIANARFLWRNRVGAEKVEVVVTINDQPAVTFNALEYPLHDFDHIDEKVQNLANQIAQALKGETPYLLIKVEAYALVGKAQEVYPSEELVLDKGKGDKSKILYQVKDVAAMHSQKIGNALRTIDTWYPEFDEKKAAIAIEPYGAVTNLGKAYRTPKDKKDFFSLFDKYALGESLENPEQEHYVMAVLVRGGVFGQSGKE

SEQ ID NO: 10294 - protein, 247 aa, Acinetobacter baumannii ABNIH7
VGFTLKVLGGIENPSACNNEIFLKSYQSVANNYIQQYGFTELAKRYALNIANARFLWRNRVGAEKVEVVVTINDQPAVTFNALEYPLHDFDHIDEKVQNLANQIAQALKGETPYLLIKVEAYALVGKAQEVYPSEELVLDKGKGDKSKILYQVKDVAAMHSQKIGNALRTIDTWYPEFDEKKAAIAIEPYGAVTNLGKAYRTPKDKKDFFSLFDKYALGESLENPEQEHYVMAVLVRGGVFGQSGKE

SEQ ID NO: 10295 - protein, 178 aa, Acinetobacter baumannii ABNIH10
MAKNEKAVASVLAFEKKLVPSDGYFYGTSWGNRKEQTALKLIQKSVRGTISNRLKPAVAGDPMKLNAEVEKANLQTVDACALGEHQDTLKVGFTLKVLGGIENPSACNNEIFLKSYQSVANNYIQQYGFTELAKRYALNIANARFLWRNRVGAEKVEVVVTINDQPAVTFNALEYPLH

SEQ ID NO: 10296 - protein, 337 aa, Acinetobacter baumannii ABNIH19; identical to SEQ ID NO: 9909

SEQ ID NO: 10297 - protein, 333 aa, Escherichia coli BCE034_MS-14; identical to SEQ ID NO: 10037

SEQ ID NO: 10298 - protein, 333 aa, Escherichia coli 2875000; identical to SEQ ID NO: 10037

SEQ ID NO: 10299 - protein, 333 aa, Escherichia coli 2872800; identical to SEQ ID NO: 10037

SEQ ID NO: 10300 - protein, 333 aa, Escherichia coli 2867750; identical to SEQ ID NO: 10037

SEQ ID NO: 10301 - protein, 333 aa, Escherichia coli 2866550; identical to SEQ ID NO: 10037

SEQ ID NO: 10302 - protein, 333 aa, Escherichia coli 2866450; identical to SEQ ID NO: 10037

SEQ ID NO: 10303 - protein, 333 aa, Escherichia coli 2866750
MAKAPVAIKTASVLAFERKLATSDAVMYAGNWQGNVWQPIEIQEKAVRGTISNRLKNTITSDSTKLDAEIQKANLQRVDVASLPVDADTLKVGFTLRVLGNLSTPSVCNDMAYQEALSGVIEGYISEHGFKELALRYALNLANGRFLWRNRIGAEQIQVKVTANDTFWTFNSHDFSLRQFDQGQAAVTQLAAIIEQGLSAKEWVMLTVEAQVRLGGGQEVFPSQELVLDSNSSKSRVLYQVAGIAGIHSQKIGNALRTIDTWHPKVDELGAIAVEPYGSVTSRGVACRQPKEKLDFYPLLDNWVTKGVKPDVDQQHYVMAVLIRGGVFGEKSE

SEQ ID NO: 10304 - protein, 333 aa, Escherichia coli 2851500
MAKAPVAIKTASVLAFERKLATSDAVMYAGNWQGNVWQPIEIQEKAVRGTISNRLKNTITSDSTKLDAEIQKANLQRVDVASLPVDADTLKVGFTLRVLGNLSTPSVCNDMAYQEALSGVIEGYISEHGFKELALRYALNLANGRFLWRNRIGAEQIQVKVTANDTFWTFNSHDFSLRQFDQGQAAVTQLAAIIEQGLSAKEWVMLTVEAQVRLGGGQEVFPSQELVLDSNSSKSRVLYQVAGIAGIHSQKIGNALRTIDTWHPKVDELGAIAVEPYGSVTSRGVACRQPKEKLDFYTLLDNWVTKGVKPDVDQQHYVMAVLIRGGVFGEKSE

SEQ ID NO: 10305 - protein, 333 aa, Escherichia coli 2853500; identical to SEQ ID NO: 10037

SEQ ID NO: 10306 - protein, 333 aa, Escherichia coli 2850750
MAKAPVAIKTASVLAFERKLATSDAVMYAGNWQGNVWQPIEIQEKAVRGTISNRLKNTITSDSTKLDAEIQKANLQRVDVASLPVDADTLKVVFTLRVLGNLSTPSVCNDMAYQEALSGVIEGYISEHGFKELALRYALNLANGRFLWRNRIGAEQIQVKVTANDTFWTFNSHDFSLRQFDQGQAAVTQLAAIIEQGLSAKEGVMLTVEAQVRLGGGQEVFPSQELVLDSNSSKSRVLYQVAGIAGIHSQKIGNALRTIDTWHPKVDELGAIAVEPYGSVTSRGVACRQPKEKLDFYTLLDNWVTKGVKPDVDQQHYVMAVLIRGGVFGEKSE

SEQ ID NO: 10307 - protein, 333 aa, Escherichia coli 2850400; identical to SEQ ID NO: 10037

SEQ ID NO: 10308 - protein, 333 aa, Escherichia coli 2848050; identical to SEQ ID NO: 10037

SEQ ID NO: 10309 - protein, 333 aa, Escherichia coli 2756500; identical to SEQ ID NO: 10037

SEQ ID NO: 10310 - protein, 333 aa, Escherichia coli Jurua 20/10; identical to SEQ ID NO: 10037

SEQ ID NO: 10311 - protein, 333 aa, Escherichia coli 2720900; identical to SEQ ID NO: 10037

SEQ ID NO: 10312 - protein, 342 aa, Pseudomonas sp. P179; identical to SEQ ID NO: 10211

SEQ ID NO: 10313 - protein, 333 aa, Escherichia coli 2735000
MAKAPVAIKTASVLAFERKLATSDAVMYAGNWQGNVWQPIEIQEKAVRGTISNRLKNTITSDSTKLDAEIQKANLQRVDVASLPVDADTLKVVFTLRVLGNLSTPSVCNDMAYQEALSGVIEGYISEHGFKELALRYALNLANGRFLWRNRIGAEQIQVKVTANDTFWTFNSHDFSLRQFDQGQAAVTQLAAIIEQGLSAKEWVMLTVEAQVRLGGGQEVFPSQELVLDSNSSKSRVLYQVAGIAGIHSQKIGNALRTIDTWHPKVDELGAIAVEPYGSVPSRGVACRQPKEKLDFYTLLDNWVTKGVKPDVDQQHYVMAVLIRGGVFGEKSE

SEQ ID NO: 10314 - protein, 333 aa, Escherichia coli 179550; identical to SEQ ID NO: 10037

SEQ ID NO: 10315 - protein, 333 aa, Escherichia coli 180200; identical to SEQ ID NO: 10037

SEQ ID NO: 10316 - protein, 339 aa, Thauera sp. 28
MTLKTASVLAFERKLDPSDALFYAGNWDQRDTANDWHAVSIREKSVRGTISNRLKTKDQDPAKLDAAIENPNLQTVDVAALPSSADTLKMVFTLRVLGGTGKPSACNDAEYLNKLLDTVRGYADTQGFGELGRRYAFNLANGRFLWRNRIGAEQVEVRIAHLVSGAPQDTWTFDALALPLRSFNAPAEATGALDSLARLITDGLAGQQHVLLQVTAFVRIGAGQEVFPSQELILDRGRGDKSKTLYHVSNIAGIHSQKIGNALRTIDTWYEGADEMGPIAIEPYGSVTTQGKAYRQPKQKLDFYNLLDNWIIKDQTPPVEQQHFVIATLVRGGVFGEAG

SEQ ID NO: 10317 - protein, 337 aa, Acinetobacter bohemicus ANC 3994
MAKNEKAVASVLAFEKKLVPSDGYFYGTSWDNRAEQTALKLIEKSVRGTISNRLKPAVAGDPMKLNAEVEKANLQKVDACSLGESQDTLKVSFSLKVLGGVEKPSACNNETFFKSYETVAKDYIQQYGFTELAKRYALNIANGRFLWRNRVGAEKVEVVVTANDQPSITFNAFEYSLHDFDTVDSQVQALADQIAAALKGELPYLLLKIEAYALVGKAQEVYPSEELVLDKGKGDKSKILYQVNDVAAMHSQKVGNALRTIDTWYPEFEDKQMAIAIEPYGAVTNLGKAYRTPKEKKDFFTLFDKYALGEKLENAEQEHYVMAVLVRGGVFGQSAKD

SEQ ID NO: 10318 - protein, 337 aa, Acinetobacter proteolyticus
MAKNEKAVASVLAFEKKLVPSDGYFYGTTWDNRNEQTALKLIPKSVRGTISNRLKPAVASDPLKLNAEVEKANLQTVDACALGEHQDTLKVGFTLKVLGGVENPSACNNEAFLNSYQAVAKNYINKYGFTELAKRYAFNIANARFLWRNRVGAEKVEVVVTINDQPAITFNALEYALHDFDHVDEKLKKLADQIAQALKGETVYLLIKVEAYALVGKAQEVYPSEELVLDKGKGDKSKILYQVNDVAAMHSQKIGNALRTIDTWYPEFDDKKTAIAIEPYGAVTNLGKAYRTPKEKKDFFTLFDKYALGESLENLEQEHYVMAVLVRGGVFGQSAKD

SEQ ID NO: 10319 - protein, 353 aa, Acinetobacter sp. NIPH 236
MTIFKKLPGSLSLQRGTVVSDGAFFNLFEDGKQEPLHVMYHGIRGTQNVAGNKEKGAATGNSLAREVTNIQLTESAKLQPKAKLLVKWDFRFIDLNYVLFASASKAGADKSEEYNFRQAFLNFVNRAKESDGLKEVVRRYVRNIVNGRWLWRNRIVAESITIQVTAQDHPETLSFDALSYNLKSFDQPSEQEQKLADILLKGITGESTSAALHIEAIVDFGMGGVEVFPSQNYLEEKPKGFSRSLYQLTPKRPDHKANDNQYLGQAALRDQKIGNALRTIDTWYPLFKENDEKPIAVEPNGANLEGQIFYRVGKDKVSAFDILKEIDELDPNSDKGMFLIACLIRGGVYSEGE

SEQ ID NO: 10320 - protein, 234 aa, Acinetobacter sp. CIP-A165
MAQLGALCISNLCATKPNSYIQQYGFTELAKRYALNIANARFLWRNRVGAEKVEVIVTVNDQPEVSFNALEYPLHDFDQVDEKVQNLANQIAQALRGEIPYLLIKIEAYALVGKAQEVYPSEELVLDKGKGDKSKILYHVNDVAAMHSQKIGNALRTVDTWYPEFDEKKTAIAIEPYGAVTNLGKAYRTPKDKKDFFSLFDKYALGESLENPEQEHYVMAVLVRGGVFGQSGKE

SEQ ID NO: 10321 - protein, 337 aa, Acinetobacter parvus DSM 16617 = CIP 108168
MAKNEKAVASVLAFEKKLVPSDGYFYGTSWENRNEQTPLKLIQKSVRGTISNRLKPVVAGDPMKLNAEVEKANLQTVDACALGENQDTLKVGFTLKVLGGVENPSACNNETFLKSYNDVAKNYIATYGFTELAKRYALNIANARFLWRNRVGAEKVEVVVTVNDQPTVTFNALEYPLHNFDQVDEKVQALANQIASALRGEVPYLLIKVEAYALVGKGQEVYPSEELVLDKGKGEKSKILYHVNDVAAMHSQKLGNALRTIDTWYPEFDEKKTAIAIEPYGAVTNLGKAYRTPKDKKDFFTLFDKYALGESLENPEQEHYVMAVLVRGGVFGQSSKD

SEQ ID NO: 10322 - protein, 340 aa, Acinetobacter lwoffii NIPH 715
MAKKPKVATDSAKVPSVLAFNRKIEPSDALMQSGLWSERANSTAWKNIDLHEKRNRGTKSQYGVDDAEKTDPNLVWGDDARIPFEADTLKVFFTVKFLGNIAEPTTHNRPDFEIKLKEKFATYQQDIGFLTLAKRYVQNLINARFLWRNRLGAENIALQIRNTDTNQIWNFENAYQHSLNNFDELEDKQAMEIAELVAKSFSEDNYLLLEVTAFAKVGEGQHIFPSQEFVDKPQKGQKSKYLYQIKTNQGMCAGIHSEKIGNAIRTIDDWYTIENSDSIKAPIAVEPYGSVPNRGQAYRISKTDFYTLLINWLENEEISKDDQHFVVANLIRGGVFGGND

SEQ ID NO: 10323 - protein, 337 aa, Acinetobacter baumannii NIPH 146; identical to SEQ ID NO: 10015

SEQ ID NO: 10324 - protein, 337 aa, Acinetobacter baumannii NIPH 615; identical to SEQ ID NO: 10015

SEQ ID NO: 10325 - protein, 346 aa, Acinetobacter sp. ANC 3789
MAKNDKLKTASVLSFNRHLDPSDGRMFAVNWADIAKDDVTTAILIQEKSVRGTISNRPKNSKEIDPAYIDAAVNKANLQTVDVAALPQGKDTVAVSFTLRVLPNVGQPSACNDVGFSERLSTVVSAYQTDNKFIELAKRYAVNLANGRFLWRNRIGAENVTVSVARIVDGQPKNTLNFDALSNRLNEITVHPDQQKQFDELSNWVQAGLNGDEHVLLKVTGFARLGEGQEVYPSQELILDTSNAKGAKSKTLYAVKDKEAGLHSQKIGNALRTIDTWYPDAEKPIAVEPYGSVTSEGKAYRQPKEKQDFYSLFDAWVNENKVPTIEQQHYVMSVLVRGGVFGESDK

SEQ ID NO: 10326 - protein, 337 aa, Acinetobacter sp. CIP 102159; identical to SEQ ID NO: 10321

SEQ ID NO: 10327 - protein, 337 aa, Acinetobacter sp. CIP 102129
MAKNEKAVVSVLAFEKKLVPSDGYFYGTNWDKRAEQTALKLIEKSVRGTVSHRLKSATDKDLLKLNMDIAQANPQTVDACALGEHQDTLKVGFTLKILGGVENPSACNNETFLKSYNDVAKNYITTYGFTELAKRYALNIANARFLWRNRVGAEKVDVVVTVNDQPTVTFNALEYPLHNFDQVDEKVQALANQIASALRGEVPYLLIKVEAYALVGKGQEVYPSEELVLDKGKGEKSKILYHVNDVAAMHSQKLGNALRTIDTWYPEFDEKKTAIAIEPYGAVTNLGKAYRTPKDKKDFFTLFDKYALGESLENPEQEHYVMAVLVRGGVFGQSSKD

SEQ ID NO: 10328 - protein, 337 aa, Acinetobacter sp. CIP 102529; identical to SEQ ID NO: 10321

SEQ ID NO: 10329 - protein, 353 aa, Acinetobacter sp. NIPH 758
MTIFKKLPGSLSLQRGTVVSDGAFFNLFEDGKQEPLHVMYHGIRGTQNVAGNKEKGAATGNSLAREVTNIQLTESAKLQPKAKLLVKWDFRFIDLSYVLFASASKAGADKTEEYNFRQAFLDFVNRAKESDGLKEVVRRYVRNIVNGRWLWRNRIVAESITIQVTAQDYPEAFSFDALSYNLKSFDQPSEQEQKLAEILLKGITGESTSAALHIEAIVDFGMGGVEVFPSQNYLEDKPKGFSRSLYQLTPKRPDHKANDNQYLGQAALRDQKIGNALRTIDTWYPLFKENDEKPIAVEPNGANLEGQIFYRVGKDKVSAFDILKEIDELDVNSEKGMFLIACLIRGGVYSEGE

SEQ ID NO: 10330 - protein, 337 aa, Acinetobacter sp. CIP 102082; identical to SEQ ID NO: 10321

SEQ ID NO: 10331 - protein, 337 aa, Acinetobacter sp. CIP 102637
MAKNEKAVASVLAFEKKLVPSDGYFYGTSWENRNEQTPLKLIPKSVRGTISNRLKPAVAGDPMKLNAEVEKANLQTVDACALGEHQDTLKVGFTLKVLGGIENPSACNNETFLNSYRSVAQNYIEKYGFTELAKRYALNIANARFLWRNRVGAEKVDVVVTVNDQATVTFNALEYPLHNFDQVDEKVQALANQIASALRGEVPYLLIKVEAYALVGKGQEVYPSEELVLDKGKGEKSKILYHVNDVAAMHSQKLGNALRTIDTWYPEFDEKKTAIAIEPYGAVTNLGKAYRTPKDKKDFFTLFDKYALGESLENPEQEHYVMAVLVRGGVFGQSSKD

SEQ ID NO: 10332 - protein, 337 aa, Acinetobacter sp. CIP 56.2
MAKNEKAVASVLAFEKKLVPSDGYFYGTTWDNRNEQTALKLIPKSVRGTISNRLKPAVASDPLKLNAEVEKANLQTVDACALGEHQDTLKVGFTLKVLGGVENPSACNNEAFLNSYQTVAKSYINQYGFTELAKRYALNIANARFLWRNRVGAEKVEVVVTINDQLAITFNALEYPLHDFDHVDEKLKKLADQIAQALKGKTAYLLIKVEAYALVGKAQEVYPSEELVLDKGKGDKSKILYQVNDVAAMHSQKIGNALRTIDTWYPEFDDKKTAIAIEPYGAVTNLGKAYRTPKEKKDFFTLFDKYALGESLENLEQEHYVMAVLVRGGVFGQSAKD

SEQ ID NO: 10333 - protein, 353 aa, Acinetobacter bereziniae NIPH 3
MTIFKKLPGSLSLQRGTVVSDGAFFNLFEDGKQEPLHVMYHGIRGTQNVAGNKEKGSATGNSLAREVTNIQLTESAKLQPKAKLLVKWDFRFIDLSYVLFASASKAGADKSEEYNFRQSFLNFVNRAKESNGLKEVVRRYVRNVVNGRWLWRNRIVAENISIQVTPQDYPEVFSFDALSYNLKSFDQPSEQEQKLSDILLKGITGESTNATLHIEAIVDFGMGGVEVFPSQNYLEDKPKGFSRSLYQLTPKKPDYKANDNQYLGQAALRDQKIGNALRTIDTWYPLFKENDEKPIAVEPNGANLEGQIFYRVGKDKVSAFDILKEVDELDPNSEKGMFLIACLIRGGVYSEGE

SEQ ID NO: 10334 - protein, 337 aa, Acinetobacter baumannii NIPH 190
MAKNEKAVASVLAFEKKLVPSDGYFYGTSWGNRKEQTALKLIQKSVRGTISNRLKPAVASDPMKLNAEVEKANLQTVDACALGEHQDTLKVGFTLKVLGGIENPSACNNEIFLKSYQSVANNYIQQYGFTELAKRYALNIANARFLWRNRVGAEKVEVVVTINDQPAVTFNALEYPLHDFDHIDEKVQNLANQIAKALKGETPYLLIKVEAYALVGKAQEVYPSEELVLDKGKGDKSKILYQVKDVAAMHSQKIGNALRTIDTWYPEFDEKKAAIAIEPYGAVTNLGKAYRTPKDKKDFFSLFDKYALGESLENPEQEHYVMAVLVRGGVFGQSGKE

SEQ ID NO: 10335 - protein, 365 aa, Acinetobacter gerneri DSM 14967 = CIP 107464
MTNTATFKKLPGSLSLQRGTIVSDGAFYHLFENGESEPLHVMYHGIRGTQNVAGNKEKGSATGNALAREVSNIQMTESAKLLPNSRLLVKWDLRFIDLDHILFACATKAGADKEDEQNFRKAFKAFTDKAKESEGLKEIARRYVRNIVNARWLWRNRTIAENITIKISEIEYQENSITTKKLANTVEFNALQYGLKSFENTCENEQKIADIIVRGMCGDNKANLHIEAIVDFGASGIEVFPSQNYLEDKPKGFSRSLYQIDPKRPETQSNDNQYLGQAAIRDQKIGNALRTIDTWYPAFIENDSKPIPVEPNGASLDAQLFFRVGKEKVSAFDILKEIQTLDPNSERGMFMLACLIRGGVYSEGE

SEQ ID NO: 10336 - protein, 353 aa, Acinetobacter venetianus RAG-1 = CIP 110063
MTIFKKLPGSLSLQRGTVVSDGAFFNLFDDGRQEALHVMYHGIRGTQNVAGNKEKGAATGNSLAREVTNIQLTESAKLQPNAKLLVKWDFRFIDLSYVLFASASKAGADKSEEYNFRQAFLSFVDRAKQSDGLKEVIRRYIRNIVNGRWLWRNRIVAESIDIQVTAQDHPENFSFDALSYHLKSFENPSEQEQKLADILLKGITGESTNAALHIEAIVDFGMGGVEVFPSQNYLEDKPKGFSRSLYQLTPKKPDHKANDNQYLGQAALRDQKIGNALRTIDTWYPQFEENDKKPIAVEPNGANLEGQIFYRVGKDKVSAFDILKEVDELDPNSEKGMFLIACLIRGGVYSEGE

SEQ ID NO: 10337 - protein, 336 aa, Acinetobacter schindleri CIP 107287
MAKNEKAVASVLAFEKKLVPSDGYFYGTTWANRTEQSALKLIEKSVRGTISNRLKAADADPLKLDAKVENANLQIVDACALAEHQDTLKVAFTLKVLGGIEQPSACNNETFLNSYKEVAKNYIQTHGFVELAKRYALNIANARFLWRNRVGAEKIEVVVKVNESDAVTFNAFDYKLHDFDCVDAKVQNLADQIAQALKGEIPYLLIKVEAYALVGKAQEVYPSEELVLDKGKGDKSKILYQVNDVAAMHSQKIGNALRTIDTWYPDFEEQKSAIAIEPYGAVTNLGKAYRTPKAKQDFFSLFDKYALGESLENIEQEHYVMAVLVRGGVFGQSSKD

SEQ ID NO: 10338 - protein, 337 aa, Acinetobacter junii CIP 107470
MAKNEKAVASVLAFEKKLVPSDGYFYGTTWEKRTEQSALNLIEKSVRGTVSHRLKKTTDQDMLKLNMDIANPNPQKVDACALAEHQDTLKVAFTLKVLGGIEQPSACNNETFLNSYKEVAKNYIQTHGFTELAKRYALNIANARFLWRNRVGAEKIEVVVTVNDQDSVTFNAFDYKLHDFDSVDAKVQNLADQIANALKGELPYLLIKVEAYALVGKAQEVYPSEELVLDKGKGDKSKILYQVNGVAAMHSQKIGNALRTIDTWYPEFEEQKSAIAIEPYGAVTNLGKAYRTPKAKQDFFSLFDKYALGESLENVEQEHYVMAVLVRGGVFGQSSKD

SEQ ID NO: 10339 - protein, 353 aa, Acinetobacter baylyi DSM 14961 = CIP 107474; identical to SEQ ID NO: 9984

SEQ ID NO: 10340 - protein, 353 aa, Acinetobacter soli NIPH 2899
MTIFKKLPGSLSLQRGTVVSDGAFFNLFEDGKQEPLHVMYHGIRGTQNVAGNKEKGAATGNSLAREVTNIQLTESAKLQPKAKLLVKWDFRFIDLSYVLFASASKAGADKTEEYNFRQAFLNFVNRAKESDGLKEVVRRYVRNIVNGRWLWRNRIVAESITIQVTAQDHPETFSFDALSYNLKSFAEPSEQEQKLADILLKGITGESTSAGLHIEAIVDFGMGGVEVFPSQNYLEEKPKGFSRSLYQLTPKKPDHKANDNQYLGQAALRDQKIGNALRTIDTWYPSFRENDEKPIAVEPNGANLEGQIFYRVGKDKVSAFDILKEIDELDVNSEKGMFLIACLIRGGVYSEGE

SEQ ID NO: 10341 - protein, 337 aa, Acinetobacter junii CIP 64.5
MAKNEKVVASVLAFEKKLVPSDGYFYGTTWGNREEQTALKLIQKSVRGTISNRLKPAVASDPLKLNAEVEKANLQTVDACALGEHQDTLKVGFTLKVLGGVENPSACNNEMFLQSYQSVAKNYIQQYGFTELAKRYALNIANARFLWRNRVGAEKIEVVVTVNDQPAVSFNALEYPLHNFDKIDEKVHNLANQIAQALKGETPYLLIKIEAYALVGKAQEVYPSEELVLDKGKGDKSKILYHVNDVAAMHSQKIGNALRTIDTWYPEFDDKKTAIAIEPYGAVTNLGKAYRTPKDKKDFFSLFDKYALGDSLENAEQEHYVMAVLVRGGVFGQSGKE

SEQ ID NO: 10342 - protein, 337 aa, Acinetobacter ursingii ANC 3649
MAKNDKVVASVLAFEKKLVPSDGYLYGTNWNKRNEQSALKLIEKSVRGTVSHRLKNTTDKDLLKLNMDIAHANPQTVDACALGEHQDTLKVGFTLKVLGGVEHPSACNNEIFLKSYNDVAKNYITTYGFSELAKRYALNLANARFLWRNRVGAEKVEVVVTVNDQAAVTFNALNYPLHNFDATDENIQNLAHQIASALKGEIPYLLIKVEAYALVGKGQEVYPSEELVLDKGKGEKSKILYHVNDVAAMHSQKLGNALRTIDTWYPEFDEKKTAIAIEPYGAVTNLGKAYRTPKDKKDFFTLFDKYALGESLENPEQEHYVMAVLVRGGVFGQSSKD

SEQ ID NO: 10343 - protein, 353 aa, Acinetobacter radioresistens DSM 6976 = NBRC 102413 = CIP 103788
MTIFKKLPGSLSLQRGTVVSDGAFFNLFEDGKQEPLHVMYHGIRGTQNVAGNKEKGAATGNSLAREVTNIQLTESAKLQPKAKLLVKWDFRFIDLSYVLFASASKAGADKSEEYNFRQAFLSFVNRAKESDGLKEVVRRYVRNIVNGRWLWRNRIVAESITIQVTAQDHPETLSFDALSYNLKSFDQPSEQEQKLADILLKGITGESTSAALHIEAIVDFGMGGVEVFPSQNYLEEKPKGFSRSLYQLTPKKPDHKANDNQYLGQAALRDQKIGNALRTIDTWYPLFKENDEKPIAVEPNGANLEGQIFYRVGKDKVSAFDILKEIDELDVNSDKGMFLIACLIRGGVYSEGE

SEQ ID NO: 10344 - protein, 353 aa, Acinetobacter calcoaceticus DSM 30006 = CIP 81.8
MTIFKKLPGSLSLQRGTVVSDGAFFNLFEDGKQEPLHVMYHGIRGTQNVAGNKEKGAATGNSLAREVTNIQLTESAKLQPKAKLLVKWDFRFIDLSYVLFASASKAGADKTEEYNFRQAFLNFVNRAKESDGLKEVVRRYVRNIVNGRWLWRNRIVAESITIQVTAQDYPETFSFDALFYNLKSFDQPSEQEQKLADILLKGITGESTSAALHIEAIVDFGMGGVEVFPSQNYLEDKPKGFSRSLYQLTPKKPDHKANDNQYLGQAALRDQKIGNALRTIDTWYPLFKENDEKPIAVEPNGANLEGQIFYRVGKDKVSAFDILKEIDELDVNSDKGMFLIACLIRGGVYSEGE

SEQ ID NO: 10345 - protein, 337 aa, Acinetobacter haemolyticus CIP 64.3
MAKNEKVVASVLAFEKKLVPSDGYFYGTSWGNREEQTALKLIQKSVRGTISNRLKPAVASDPLKLNAEVEKANLQTVDACALGEYQDTLKVGFTLKVLGGIENPSACNNEIFLQSYQSVAKNYIQQYGFTELAKRYALNIANARFLWRNRVGAEKVEVVVTVNDQLAVTFNALEYPLYDFDQVDEKVQNLANQIAQALRGEIPYLLIKIEAYALVGKAQEVYPSEELVLDKGKGDKSKILYHVNDVAAMHSQKIGNALRTIDTWYPEFDDKKTAIAIEPYGAVTNLGKAYRTPKDKKDFFSLFDKYALGESLENTEQEHYVMAVLVRGGVFGQSGKE

SEQ ID NO: 10346 - protein, 337 aa, Acinetobacter baumannii NIPH 201; identical to SEQ ID NO: 9909

SEQ ID NO: 10347 - protein, 337 aa, Acinetobacter baumannii NIPH 527; identical to SEQ ID NO: 9909

SEQ ID NO: 10348 - protein, 337 aa, Acinetobacter baumannii NIPH 290; identical to SEQ ID NO: 9909

SEQ ID NO: 10349 - protein, 337 aa, Acinetobacter baumannii ANC 4097; identical to SEQ ID NO: 9909

SEQ ID NO: 10350 - protein, 353 aa, Acinetobacter baumannii ATCC 19606 = CIP 70.34 = JCM 6841; identical to SEQ ID NO: 10054

SEQ ID NO: 10351 - protein, 346 aa, Acinetobacter sp. NIPH 284
MAKNDKLKTASVLSFNRHLDASDGRMFAVNWVEIAQGTGNTPILIQAKSVRGTISNRPKNSKETDEAAINAAVNKPNLQTVDVAALPQGKDTVAVTFSLRVLPNVGRPSACNDAAFAERLEAAVSGYETANKFSELANRYAVNLANGRFLWRNRIGAENVTVTVERLIDGKSAEKLSFDALQNRLNEATVHQDQQTEIKQLSAWIEAGLSGHEHVLLKVTGFSRLGEGQEVYPSQELILDTSNSKGAKSKTLYSFGNNEAGMHSQKIGNALRTIDIWYPNADKPIAVEPYGSVTSEGKAYRQPKEKQDFYSLFDAWVNYNKVLELEQQHYVMAVLVRGGVFGESDK

SEQ ID NO: 10352 - protein, 337 aa, Acinetobacter sp. ANC 3862
MAKNEKAVASVLAFEKKLVPSDGYFYGTTWTNRNEQTALKLIEKSVRGTISNRLKPAVAGDPMKLNAEVEKANLQTVDACALGENQDTLKVGFTLKVLGGIENPSACNNENFFDSYKAVAKNYIEQYGFNELAKRYALNIANARFLWRNRVGAEKVEVVVTINDQAAIIFNALEYPLHDFDQIDEKVQTLANQIAQALKGETAYLLIKVEAYALVGKAQEVYPSEELVLDKGKGNKSKILYQVNDVAAMHSQKIGNALRTIDTWYPEFDEKKTAIAIEPYGAVTNLGKAYRTPKDKVDFFNLFDKYALGESLANAEQEHYVMAVLVRGGVFGQSGKE

SEQ ID NO: 10353 - protein, 337 aa, Acinetobacter ursingii NIPH 706
MAKNDKVVASVLAFEKKLVPSDGYLYGTNWDKRNEQSALKLIEKSVRGTISNRLKPAVAGDPLKLNAEVEKANLQKVDACALGENQDTLKVGFTLKVLGGVEHPSACNNEIFLKSYNDVAKNYITTYGFNELAKRYALNIANARFLWRNRVGAEKVEVVVTVNDQAAVTFNALNYPLHNFDASDENIQNLAHQIASALKGEVPYLLIKVEAYALVGKGQEVYPSEELVLDKGKGEKSKILYHVNEVAAIHSQKLGNALRTIDTWYPEFDEKKTAIAIEPYGAVTNLGKAYRTPKDKKDFFTLFDKYALGESLENPEQEHYVMAVLVRGGVFGQSSKD

SEQ ID NO: 10354 - protein, 345 aa, Xanthomonas fragariae LMG 25863
MTTDLKTASVLAFERKLDPSDALLFSGAWAARATPADWRPIKLREKSVRGTISNRLKVKEQDPTKLDAAIENPNLQTVDVAALPLDADTLKVQFTLRVLGGTGTPSACNDTDYREKLTATVAAYVQQHGFDTLAQRYAANLANGRFLWRNRIGAEQVEVQVAHLKNGVPAAQWAFQAHDHSLRTLRAPSAEAADLVALSSLIATALAGSAHLLLQVTAFVRVGAGQEVFPSQELILDKGSSKKSKTLYAVGDGDNAVAAIHSQKIGNALRTIDTWYPEADDNGPIAVEPYGSVTTQGKAYRQPKAKLDFYNLLDNWVLKDKLPEPDQQHFVIATLIRGGVFGDAG

SEQ ID NO: 10355 - protein, 345 aa, Grimontia indica
MELCTQLSYQGSLRPSKGVFFYEEADGTMKPLPIDQDAIVGQKCSYSEAYQPSGSPKNLQPQDLAFGNPVRRESCYVPPTVDKIVCRFSLRVEANSLSPFVCNSQSVGEALCSLAAAYQRAGGYDELARRYCKNLLLGQWLWRNQRSMGLAITVATSAGNEYRIENALHLDWHEPWQDDSQKVLNGLTGELASALSGEEPFWFADIKANISASFMQEIFPSQLFSDSKDGSNLGREYAKVRSGDGQIWPSLNAEKIGAAIQLIDDWWADEADKRLRVHEYGGDKEYLIAHRIPSSGIDAYSLLKSVDEKAALIDGLKCSEEIPSDIHYLMAVLVKGGLFQKSRSV

SEQ ID NO: 10356 - protein, 333 aa, Escherichia coli KTE33
MAKAPVAIKTASVLAFERKLATSDAVMYAGNWQGNEWQPIEIQEKAVRGTISNRLKNTIASDPTKLDAEIQKANLQRVDVASLPVDADTLKVVFTLRVLGNLSSPSVCNDMAYQEALSGVIEGYISEHGFKELALRYTLNLANGRFLWRNRIGAEQIQVKVTANDTSWTFNSHDFSLRQFDQEQAAVTQLAAIIEQGLSGKEWVMLTVEAQVRLGAGQEVFPSQELVLDSNSSKSRVLYQVAGITGIHSQKIGNALRTIDTWHPKVDELGAIAVEPYGSVTSRGVACRQPKEKLDFYTLLDNWVTKGVKPEVDQQHYVMAVLIRGGVFGEKAE

SEQ ID NO: 10357 - protein, 353 aa, Acinetobacter sp. CIP 110321
MTIFKKLPGSLSLQRGTVLSDGAFFNLFEDGKQEPLHVMYHGIRGTQNVAGNKEKGAATGNSLAREVTNIQLTESAKLQPKAKLLVKWDFRFIDLSYVLFASASKAGADKSEEYNFRQAFLNFVNRAKESDGLKEVVRRYVRNIVNGRWLWRNRIVAESITIQVTAQDHHETFSFDALSYNLKSFDQPSEQEQKLADTLLKGITGESTSAALHIEAIVDFGMGGVEVFPSQNYLEDKPKGFSRSLYQLTPKKPDHKANDNQYLGQAALRDQKIGNALRTIDTWYPQFKENDEKPIAVEPNGANLEGQIFYRVSKDKVSAFDILKEIDELDPNSEKGMFLIACLIRGGVYSEGE

SEQ ID NO: 10358 - protein, 342 aa, Pseudomonas aeruginosa PA14; identical to SEQ ID NO: 9879

SEQ ID NO: 10359 - protein, 342 aa, Pseudomonas aeruginosa MSH-10; identical to SEQ ID NO: 10211

SEQ ID NO: 10360 - protein, 333 aa, Escherichia coli KTE7; identical to SEQ ID NO: 9875

SEQ ID NO: 10361 - protein, 333 aa, Escherichia coli KTE3; identical to SEQ ID NO: 9875

SEQ ID NO: 10362 - protein, 333 aa, Escherichia coli KTE19; identical to SEQ ID NO: 9875

SEQ ID NO: 10363 - protein, 333 aa, Escherichia coli KTE27; identical to SEQ ID NO: 9875

SEQ ID NO: 10364 - protein, 333 aa, Escherichia sp. KTE31; identical to SEQ ID NO: 10356

SEQ ID NO: 10365 - protein, 333 aa, Escherichia sp. KTE52
MAKAPVAVKTASVLAFERKLATSDAVMYAGNWQGNEWQPIEIQEKAVRGTISNRLKDAISSNELKLNAEIQKANLQRVDVAALPVDADTLKVMFTLRVLGNLSSPSVCNDMAYQEALSDVIEGYISEHGFKELALRYALNLANGRFLWRNRIGAEQIQVKVTANDKSWTFNSHDFSLRQFDQGQSSVTKLASTIEQGLSGKEWVMLTVEAQVRLGAGQEVFPSQELVLDSNSSKSRVLYQVAGIAGIHSQKIGNALRTIDTWHPKVDELGAIAVEPYGSVTSRGVACRQPKEKLDFYTLLDNWVTKGMKPDVEQQHYVMAVLIRGGVFGEKAE

SEQ ID NO: 10366 - protein, 333 aa, Escherichia sp. KTE96
MAKAPVAIKTASVLAFERKLATSDAAMYAGNWQGNEWQPIEIQEKAVRGTISNRLKDAISSNELKLNAEIQKANLQRVDVAALPVDADTLKVMFTLRVLGNLSSPSVCNDMAYQEALSDVIDGYISEHGFKELALRYALNLANGRFLWRNRIGAEQIQVKVTANDSSWTFNSHDFSLRQFDQGQSSVTELATIIEQGLSGKEWVMLTVEAQVRLGAGQEVFPSQELVLDSNSSKSRVLYQVAGIAGIHSQKIGNALRTIDTWHPKVDELGAIAVEPYGSVTSRGVACRQPKEKLDFYTLLDNWVTKGMKPDVDQQHYVMAVLIRGGVFGEKAE

SEQ ID NO: 10367 - protein, 333 aa, Escherichia coli KTE89; identical to SEQ ID NO: 9930

SEQ ID NO: 10368 - protein, 333 aa, Escherichia coli KTE126; identical to SEQ ID NO: 9995

SEQ ID NO: 10369 - protein, 333 aa, Escherichia sp. KTE159; identical to SEQ ID NO: 10365

SEQ ID NO: 10370 - protein, 333 aa, Escherichia coli KTE240; identical to SEQ ID NO: 9875

SEQ ID NO: 10371 - protein, 333 aa, Escherichia coli KTE186
MAKAPVAIKTASVLAFERKLATSDAVMYAGNWQGNEWQPIEIQEKAVRGTISNRLKNAIVSDPTKLDAEIQKANLQRVDVASLPVDTDTLKVVFTLRVLGNLSTPSVCNDMAYQEALSGVIEGYISEHGFKELTLRYALNLANGRFLWRNRIGAEQIQVKVTANETSWAFNSHDFSLRQFDQGQAAVTQLAAIIEQGLSAKEWVMLTVEAQVRLGAGQEVFPSQELVLDSNSSKSRVLYQVAGIAGIHSQKIGNALRTIDTWHPKVDELGAIAVEPYGSVTSRGVACRQPKEKLDFYTLLDNWVTKGMKPDVKQQHYVMAVLIRGGVFGEKSE

SEQ ID NO: 10372 - protein, 346 aa, Halomonas anticariensis FP35 = DSM 16096
MAKNDTLKTASVLAFERKLDPSDALFFAGNWENRDQADVWPHVEVREKSVRGTISNRLKVKEQDPAKLDAAIENPNLQTVDVATLPSGADTLMARFTLRVLGGAGVPSACNNADYQAKLNDVVKGYVSGYGFNELAKRYAYNLANGRFLWRNRVGAEQVEVQVRLMEKGQAVSAWTFDAFSLSLRDFASTGDAQASLEELAGHITNGLSGERHVLLEVVAFARVGAGQEVFPSQELILDRGRGDKSKTLYQVNEVAGIHSQKLGNALRTIDTWYPAPEDGSDLGPIAVEPYGSVTTQGSAYRQPKQKMDFYNLLDNWLLKDQVPSTEQQHFVMATLIRGGVFGDAG

SEQ ID NO: 10373 - protein, 335 aa, Pasteurella multocida 1500E; identical to SEQ ID NO: 9947

SEQ ID NO: 10374 - protein, 342 aa, Delftia acidovorans CCUG 15835
MSSTLKTASVLAFERKLDPSDAVFHAGNWDDRAASASWPSVKLREKSVRGTISNRLKTKDQDPAKLDAAIENPNLQTVDVAALPADADTLKVQFTLRVLSGAGTPSACNSAEYQARLAQTVQAYASAQGFAELANRYAANLANGRFLWRNRVGAESVQVQVVQLKDGKAGQAWSFDALAHNLRTLEQPDEKVAALGSVIAQGLEGKAHVLLQITAFVRLGAGQEVFPSQELILDKGSTKKSKTLYQIGEKGQEVAAIHSQKIGNALRTIDTWYDGAQDLGPIAVEPYGSVTTQGKAWRQPKQKQDFYTLLDDWLLKDKVPPVEQQHFVMAVLIRGGVFGDAS

SEQ ID NO: 10375 - protein, 36 aa, Pasteurella multocida P1933
MFDNWLLKGEVPPVEQQHYVMSVLIRGGVFGASGKE

SEQ ID NO: 10376 - protein, 335 aa, Pasteurella multocida 2000; identical to SEQ ID NO: 9947

SEQ ID NO: 10377 - protein, 297 aa, Pasteurella multocida P1933
MSKLSTPSVLAFERNLDISDAIFAQKDSKNDKDAPVPLRIREKSVRGTISNRLKNTITNDPAKLDAETEKANLQRVDVATLDDDKDTLVATFSVKVLPFTGRPNVCNDQDYQHQVMTTVAQYLSEQGMDELAKRYATNIANARWLWRNRMGAEKIKIEVTCGENTLHFDDAKQFSLNHFDHQDDKIHQIAKEIKQGLLGEKFVILYVTAYANMGYGQEVYPSQELVLDNSTNNRKSKILYEINQKAGMHSQKVGNAIRTIDTWYAEEVAFPIAAEPYGAVTTLGTAFRQPNVSNHLK

SEQ ID NO: 10378 - protein, 335 aa, Pasteurella multocida 93002; identical to SEQ ID NO: 9947

SEQ ID NO: 10379 - protein, 335 aa, Pasteurella multocida RIIF; identical to SEQ ID NO: 9868

SEQ ID NO: 10380 - protein, 336 aa, Pasteurella multocida 671/90
MSKKLATPSVLAFERNLDISDAIFAQKDSKNDKDAPVPLRIREKSVRGTISNRLKNPITNDPAKLDAETEKANLQRVDVATLDDDKDTLVATFSVKVLPFTGRPNVCNDQDYQHQVMTTVAQYLSEQGMDELAKRYATNIANARWLWRNRMGAEKIKIEVTCGENTLHFDDAKQFSLNHFDHQDDKIHQIAKEIKQGLLGEKFVILYVTAYANMGYGQEVYPSQELVLDNSTNNRKSKILYEINQKAGMHSQKVGNAIRTIDTWYAEEVAFPIAAEPYGAVTTLGTAFRQPKTKKNDFYTLFDNWLLKGEVPPVEQQHYVMSVLIRGGVFGASGKE

SEQ ID NO: 10381 - protein, 335 aa, Pasteurella multocida 1500C; identical to SEQ ID NO: 10204

SEQ ID NO: 10382 - protein, 159 aa, Enterococcus faecium 13.SD.W.09; identical to SEQ ID NO: 10091

SEQ ID NO: 10383 - protein, 159 aa, Enterococcus faecalis 06-MB-DW-09
MKPIIKETLQKKTTTSAKLRYLAYAYKEWLIAITLFVVFAGSITHSLTRPQEEVVNAAIVTETAMDPAVQSELEAAVEAWAIDQGYQKEELRISLVSYAEPAAVQAFTTRLAAGAIQMVVFPASEAQTWQERFGSQELAQEIITVGENEFILQVTNKEK

SEQ ID NO: 10384 - protein, 345 aa, Vibrio natriegens NBRC 15636 = ATCC 14048 = DSM 759
MELCSQLNYVRSLSAGKACFYYLTPSGDMCPLSIDKTRLRAPKGGYSEAYRGSQFHQKNVAPQDLAYANPQFIEECYVPPSTDEIVCEFSLRVKANSLHPEVCNDDSVREQLALLAATYKDLNGYQELAYRYAKNILLGTWLWRNRECRGVAIEVTTSDGEIILISDATRLSWYGHWDEQSTESLERLTSYLSRALSDSAQYFYMDVKALLAVGRGDEVHPSQEFLDDKQEGVPTKQLAKVRLADGRETAAFHAQKIGAALQSIDDWWHEKADKPLRVNEYGADREYVIARRHTQSGNDFYQLIRRTEAWTEEMEKSKSIPNDVHFIMSVLIKGGLFNSSKSTAK

SEQ ID NO: 10385 - protein, 343 aa, Vibrio fluvialis PG41
MAKNNDTASVLAFEKKLVPSDGYLFGCQWETKAQATPLALQEKSVRGTISNRLKSAVKNDPAKLNAEVEKANLQRVDACALGQDHDTLKLHFTLKVLGGLAQPSACNNALFKQSYSTAVSKYITQYGCFELAKRYATNLANARFLWRNRVGAEEIEVQVKALNKEAEQAWTFNAKQFSTKHFDHNDSQINSLADRIAQALASETDHLMLQIDCYAKVGKAQEVYPSEELVLDKGNSKTKKSKILYAVNEHAAMHSQKIGNALRSIDTWYPDYASEEQSAGAIAIEPYGAVTNLGKAFRTPKDKQDFYTFFDKWARGESLPREEDEHYVMAVLVRGGVFGESDK

SEQ ID NO: 10386 - protein, 365 aa, Acinetobacter gerneri MTCC 9824; identical to SEQ ID NO: 10335

SEQ ID NO: 10387 - protein, 337 aa, Acinetobacter junii MTCC 11364; identical to SEQ ID NO: 10338

SEQ ID NO: 10388 - protein, 337 aa, Acinetobacter haemolyticus MTCC 9819; identical to SEQ ID NO: 10345

SEQ ID NO: 10389 - protein, 337 aa, Acinetobacter baumannii 1605; identical to SEQ ID NO: 9909

SEQ ID NO: 10390 - protein, 347 aa, Vibrio parahaemolyticus 10290; identical to SEQ ID NO: 10102

SEQ ID NO: 10391 - protein, 347 aa, Vibrio parahaemolyticus VP2007-095; identical to SEQ ID NO: 10102

SEQ ID NO: 10392 - protein, 347 aa, Vibrio parahaemolyticus VP250; identical to SEQ ID NO: 9979

SEQ ID NO: 10393 - protein, 347 aa, Vibrio parahaemolyticus NIHCB0603; identical to SEQ ID NO: 9979

SEQ ID NO: 10394 - protein, 347 aa, Vibrio parahaemolyticus VP232; identical to SEQ ID NO: 9979

SEQ ID NO: 10395 - protein, 347 aa, Vibrio parahaemolyticus VP-NY4; identical to SEQ ID NO: 9979

SEQ ID NO: 10396 - protein, 347 aa, Vibrio parahaemolyticus 3259; identical to SEQ ID NO: 9963

SEQ ID NO: 10397 - protein, 347 aa, Vibrio parahaemolyticus 949; identical to SEQ ID NO: 9979

SEQ ID NO: 10398 - protein, 342 aa, Pseudomonas aeruginosa WC55; identical to SEQ ID NO: 10024

SEQ ID NO: 10399 - protein, 333 aa, Escherichia coli HVH 1 (4-6876161); identical to SEQ ID NO: 9875

SEQ ID NO: 10400 - protein, 333 aa, Escherichia coli HVH 3 (4-7276001); identical to SEQ ID NO: 9875

SEQ ID NO: 10401 - protein, 333 aa, Escherichia coli HVH 5 (4-7148410); identical to SEQ ID NO: 9875

SEQ ID NO: 10402 - protein, 333 aa, Escherichia coli HVH 9 (4-6942539); identical to SEQ ID NO: 9930

SEQ ID NO: 10403 - protein, 333 aa, Escherichia coli HVH 19 (4-7154984); identical to SEQ ID NO: 9875

SEQ ID NO: 10404 - protein, 333 aa, Escherichia coli HVH 24 (4-5985145); identical to SEQ ID NO: 9930

SEQ ID NO: 10405 - protein, 333 aa, Escherichia coli HVH 30 (4-2661829); identical to SEQ ID NO: 9875

SEQ ID NO: 10406 - protein, 333 aa, Escherichia coli HVH 32 (4-3773988); identical to SEQ ID NO: 9875

SEQ ID NO: 10407 - protein, 333 aa, Escherichia coli HVH 35 (4-2962667); identical to SEQ ID NO: 9875

SEQ ID NO: 10408 - protein, 333 aa, Escherichia coli HVH 38 (4-2774682); identical to SEQ ID NO: 9930

SEQ ID NO: 10409 - protein, 333 aa, Escherichia coli HVH 42 (4-2100061); identical to SEQ ID NO: 9875

SEQ ID NO: 10410 - protein, 333 aa, Escherichia coli HVH 48 (4-2658593); identical to SEQ ID NO: 9875

SEQ ID NO: 10411 - protein, 333 aa, Escherichia coli HVH 59 (4-1119338); identical to SEQ ID NO: 9875

SEQ ID NO: 10412 - protein, 333 aa, Escherichia coli HVH 73 (4-2393174); identical to SEQ ID NO: 9875

SEQ ID NO: 10413 - protein, 333 aa, Escherichia coli HVH 76 (4-2538717); identical to SEQ ID NO: 9875

SEQ ID NO: 10414 - protein, 239 aa, Escherichia coli HVH 80 (4-2428830)
MAKAPVAIKTASVLAFERKLATSDAVMYAGNWQGNEWQPIEIQEKAVRGTISNRLKNAIVSDPTKLDAEIQKANLQRVDVASLPVDTDTLKVVFTLRVLGNLSTPSVCNDMAYQEALSGVIEGYISEHGFKELALRYALNLANGRFLWRNRIGAEQIQVKVTANETSWTFNSHDFSLRQFDQGQAAVTQLAAIIEQGLSAKEWVMLTVEAQVRLGAGQEVFPSQELVLDSNSSKSRVLY

SEQ ID NO: 10415 - protein, 93 aa, Escherichia coli HVH 80 (4-2428830)
MAGIAGIHSQKIGNALRTIDTWHPKVDELGAIAVEPYGSVTSRGVACRQPKEKLDFYTLLDNWVTKGMKPDVEQQHYVMAVLIRGGVFGEKSE

SEQ ID NO: 10416 - protein, 333 aa, Escherichia coli HVH 102 (4-6906788); identical to SEQ ID NO: 9875

SEQ ID NO: 10417 - protein, 333 aa, Escherichia coli HVH 104 (4-6977960); identical to SEQ ID NO: 9875

SEQ ID NO: 10418 - protein, 333 aa, Escherichia coli HVH 118 (4-7345399); identical to SEQ ID NO: 9875

SEQ ID NO: 10419 - protein, 333 aa, Escherichia coli HVH 125 (4-2634716)
MAKAPVAIKTASVLAFERKLATSDAVMYAGNWQGNEWQPIEIQEKAVRGTISNRLKNAIVSDPTKLDAEIQKANLQRVDVASLPVDTDTLKVVFTLRVLGNLSTPSVCNDMAYQEALSGVIEGYISEHGFKELALRYALNLANGRFLWRNRIGAEQIQVKVTANETSWTFNSHDFSLRQFDQGQAAVTQLAAIIEQGLSAKEWVMLTVEAQVRLGAGQEVFPSQELVLDSNSSKSRVLYQVAGIAGIHSQKIGNALRTIDTWYPKVDELGAIAVEPYGSVTSRGVACRQPKEKLDFYTLLDNWVTKGMKPDVKQQHYVMAVLIRGGVFGEKSE

SEQ ID NO: 10420 - protein, 333 aa, Escherichia coli HVH 126 (4-6034225); identical to SEQ ID NO: 9875

SEQ ID NO: 10421 - protein, 333 aa, Escherichia coli HVH 127 (4-7303629); identical to SEQ ID NO: 9875

SEQ ID NO: 10422 - protein, 333 aa, Escherichia coli HVH 137 (4-2124971); identical to SEQ ID NO: 9875

SEQ ID NO: 10423 - protein, 333 aa, Escherichia coli HVH 170 (4-3026949); identical to SEQ ID NO: 9875

SEQ ID NO: 10424 - protein, 333 aa, Escherichia coli HVH 180 (4-3051617); identical to SEQ ID NO: 9875

SEQ ID NO: 10425 - protein, 333 aa, Escherichia coli HVH 191 (3-9341900); identical to SEQ ID NO: 9875

SEQ ID NO: 10426 - protein, 333 aa, Escherichia coli HVH 192 (4-3054470); identical to SEQ ID NO: 9875

SEQ ID NO: 10427 - protein, 333 aa, Escherichia coli HVH 196 (4-4530470); identical to SEQ ID NO: 9875

SEQ ID NO: 10428 - protein, 333 aa, Escherichia coli HVH 198 (4-3206106); identical to SEQ ID NO: 9995

SEQ ID NO: 10429 - protein, 333 aa, Escherichia coli HVH 199 (4-5670322); identical to SEQ ID NO: 9875

SEQ ID NO: 10430 - protein, 333 aa, Escherichia coli HVH 201 (4-4459431); identical to SEQ ID NO: 9875

SEQ ID NO: 10431 - protein, 333 aa, Escherichia coli HVH 203 (4-3126218); identical to SEQ ID NO: 9875

SEQ ID NO: 10432 - protein, 333 aa, Escherichia coli HVH 211 (4-3041891); identical to SEQ ID NO: 9875

SEQ ID NO: 10433 - protein, 333 aa, Escherichia coli HVH 217 (4-1022806); identical to SEQ ID NO: 9875

SEQ ID NO: 10434 - protein, 333 aa, Escherichia coli HVH 222 (4-2977443); identical to SEQ ID NO: 9875

SEQ ID NO: 10435 - protein, 333 aa, Escherichia coli KOEGE 32 (66a); identical to SEQ ID NO: 9875

SEQ ID NO: 10436 - protein, 333 aa, Escherichia coli KOEGE 56 (169a); identical to SEQ ID NO: 10419

SEQ ID NO: 10437 - protein, 333 aa, Escherichia coli UMEA 3041-1; identical to SEQ ID NO: 9875

SEQ ID NO: 10438 - protein, 333 aa, Escherichia coli UMEA 3117-1; identical to SEQ ID NO: 9995

SEQ ID NO: 10439 - protein, 93 aa, Escherichia coli UMEA 3140-1; identical to SEQ ID NO: 10415

SEQ ID NO: 10440 - protein, 239 aa, Escherichia coli UMEA 3140-1; identical to SEQ ID NO: 10414

SEQ ID NO: 10441 - protein, 239 aa, Escherichia coli UMEA 3162-1; identical to SEQ ID NO: 10414

SEQ ID NO: 10442 - protein, 93 aa, Escherichia coli UMEA 3162-1; identical to SEQ ID NO: 10415

SEQ ID NO: 10443 - protein, 333 aa, Escherichia coli UMEA 3203-1; identical to SEQ ID NO: 9875

SEQ ID NO: 10444 - protein, 333 aa, Escherichia coli UMEA 3206-1; identical to SEQ ID NO: 9875

SEQ ID NO: 10445 - protein, 333 aa, Escherichia coli UMEA 3221-1; identical to SEQ ID NO: 10419

SEQ ID NO: 10446 - protein, 333 aa, Escherichia coli UMEA 3230-1; identical to SEQ ID NO: 10419

SEQ ID NO: 10447 - protein, 333 aa, Escherichia coli UMEA 3391-1; identical to SEQ ID NO: 9930

SEQ ID NO: 10448 - protein, 333 aa, Escherichia coli UMEA 3632-1; identical to SEQ ID NO: 9875

SEQ ID NO: 10449 - protein, 333 aa, Escherichia coli UMEA 3662-1; identical to SEQ ID NO: 9875

SEQ ID NO: 10450 - protein, 333 aa, Escherichia coli UMEA 3702-1
MAKAPVAIKTASVLAFERKLATSDAVMYAGNWQGNEWQPIEIQEKAVRGTISNRLKNAIVSDPTKLDAEIQKANLQRVDVASLPVDTDTLKVVFTLRVLGNLSTPSVCNDVAYQEALSGVIEGYISEHGFKELALRYALNLANGRFLWRNRIGAEQIQVKVTANETSWTFNSHDFSLRQFDQGQAAVTQLAAIIEQGLSAKEWVMLTVEAQVRLGAGQEVFPSQELVLDSNSSKSRVLYQVAGIAGIHSQKIGNALRTIDTWHPKVDELGAIAVEPYGSVTSRGVACRQPKEKLDFYTLLDNWVTKGMKPDVEQQHYVMAVLIRGGVFGEKSE

SEQ ID NO: 10451 - protein, 333 aa, Escherichia coli UMEA 3893-1; identical to SEQ ID NO: 9875

SEQ ID NO: 10452 - protein, 333 aa, Escherichia coli UMEA 3834-1; identical to SEQ ID NO: 9875

SEQ ID NO: 10453 - protein, 333 aa, Escherichia coli HVH 210 (4-3042480); identical to SEQ ID NO: 9875

SEQ ID NO: 10454 - protein, 333 aa, Escherichia coli UMEA 3298-1; identical to SEQ ID NO: 9875

SEQ ID NO: 10455 - protein, 333 aa, Gallibacterium anatis 12656/12
MSTITTATVLAFERRLDISDAVFSQKSSSTGQSTPVRITEKAVRGTISNRLKNAIANDPVKLDAEIQKANLQTVDIAALDHDKDTLIVSWSCKVLPFTGQPNVCNNPEYQKVLEETVQNYLNNTGLSELAYRYAYNIINARWLWRNRMNAEKINIKIKFNNSDEMLEFKDVKPFSLNNFDYKDEKLTKLATYIEKGFKGEQFVLINIEAEVLMGKGQEVYPSQELILDNSSARKSKILYQINDIAGIHSQKIGNAIRTIDTWYEPNAAFPISVEPYGAVTTLGRAFRQPKQKLDFYTLFDDWILRGQAPTPEQQYFVIAVLIRGGIFGASGKE

SEQ ID NO: 10456 - protein, 350 aa, Pseudoalteromonas arctica A 37-1-2
MELCNILKYDRSLYPSKAVFFYKTADSDFVPLEADINKVRGPKSGFTEAFTPQFLPKNISPQDLTHNNILTLEECYVPPNVEHIFCRFSLRVQANSLAPSGCSDPEVFSLLKELATIFKECGGYKELATRYCRNILLGTWLWRNQNTGNTQIEIKTSKGNRYLIDNTRKLAWESKWASDDQRVLEELSNEIESALTDPNVFWSADITAKIEASFCQEVYPSQILNDKVKQGEASKQFVKSKCADGRYAVSFNSVKIGAALQSIDDWWDEDASKRLRVHEFGADKEIGIARRPPDSEQNFYSIFKNTEWYLSALKNCITNKNENIDPAIYYLFSVLIKGGMFQKKAEAKKA

SEQ ID NO: 10457 - protein, 341 aa, Pseudoalteromonas citrea DSM 8771
MAKKENIASVLAFEKKLVTSDGYMYGTAWNNRNEVQALNLTPKSVRGTISNRLKAAIKGDPAKLNAEVEKPNLQKVDACALLPEQDTLNLKFTIKVLGGITEPAACNNAQFKQSYRNAALGYIEQHKFTELAHRYATNIANARFLWRNRVGAENIEVVVSARNKYVEKKWTFDAKQFSTKHFDHNDEKIAELASHIAKALGSEEDFLLLDIDCFAQIGRAQEVYPSEELILDKGKGEKSKKLYDVKGIAAMHSQKLGNALRTIDTWYPDFSDPDSSAGPIAMEPYGAVTNLGRAYRTPAAKQDFYTFFDAWARGEKLQSIEQEHYVMAILVRGGVFGESDK

SEQ ID NO: 10458 - protein, 340 aa, Pseudoalteromonas spongiae UST010723-006
MKLPRQLTYTRSLSPGKAVFFYKTPESDFEPLQIERQKIRGQKSGFVEAYKNEATPKELAPQDLAFGNPHTIELCYVPPTVQQVYCRFSLRVEANSLEPNVCSEPKVSYWLTRFMNTYKQHGGFRDLAKRYAKNILICEWLWRNKTSPNVDLEIIGEGFKPISISKANRLRWEGKWREAEDSLHTLTDVIQTGLEDPYSFCFLEVTAKIDTYFGQEIYPSQSFAENGAIARTYAYTQVAGKDAACFHSQKVGAAIQMIDDWYDEGANKRLRIHEYGADYKNVIARRAPSKRLDFYSLLKKIALYVKEMEQNGLKNQEQASHIHYIAAVLIKGGLFQRTKE

SEQ ID NO: 10459 - protein, 342 aa, Pseudoalteromonas undina DSM 6065
MQLPRHLSYTRSLSPSKAVFFYKTPESDFEPLQIEQNKLVGQKSGFGDAYQKQNVAKNLAPQDLAFGNPQTIDVCYVPPTVNELFCRFSLRVEANCIEPHVCDDPKVIYWLKRFFETYKKHNGLNEVATRYAKNILMGNWLWRNRQSPNVDIEILTEHAAPIVVEGAQKLKWQGNWQNNQTALLTLSESIQEGLSNPQNYCYLDITAKIKNAFSQEVHPSQKFVDNVEQGMSSKQLAYTQVGDKKAASLNSQKVGASIQTIDDWYEGGYKPLRTHEYGADKQILVAHRTPKSHSDFYSLLPRIALHIKHMEKHGLEQGEESDAVHFIAAVLIKGGLFQRSKG

SEQ ID NO: 10460 - protein, 353 aa, Acinetobacter baumannii EGD-HP18
MTIFKKLPGSLSLQRGTVVSDGAFFNLFEDGKHEPLHVMYHGIRGTQNVAGNKEKGAATGNSLAREVTNIQLTESAKLQPKAKLLVKWDFRFIDLSYVLFASASKAGADKTEEYNFRQAFLNFVNRAKESDGLKEVVRRYVRNIVNGRWLWRNRIVSESITIQVTAQDYPEIFSFDALSYNLKSFDQPSEQEQKLADILLKGITGESTNAALHIEAIVDFGMGGVEVFPSQNYLEDKPKGFSRSLYQLTPKKPDHQANDNQYLGQAALRDQKIGNALRTIDTWYPLFKENDEKPIAVEPNGANLEGQIFYRVGKDKVSAFDILKEIDELDPNSEKGMFLIACLIRGGVYSEGE

SEQ ID NO: 10461 - protein, 335 aa, Pasteurella multocida subsp. multocida str. PMTB; identical to SEQ ID NO: 10204

SEQ ID NO: 10462 - protein, 60 aa, Pseudomonas aestus
MEPYGSVTTQGKAYRQPRGSQDDFYTLLDSWVLKDRVPALDQQHFVIATLIRGGVFGEAG

SEQ ID NO: 10463 - protein, 343 aa, Vibrio cholerae HC-36A1; identical to SEQ ID NO: 10113

SEQ ID NO: 10464 - protein, 334 aa, Yersinia pestis S3; identical to SEQ ID NO: 55

SEQ ID NO: 10465 - protein, 334 aa, Yersinia pestis 24H; identical to SEQ ID NO: 55

SEQ ID NO: 10466 - protein, 334 aa, Yersinia pestis 113; identical to SEQ ID NO: 55

SEQ ID NO: 10467 - protein, 334 aa, Yersinia pestis 9; identical to SEQ ID NO: 55

SEQ ID NO: 10468 - protein, 336 aa, Photorhabdus temperata J3
MSKSTIKTASVLAFERKLSNSDAIMFAGNWVQNGGEWKPIVIQEKAVRGTISNRLKNALTSDPAKLDAEIQKANLQRVDVAALPFDADTLKVSFTLRVLGNLSTPSVCNDQDYQAELANVINGYIAEHGFKTLAARYAENLANGRFLWRNRVGVEEIEVCVKGKSGEWWTFNSEDFSLREFGKVEGNLAKLAAEIEEGLAGSGSTFFNVEAFVRLGCGQEVFPSQELVLDSNSKKSKVLYQVNEIAALHSQKVGNALRTIDTWYPDASELALGPIAVEPYGSVTSRGKAYRQPKVKMDFYTLLDNWVVKGKAPEVEQQHYVMAILIRGGVFGEKGE

SEQ ID NO: 10469 - protein, 316 aa, Megasphaera sp. BV3C16-1
MYGTTWENRFDESEIKPLSVVTKSVRGTISNRLKPTVQNDPAKLNAEVEKANLQRVDACALDMKQDTLKLSYTLKVLSGVEAPSACNHAEFGWKYKHAAEAYIQKNGFTELARRYAINIANARFLWRNRMGAEQIEVHVTADGMEWIFNGYDYSLKNFEGNSRIDELAEKIAAALSGKRPHVFIRVNAYALLGIGQEVYPSEELVLDKGRGEKSKVLYQVQGSAAMHSQKLGNAIRTIDTWYPAFGTEAGVGPIAVEPYGVVTNLGQAFRVAKEKADFYSLFDKFALGKQLDDVEQEHYVMAVLVRGGVFGQSSRE

SEQ ID NO: 10470 - protein, 342 aa, Pseudomonas aeruginosa C23; identical to SEQ ID NO: 10211

SEQ ID NO: 10471 - protein, 342 aa, Pseudomonas aeruginosa C20; identical to SEQ ID NO: 10211

SEQ ID NO: 10472 - protein, 342 aa, Pseudomonas aeruginosa M8A.1; identical to SEQ ID NO: 10211

SEQ ID NO: 10473 - protein, 342 aa, Pseudomonas aeruginosa BL15; identical to SEQ ID NO: 9879

SEQ ID NO: 10474 - protein, 342 aa, Pseudomonas aeruginosa BL16; identical to SEQ ID NO: 9879

SEQ ID NO: 10475 - protein, 342 aa, Pseudomonas aeruginosa BL10; identical to SEQ ID NO: 10211

SEQ ID NO: 10476 - protein, 342 aa, Pseudomonas aeruginosa BWHPSA028; identical to SEQ ID NO: 10024

SEQ ID NO: 10477 - protein, 342 aa, Pseudomonas aeruginosa BWHPSA027; identical to SEQ ID NO: 9879

SEQ ID NO: 10478 - protein, 342 aa, Pseudomonas aeruginosa BWHPSA024; identical to SEQ ID NO: 10211

SEQ ID NO: 10479 - protein, 342 aa, Pseudomonas aeruginosa BWHPSA021; identical to SEQ ID NO: 10211

SEQ ID NO: 10480 - protein, 342 aa, Pseudomonas aeruginosa BWHPSA023; identical to SEQ ID NO: 10211

SEQ ID NO: 10481 - protein, 342 aa, Pseudomonas aeruginosa BWHPSA020
MSKPILSTASVLAFERKLDPSDALMSAGAWAQRDASQEWPAVTVREKSVRGTISNRLKTKDRDPAKLDASIQSPNLQTVDVANLPSDADTLKVRFTLRVLGGAGTPSACNDAAYRDKLLQTVAAYVNDQGFAELARRYAHNLANARFLWRNRVGAEAVEVRINHIRQGEVARAWRFDALAIGLRDFKADAELDALAELIASGLSGSGHVLLEVVAFARIGDGQEVFPSQELILDKGDKKGQKSKTLYSVRDAAAIHSQKIGNALRTIDTWYPDEDGLGPIAVEPYGSVTSQGKAYRQPKQKLDFYTLLDNWVLRDEAPAVEQQHYVIANLIRGGVFGEAEEK

SEQ ID NO: 10482 - protein, 342 aa, Pseudomonas aeruginosa BWHPSA014; identical to SEQ ID NO: 10211

SEQ ID NO: 10483 - protein, 342 aa, Pseudomonas aeruginosa BWHPSA012; identical to SEQ ID NO: 10211

SEQ ID NO: 10484 - protein, 342 aa, Pseudomonas aeruginosa BWHPSA005; identical to SEQ ID NO: 10211

SEQ ID NO: 10485 - protein, 342 aa, Pseudomonas aeruginosa BWHPSA004; identical to SEQ ID NO: 10211

SEQ ID NO: 10486 - protein, 342 aa, Pseudomonas aeruginosa BWHPSA001; identical to SEQ ID NO: 10211

SEQ ID NO: 10487 - protein, 342 aa, Pseudomonas aeruginosa UDL; identical to SEQ ID NO: 10211

SEQ ID NO: 10488 - protein, 342 aa, Pseudomonas aeruginosa CF18
MSKPILSTASVLAFERKLDPSDALMSAGAWAQRDASQEWPAVTVREKSVRGTISNRLKTKDRDPAKLDASIQSPNLQTVDVANLPSDADTLKVRFTLRVLGGAGTPSACNDAAYRDKLLQTVATYVNEQGFAELARRYAHNLANARFLWRNRVGAEAVEVRINHIRQGEVARAWRFDALAIGLRDFKADAELDALAELIASGLSGSRHVLLEVVAFARIGDGQEVFPSQELILDKGDKKGQKSKTLYSVRDAAAIHSQKIGNALRTIDTWYPDEDGLGPIAVEPYGSVTSQGKAYRQPKQKLDFYTLLDNWVLRDEAPAVEQQHYVIANLIRGGVFGEAEEK

SEQ ID NO: 10489 - protein, 342 aa, Pseudomonas aeruginosa MSH3; identical to SEQ ID NO: 10211

SEQ ID NO: 10490 - protein, 342 aa, Pseudomonas aeruginosa E2; identical to SEQ ID NO: 10211

SEQ ID NO: 10491 - protein, 342 aa, Pseudomonas aeruginosa BL02; identical to SEQ ID NO: 10211

SEQ ID NO: 10492 - protein, 342 aa, Pseudomonas aeruginosa BWHPSA010; identical to SEQ ID NO: 9958

SEQ ID NO: 10493 - protein, 342 aa, Pseudomonas aeruginosa BWHPSA008; identical to SEQ ID NO: 9974

SEQ ID NO: 10494 - protein, 342 aa, Pseudomonas aeruginosa BWHPSA009; identical to SEQ ID NO: 10211

SEQ ID NO: 10495 - protein, 342 aa, Pseudomonas aeruginosa CF5; identical to SEQ ID NO: 10211

SEQ ID NO: 10496 - protein, 342 aa, Pseudomonas aeruginosa MSH10; identical to SEQ ID NO: 10211

SEQ ID NO: 10497 - protein, 333 aa, Escherichia coli 908519; identical to SEQ ID NO: 9995

SEQ ID NO: 10498 - protein, 333 aa, Escherichia coli 908675; identical to SEQ ID NO: 9875

SEQ ID NO: 10499 - protein, 337 aa, Acinetobacter gyllenbergii NIPH 230
MAKNEKAVASVLAFEKKLVPSDGYFYGTTWDNRNEQTALKLIPKSVRGTISNRLKPAVASDPLKLNAEVEKANLQTVDACALDEHQDTLKVGFTLKVLGGVENPSACNNEAFLNSYQTVAKSYINQYGFTELAKRYALNIANARFLWRNRVGAEKVEVVVTINDQPAITFNALEYPLHDFDHVDEKLKKLADQIAQALKGETVYLLIKIEAYALVGKAQEVYPSEELVLDKGKGDKSKILYQVNDVAAMHSQKIGNALRTIDTWYPEFDDKKTAIAIEPYGAVTNLGKAYRTPKEKKDFFTLFDKYALGESLENIEQEHYVMAVLVRGGVFGQSAKD

SEQ ID NO: 10500 - protein, 337 aa, Acinetobacter tjernbergiae DSM 14971 = CIP 107465
MAKNEKAIASVLAFEKKLVPSDGYFYGTTWINRNEQTALKLIPKSVRGTISNRLKPAVAGDPIKLNAEVEKANLQTVDACALGENQDTLKVSFTLKVLGGVENPSACNNEIFLNSYQAVAKNYIEQYGFTELAKRYALNIANARFLWRNRVGAEKVEVVVTINDQPAVTFNALQYPLHDFDQIDEKVQNLANQIAQALKGETAYLLIKVEAYALVGKAQEVYPSEELVLDKGKGNKSKILYQVNDVAAMHSQKIGNALRTIDTWYPEFDDKKTAIAIEPYGAVTNLGKAYRTPKDKVDFFNLFDKYALGESLANTEQEHYVMAVLIRGGVFGQSGKE

SEQ ID NO: 10501 - protein, 333 aa, Klebsiella oxytoca MGH 42
MAKAPVSVKTASVLAFERKLATSDAMMYAGNWLGDSWQPIEIKEKAVRGTISNRLKNAIASDATKLDAEIQKANLQRVDTAALPADADTLKVVFTLRVLGNLATPSVCNDMAYQNAIQQTIEGYISEHGFAELARRYAANLANGRFLWRNRIGAEQIQVSVSAQGQAWVFNGHDYSLREFSQDDEEIASLAALIEQGLCGQAWVMLTVEAQVRLGAGQEVFPSQELVLDSNSSKSRVLYQVAGIAGIHSQKIGNALRTIDTWHPKVDELGAIAVEPYGSVTSRGMACRQPKDKMDFYTLLDSWVTKGIKPDVEQQHYVMAVLIRGGVFGEKSE

SEQ ID NO: 10502 - protein, 332 aa, Enterobacter roggenkampii MGH 34
MAKAPTAVKTASVLAFERKLATSDAVMYSGSWQGNQWQPIRIQEKAVRGTISNRLKNALTNDPAKLDAEIQKANLQRVDVASLPADADTLKVKFTLRVLGNLSTPSVCNDRAYQDELQQVIDGYITEHGFAELARRYATNLANGRFLWRNRVGAEKIIVNVTGSKSWTFDAYNYALRDFTASDESLNALAQEIEKGLSGGGFVLLNVEAQVLLGAGQEIFPSQELVLDSNSSKSRLLYQVDSVAGMHSQKIGNAIRTIDTWHPQVDALGAIAVEPYGSVTSRGVACRQPKEKMDFYTLLDNWVTKGLKPEVEQQHYVMAVLIRGGVFGEKGD

SEQ ID NO: 10503 - protein, 333 aa, Klebsiella oxytoca MGH 28; identical to SEQ ID NO: 10501

SEQ ID NO: 10504 - protein, 332 aa, Enterobacter sp. MGH 23
MAKAPTAVKTASVLAFERKLATSDAVMYSGSWEGKAWQPIRIQEKAVRGTISNRLKNALTNDPAKLDAEIQKANLQRVDVAALPADADTLKVKFTLRVLGNLSMPSVCNDRAYQDELQQGIDGYISEHGFAELARRYATNLANGRFLWRNRVGAEKISVNVTGSNAWTFDAYNYALRDFSASDENLNALAQEIEKGLSGEGFVLLNVEAQVLLGAGQEIFPSQELVLDSNSSKSRLLYQVDSVAGMHSQKIGNAIRTIDTWHPKVDELGAIAVEPYGSVTSRGVACRQPKEKMDFYTLLDNWVTKGQKPDVEQQHYVMAVLIRGGVFGEKGE

SEQ ID NO: 10505 - protein, 332 aa, Enterobacter sp. MGH 22; identical to SEQ ID NO: 10504

SEQ ID NO: 10506 - protein, 335 aa, Serratia sp. ATCC 39006
MAKATALKTASVLAFERKLANSDALMYAGNGTQQGNWIPIVIQEKSVRGTISNRLKNALASDPAKLDTEIQKANLQKVDVAALPFDAGTLKVVFTLRVLGNLAQPSVCNDQDYQVALAHIITGYVDEHGFAVLATRYAENIANGRFLWRNRIGAEAIRVVVTQGQQRWEFNGEDYSLRQFSQPSAELTALAKAIEQGLTGESSALFTVEAFVQLGNGQEVFPSQELILDEKARNGKSKILYQVNGIAAIHSQKIGNALRTIDDWHPAADEAGPIAVEPYGSVTSRGKAYRQPKEKMDFYTLLDNWVIKNDVPAPEQQHYVIATLIRGGVFGEKGE

SEQ ID NO: 10507 - protein, 333 aa, Escherichia coli HVH 12 (4-7653042); identical to SEQ ID NO: 9875

SEQ ID NO: 10508 - protein, 333 aa, Escherichia coli HVH 148 (4-3192490); identical to SEQ ID NO: 9875

SEQ ID NO: 10509 - protein, 333 aa, Escherichia coli HVH 178 (4-3189163); identical to SEQ ID NO: 9875

SEQ ID NO: 10510 - protein, 36 aa, Pasteurella multocida subsp. multocida P1062; identical to SEQ ID NO: 10375

SEQ ID NO: 10511 - protein, 297 aa, Pasteurella multocida subsp. multocida P1062; identical to SEQ ID NO: 10377

SEQ ID NO: 10512 - protein, 333 aa, Escherichia coli CE418; identical to SEQ ID NO: 10037

SEQ ID NO: 10513 - protein, 347 aa, Vibrio parahaemolyticus 10296; identical to SEQ ID NO: 10102

SEQ ID NO: 10514 - protein, 347 aa, Vibrio parahaemolyticus 12310; identical to SEQ ID NO: 10102

SEQ ID NO: 10515 - protein, 111 aa, Escherichia coli ATCC BAA-2209
MAKAPVAVKTASVLAFERKLATSDAVMYAGNWQGNEWQPIEIQEKAVRGTISNRLKDAISSNELKLNAEIQKANLQRVDVAALPVDADTLKVMFTLRVLGNLSSPSVCNDM

SEQ ID NO: 10516 - protein, 333 aa, Escherichia coli HVH 214 (4-3062198); identical to SEQ ID NO: 9875

SEQ ID NO: 10517 - protein, 342 aa, Pseudoalteromonas agarivorans
MQLPRHLSYTRSLSPSKAVFFYKTPESDFEPLQIEQNKLVGQKSGFGDAYQKQNVAKNLAPQDLAFGNPQTIDVCYVPPTVNELFCRFSLRVEANSLEPYVCDDPKAIYWLKRFFETYKKHNGLNEVATRYAKNILMGNWLWRNRQSPNVDIEILTEHSDPIIVEGAQKLKWQGNWQNNQTALITLSEAIQEGLSNPQNYCYLDITAKIKNAFSQEVHPSQKFVDTVEQGMSSKQLAYTQVGDKKAASLNSQKVGAAIQTIDDWYEGGYKPLRTHEYGADKQILVAHRTPKSHSDFYSLLPRIALHIKHMEKHGLGRSEESNAVHFIAAVLIKGGLFQRSKG

SEQ ID NO: 10518 - protein, 347 aa, Vibrio parahaemolyticus EKP-008; identical to SEQ ID NO: 9963

SEQ ID NO: 10519 - protein, 353 aa, Acinetobacter baumannii UH22908
MTIFKKLPGSLSLQRGTVVSDGAFFNLFEDGKQEPLHVMYHGIRGTQNVAGNKEKGAATGNSLAREVTNIQLTESAKLQPKAKLLVKWDFRFIDLSYVLFASASKAGADKTEEYNFRQAFLNFVNRAKESDGLKEVVRRYVRNIVNGRWLWRNRIVAETITIQVTAQDYPEIFSFDALSYNLKSFDQTSEQEQKLADILLKGITGESTSAALHIEAIVDFGMGGVEVFPSQNYLEDKPKGFSRSLYQLTPKKPDHQANDNQYLGQAALRDQKIGNALRTIDTWYPLFKENDEKPIAVEPNGANLEGQIFYRVGKDKVSAFDILKEIDELDPNSEKGMFLIACLIRGGVYSEGE

SEQ ID NO: 10520 - protein, 353 aa, Acinetobacter baumannii UH7607; identical to SEQ ID NO: 10519

SEQ ID NO: 10521 - protein, 353 aa, Acinetobacter baumannii UH6907; identical to SEQ ID NO: 10519

SEQ ID NO: 10522 - protein, 353 aa, Acinetobacter baumannii UH7907; identical to SEQ ID NO: 10519

SEQ ID NO: 10523 - protein, 337 aa, Acinetobacter baumannii CI86; identical to SEQ ID NO: 10015

SEQ ID NO: 10524 - protein, 337 aa, Acinetobacter baumannii CI79; identical to SEQ ID NO: 10015

SEQ ID NO: 10525 - protein, 347 aa, Vibrio parahaemolyticus B-265; identical to SEQ ID NO: 9979

SEQ ID NO: 10526 - protein, 347 aa, Vibrio parahaemolyticus 605; identical to SEQ ID NO: 9979

SEQ ID NO: 10527 - protein, 347 aa, Vibrio parahaemolyticus 50; identical to SEQ ID NO: 9969

SEQ ID NO: 10528 - protein, 347 aa, Vibrio parahaemolyticus 3256; identical to SEQ ID NO: 10102

SEQ ID NO: 10529 - protein, 342 aa, Pseudomonas aeruginosa Z61; identical to SEQ ID NO: 10211

SEQ ID NO: 10530 - protein, 342 aa, Pseudomonas aeruginosa BWHPSA048; identical to SEQ ID NO: 10211

SEQ ID NO: 10531 - protein, 342 aa, Pseudomonas aeruginosa BWHPSA044; identical to SEQ ID NO: 9879

SEQ ID NO: 10532 - protein, 342 aa, Pseudomonas aeruginosa BWHPSA040; identical to SEQ ID NO: 10211

SEQ ID NO: 10533 - protein, 342 aa, Pseudomonas aeruginosa BWHPSA038; identical to SEQ ID NO: 10481

SEQ ID NO: 10534 - protein, 347 aa, Vibrio parahaemolyticus IDH02640; identical to SEQ ID NO: 9979

SEQ ID NO: 10535 - protein, 347 aa, Vibrio parahaemolyticus SBR10290; identical to SEQ ID NO: 10102

SEQ ID NO: 10536 - protein, 347 aa, Vibrio parahaemolyticus IDH02189; identical to SEQ ID NO: 9979

SEQ ID NO: 10537 - protein, 347 aa, Vibrio parahaemolyticus Peru-288; identical to SEQ ID NO: 9979

SEQ ID NO: 10538 - protein, 347 aa, Vibrio parahaemolyticus EKP-028; identical to SEQ ID NO: 9979

SEQ ID NO: 10539 - protein, 333 aa, Escherichia coli BIDMC 49b; identical to SEQ ID NO: 9875

SEQ ID NO: 10540 - protein, 333 aa, Escherichia coli BIDMC 49a; identical to SEQ ID NO: 9875

SEQ ID NO: 10541 - protein, 347 aa, Vibrio parahaemolyticus 861; identical to SEQ ID NO: 9979

SEQ ID NO: 10542 - protein, 347 aa, Vibrio parahaemolyticus EKP-026; identical to SEQ ID NO: 9979

SEQ ID NO: 10543 - protein, 332 aa, Enterobacter sp. BIDMC 28
MAKAPTAVKTASVLAFERKLATTDAVMYSGSWQGETWQPIRIQEKAVRGTISNRLKNALTNDPAKLDAEIQKANLQRVDVAALPADADTLQVKFTLRVLGNLSTPSVCNDRAYQDALQQVIDGYISEHGFAELARRYATNLANGRFLWRNRVGAEKITVNVTGSKTWTFDAYCYALRDFSASDKNLEALAQEIEKGLSGEGFVLLNVEAQVLLGAGQEVFPSQELVLDSNSSKSRLLYQVDNVAGMHSQKIGNAIRTIDTWHPKVDELGAIAVEPYGSVTSRGVACRQPKEKMDFYTLLDNWVTKGQKPDVAQQHYVMAVLIRGGVFGEKGE

SEQ ID NO: 10544 - protein, 347 aa, Vibrio parahaemolyticus V14/01; identical to SEQ ID NO: 9979

SEQ ID NO: 10545 - protein, 342 aa, Pseudomonas aeruginosa VRFPA09; identical to SEQ ID NO: 9879

SEQ ID NO: 10546 - protein, 347 aa, Vibrio parahaemolyticus V-223/04; identical to SEQ ID NO: 9979

SEQ ID NO: 10547 - protein, 306 aa, Vibrio parahaemolyticus EKP-021
MKEGSKSAYKYDGQIDADVTAYSLAQGNPHEIDFCCVPYGAESIECEFSVSFASSLRKPFKCSDPEVKRTLVQLIKLYEEKVGWEELANRFLENICNGRWLWRNNECTYSTSIGIKPWPWEDEKAISPFHDIRKNYAGTNHFRDHKDWDNLIKLITDAFSQPNGLCIFEVSATFRLGTNAPIYPSQVFKDSVKGEKNRIYQSTDVDGESSPILGCYKTGAAIATIDDWYPDADKPIRISHYGAHREDVYCYRHPNTGKDLFTLLEKADQYLEQLQATDVLPDEMINDLHFIVANLIKGGLLQQKGT

SEQ ID NO: 10548 - protein, 343 aa, Vibrio vulnificus BAA87
MELCTQLNYVRSLSVGKAYFYYLSESGEMCPLNVDRTRLRAPKGSYSEAYKGNKFVDKNVAPQDLAYSNPQFIEECYVKPGVDEIYCAFSLRIRANSLTPDICSDDEARRKLSMLAKIYKDLNGYKELAHRYAKNILLGTWLWRNRQCRNITIEVTTSELDTFVVEHAQKLSWYGHWDGDSTECLERLTAYLERALSDPSEYFYMDVKARMRVGWGDEVYPSQEFLDSREDGVPTKQLAKIDLLSGKETVAFHGQKVGAALQSIDDWWHENADKPLRVNEYGADREYVIARRHLTHGNDFYQLVRNTESWIETMTASQTIPNDVHFIMSVLIKGGLFNCSKAK

SEQ ID NO: 10549 - protein, 342 aa, Pseudoalteromonas sp. BSi20652
MQLPRHLSYTRSLSPSKAVFFYKTMESDFEPLQIEQNKLVGQKSGFGDAYQKQNVAKNLAPQDLAFGNPQTIDVCYVPPTVNELFCRFSLRVEANSNEPHVCDDPKVIYWLKRFFETYKKHNGLNEVATRYAKNILMGNWLWRNRQSPNVDIEILTEHSDPIIVEGAQKLKWQGNWKNNQTALLTLSEAIQEGLSNPQNYCYLDITAKIKNAFSQEVHPSQKFVDNVEQGMSSKQLAYTQVGDKKAASLNSQKVGAAIQTIDDWYEGGYKPLRTHEYGADKQILVAHRTPKSHSDFYSLLPRIALHIKHMEKHGLEQNEKSNTVHFIAAVLIKGGLFQRSKG

SEQ ID NO: 10550 - protein, 91 aa, Pseudoalteromonas sp. BSi20652
MHSQKLGNALRSIDTWYPEFDDEEKTAGPIAIEPYGAVTNLGKAYRTPKDKQDFYTFFDKWARGTELDRIEDEHYVMAILVRGGVFGESDK

SEQ ID NO: 10551 - protein, 258 aa, Pseudoalteromonas sp. BSi20652
MAKNQDTASVLAFEKKLVPSDGYMYGTQWEDRNNKSIQTPLQLIEKSVRGTISNRLKAAIKSDPVKLNAEVEKANLQTVDSCALDPEQDTLKLHFTLKVLGGVQTPSACNNALFKESYSKAVSTYVKKEGFKELGKRYALNLANARFLWRNRVGAENIEVQVNALNKNSKQSWMFDATQFSTRHFNNDDKQVAELGERIALALSSSDDFLMLEINCFVQVGKAQEVYPSEELVLDKGKGKKVKYSIQSKILPLCIRKN

SEQ ID NO: 10552 - protein, 342 aa, Pseudoalteromonas sp. BSi20480
MQLPRHLSYSRSLSPSKAVFFYKTPESDFEPLQIEQNKLVGQKSGFGDAYQKQGEAKNLAPQDLAFGNPQTIDVCYVPPTVNELFCRFSLRVEANSNEPHVCDDPKVIYWLKRFFETYKKHNGFNDVATRYAKNILMGNWLWRNRQSPNVDIEILTEHAAPIIVEGVQKLKWQGNWQNNQTALLTLSEAIQEGLSNPQNYCYLDITAKIKNAFSQEVHPSQKFVDNVEQGMSSKQLAYTQVGDKKAASLNSQKVGAAIQTIDDWYEGGYKPLRTHEYGADKQILVAHRTPKSHSDFYSLLPRIAMHIKHMEKHGLGQSEQSDAVHFIAAVLIKGGLFQRSKG

SEQ ID NO: 10553 - protein, 342 aa, Pseudoalteromonas sp. BSi20495
MQLPRHLSYTRSLSPSKAVFFYKTPESDFEPLQIEQNKLVGQKSGFGDAYQKQDVAKNLAPQDLAFGNPQTIDVCYVPPTVNELFCRFSLRVEANSNEPHVCDDPKVIYWLRRFFETYKKNNGLNEVATRYAKNILMGNWLWRNRQSPNVDIEILTENSDPIIVESAQKLKWQGNWQNNQTALLTLSEAIQEGLSNPQNYCYLDITAKIKNAFSQEVHPSQKFVDNVEQGMSSKQLAYTQVGDKKAASLNSQKVGAAIQTIDDWYEGGYKPLRTHEYGADKQILVAHRTPKTHSDFYSLLPRIALHIKYMEKHGLEQSEESDAVHFIAAVLIKGGLFQRSKA

SEQ ID NO: 10554 - protein, 327 aa, Pseudoalteromonas sp. BSi20495
MAEIKLKTPSVLAFEAKLVPSDALMFAGNWEQQAWQAIQVGEKAVRGTISNRLKAATANDPTKLDAEVSKANLQTVDIAALAHNTDTLKVVFTLRVLSDLATPSTCNNPDYQAQLANKITQYQTEVSFEELSKRYAFNIASARFLWRNRVGAENVKVVVTVANETIEFNCQYYSLREFSSDEKITQLAHFIQQGLTDNHVLIKVQAYSQLGEGQAVYPSQELVMGGGKGDKSKFLYQLDGQAAMHSQKIGNALRTIDTWHPAVDEVGPIAVEPYGSVTNRGAAYRQPKEKTDFYNLLDAWMIKGKVPAIEQQHYIMAMLIRGGVFGE

SEQ ID NO: 10555 - protein, 353 aa, Acinetobacter radioresistens DSM 6976 = NBRC 102413 = CIP 103788; identical to SEQ ID NO: 10343

SEQ ID NO: 10556 - protein, 327 aa, Paraglaciecola chathamensis S18K6
MAEVKLKTPSVLAFEAKLVPSDALMFAGNWEQKAWQSIQVGEKAVRGTISNRLKAATANDPTKLDAEVSKANLQTVDIAALAHSTDTLKVVFTLRVLSNLATPSTCNNPDYQAELAEKIKQYQTDVSFEELSKRYAFNIASARFLWRNRVGAENVKVVVTVENQTIEFNCQDYSLREFSSDEKIIQLAQFIQQGLTDNHVLIKVEAYSQLGEGQAVYPSQELVMGGGKGDKSKFLYQLDGQAAMHSQKIGNALRTIDTWHPAVDEVGPIAVEPYGSVTNRGAAYRQPKEKTDFYNLLDAWMIKGKEPAVEQQHYIMAMLIRGGVFGE

SEQ ID NO: 10557 - protein, 327 aa, Aliiglaciecola lipolytica E3
MAEIKLKTPSVLAFEAKLVPSDALMFAGNWEQQEWQPIQVGEKAVRGTISNRLKAATANDPTKLDAEVSKANLQTVDIAALAHKTNTLKVVFTLRVLSDLATPSTCNNPDYQAELANKIKQYQADVSFEELSKRYAFNIATARFLWRNRVGAENVKVVVTVANETIEFNSQDYSLREFSSDAKITQLAKFIQQGLTDNHVLIKVEAYSQLGEGQAVYPSQELVMGGGKSDKSKFLYQLDGQAAMHSQKIGNALRTVDTWHPAVDEVGPIAVEPYGSVTNRGAAYRQPKEKTDFYNLLDAWMIKGKEPAVEQQHYIMAMLIRGGVFGE

SEQ ID NO: 10558 - protein, 341 aa, Paraglaciecola arctica BSs20135
MAKKDNIASVLAFEKKLVTSDGYMYGTTWDTRSQITPLALREKSVRGTISNRLKAAIKSDPAKLNAEVEKANLQRVDACAVAPEQDTLNLQFTVKVLGGITQPSACNNALFKQSYSAAAKEYITTEAFTELARRYASNIANARFLWRNRVGAEKIEVQVKAKNSTVDESWVFDATQFSTRNFDFNDDAINALAKYIAKALASADDFLLLDISCFVQVGKAQEVYPSEELVLDKGKGEKSKILYDVNGIAAMHSQKIGNALRTIDTWYPEFTDPETSAGPIAIEPYGAVTNLGKAYRTPAAKQDFYTFFDVWARGEKLSRVEDEHYVMAILVRGGVFGESDK

SEQ ID NO: 10559 - protein, 322 aa, Paraglaciecola polaris LMG 21857
MSIKLPTMLAFERKLETSDALMMSGDWEHLTTENPTWLPIKITKRQNRSTQSAYGASDENKTKPNPVSSDSDDANLPNDKDTLKVSFTLRIVGNLGEPFGCNDPNFEEIIKEKVSEYKQEGLKELSHRYAHNIASGRFLWRNRVCAKNISIQIRINDNELPITFDGYEFPLNDFDAQRENNSLKTLSNAIFQGLESINDFACLQVDAFVQLGKGQHVFPSQEMNMGEKKKVLFKLDDCAALHSVKVGNAIRTIDNWYDDAKFPIAVEPFGSVTQRGQAYRKSKIDLYTLMIAWVNNKDVSGEQKNFVLANLIRGGVFGGKAE

SEQ ID NO: 10560 - protein, 346 aa, Vibrio azureus NBRC 104587
MRLCNQLNYLRSLSTGKAYFYSLSSDGTINPIGLDRTRLRAPKGGYSEAYQGNNFSPKNVAPQDLAYANPQFIEECYVRPGVDEIYCAFSLRISANSLTPQICNDDDVRTQLSQLARVYKELGGYSELANRYAKNILLGTWLWRNRGPRNIKIEVRTSDSDLFVIDNALRLSWYGQWDNKSSECLKKLTDYFARALSEPTEYFYLDVKAEITVGWGDEIYPSQKFLDTKEHDMPTKQFATIELESGQQTVALHGQKVGAALQLIDDWWHEEADKPLRVNEYGADREYVIARRHPKFKNDFYHLIQNTEAWVEDMVVSQTIPNEVHFIMSILVKGGLFNGSSPKKDK

SEQ ID NO: 10561 - protein, 334 aa, Yersinia pseudotuberculosis NBRC 105692; identical to SEQ ID NO: 9900

SEQ ID NO: 10562 - protein, 335 aa, Pasteurella multocida subsp. multocida str. Pm70; identical to SEQ ID NO: 9868

SEQ ID NO: 10563 - protein, 334 aa, Yersinia pestis KIM10+; identical to SEQ ID NO: 55

SEQ ID NO: 10564 - protein, 347 aa, Vibrio parahaemolyticus RIMD 2210633; identical to SEQ ID NO: 9979

SEQ ID NO: 10565 - protein, 369 aa, Coxiella burnetii RSA 493; identical to SEQ ID NO: 9870

SEQ ID NO: 10566 - protein, 344 aa, Chromobacterium violaceum ATCC 12472; identical to SEQ ID NO: 9871

SEQ ID NO: 10567 - protein, 337 aa, Photorhabdus luminescens subsp. laumondii TTO1; identical to SEQ ID NO: 9983

SEQ ID NO: 10568 - protein, 334 aa, Yersinia pestis biovar Microtus str. 91001; identical to SEQ ID NO: 55

SEQ ID NO: 10569 - protein, 342 aa, Pseudomonas aeruginosa UCBPP-PA14; identical to SEQ ID NO: 9879

SEQ ID NO: 10570 - protein, 353 aa, Acinetobacter baumannii
MTIFKKLPGSLSLQRGTVVSDGAFFNLFEDGKQEPLHVMYHGIRGTQNVAGNKEKGAATGNSLAREVTNIQLTESAKLQPKAKLLVKWDFRFIDLSYVLFASASKAGADKTEEYNFRQAFLNFVNRAKESDGLKEVVRRYVRNIVNGRWLWRNRIVAESITIQVTAQDHPETLSFDALSYNLKSFDQPSEQEQKLADILLKGITGESTSAALHIEAIVDFGMGGVEVFPSQNYLEDKPKGFSRSLYQLTPKKPDHKANDNQYLGQAALRDQKIGNALRTIDTWYPQFKENDEKPIAVEPNGANLEGQIFYRVGKDKVSAFDILKEIDELDPNSEKGMFLIACLIRGGVYSEGE

SEQ ID NO: 10571 - protein, 353 aa, Acinetobacter baumannii; identical to SEQ ID NO: 10054

SEQ ID NO: 10572 - protein, 353 aa, Acinetobacter baumannii
MTIFKKLPGSLSLQRGTVVSDGAFFNLFEDGKQEPLHVMYHGIRGTQNVAGNKEKGAATGNSLAREVTNIQLTESAKLQPKAKLLVKWDFRFIDLSYVLFASASKAGADKTEEYNFRQAFLNFVNRAKESDGLKEVVRRYVRNIVNGRWLWRNRIVAESITIQVTAQDYPEIFSFEALSYNLKSFDQPSEQEQKLAEILLKGITGESTSAALHIEAIVDFGMGGVEVFPSQNYLEDKPKGFSRSLYQLTPKKPDHQANDNQYLGQAALRDQKIGNALRTIDTWYPLFKENDEKPIAVEPNGANLEGQIFYRVGKDKVSAFDILKEIDELDPNSEKGMFLIACLIRGGVYSEGE

SEQ ID NO: 10573 - protein, 353 aa, Acinetobacter; identical to SEQ ID NO: 10519

SEQ ID NO: 10574 - protein, 353 aa, Acinetobacter baumannii
MTIFKKLPGSLSLQRGTVVSDGAFFNLFEDGKQEPLRVMYHGIRGTQNVAGNKEKGAATGNSLAREVTNIQLTESAKLQPKAKLLVKWDFRFIDLSYVLFASASKAGADKTEEYNFRQAFLNFVNRAKESDGLKEVVRRYVRNIVNGRWLWRNRIVAESITIQVTAQDYPEIFSFDALSYNLKSFDQPSEQEQKLADILLKGITGESTSAALHIEAIVDFGMGGVEVFPSQNYLEDKPKGFSRSLYQLTPKKPDHQANDNQYLGQAALRDQKIGNALRTIDTWYPLFKENDEKPIAVEPNGANLEGQIFYRVGKDKVSAFDILKEIDELDPNSEKGMFLIACLIRGGVYSEGE

SEQ ID NO: 10575 - protein, 343 aa, Vibrio; identical to SEQ ID NO: 10059

SEQ ID NO: 10576 - protein, 343 aa, Vibrio cholerae
MELCTQLNYVRSLSAGKAYFYYLSESGEMCPLDVDRTRLRAPKGSYSEAYKGNKFVDKNVAPQDLAYSNPQFIEECYVKPGVDEIYCAFSLRIRANSLTPDMCSDDEVRSKLSMLAKIYKDLNGYKELAHRYAKNILLGTWLWRNRECRNITIEVTTSELDTFVVEHAQKLSWYGHWDGDSTECLERLTAYLERALSDPTEYFYMDVKAKMRVGWGDEVYPSQEFLDSREDGIPTKQLATVELLSGKETVAFHGQKVGAALQSIDDWWNENADKPLRVNEYGADREYVIARRHVTHGNDFYQLVRNTENWIETMTASRTIPNDVHFIMSVLIKGGLFNCAKAN

SEQ ID NO: 10577 - protein, 343 aa, Vibrio; identical to SEQ ID NO: 10057

SEQ ID NO: 10578 - protein, 275 aa, Acinetobacter baumannii; identical to SEQ ID NO: 9908

SEQ ID NO: 10579 - protein, 352 aa, Vibrio cholerae; identical to SEQ ID NO: 10200

SEQ ID NO: 10580 - protein, 333 aa, Escherichia coli; identical to SEQ ID NO: 9875

SEQ ID NO: 10581 - protein, 333 aa, Escherichia coli; identical to SEQ ID NO: 9930

SEQ ID NO: 10582 - protein, 333 aa, Escherichia coli; identical to SEQ ID NO: 9995

SEQ ID NO: 10583 - protein, 333 aa, Escherichia
MAKAPVAIKTASVLAFERKLATSDAVMYAGNWQGNEWQPIEIQEKAVRGTISNRLKNTIASDPTKLDAEIQKANLQRVDVASLPVDADTLKVVFTLRVLGNLSSPSVCNDMAYQEALSEVIEGYISEHGFKELALRYALNLANGRFLWRNRIGAEQILVKVTANDTSWTFNSHDFSLRQFGQGQSSVTELAATIEQGLSGKEWVMLTVETQVRLGAGQEVFPSQELVLDSNSSKSRVLYQVAGIAGIHSQKIGNALRTIDTWHPKVDELGAIAVEPYGSVTSRGVACRQPKEKLDFYTLLDNWVTKGVKPEVDQQHYVMAVLIRGGVFGEKAE

SEQ ID NO: 10584 - protein, 333 aa, Escherichia sp. TW09231
MAKAPVAIKTASVLAFERKLATSDAVMYAGNWQGNEWQPIEIQEKAVRGTISNRLKNTIASDPTKLDAEIQKANLQRVDVASLPVDADTLKVVFTLRVLGNLSSPSVCNDMTYQEALSEVIEGYISEHGFKVLALRYALNLANGRFLWRNRIGAEQSQVKVTANDISWTFNSHDFSLRQFDQEQAAVTQLATIIEQGLSGKEWVMLTVEAQVRLGAGQEVFPSQELVLDSNSSKSRVLYKVAGIAGIHSQKIGNALRTIDTWHPKVEELGAIAVEPYGSVTSRGVACRQPKEKLDFYTLLDNWVTKGVKPEVDQQHYVMAVLIRGGVFGEKAE

SEQ ID NO: 10585 - protein, 333 aa, Escherichia coli; identical to SEQ ID NO: 10115

SEQ ID NO: 10586 - protein, 333 aa, Enterobacteriaceae; identical to SEQ ID NO: 10037

SEQ ID NO: 10587 - protein, 333 aa, Escherichia
MAKAPVAVKTASVLAFERKLATSDAVMYAGNWQGNEWQPIEIQEKAVRGTISNRLKDAISSNELKLNAEIQKANLQRVDVAALPVDADTLKVMFTLRVLGNLSSPSVCNDMAYQEALSDVIEGYISEHGFKELALRYALNLANGRFLWRNRIGAEQIQVKVTANDKSWTFNSHDFSLRQFDQGQSSVTELASTIEQGLSGKEWVMLTVEAQVRLGAGQEVFPSQELVLDSNSSKSRVLYQVAGIAGIHSQKIGNALRTIDTWHPKVDELGAIAVEPYGSVTSRGVACRQPKEKLDFYTLLDNWVTKGMKPDVEQQHYVMAVLIRGGVFGEKSE

SEQ ID NO: 10588 - protein, 333 aa, Escherichia albertii
MAKAPVAVKTASVLAFERKLATSDAVMYAGNWQGNEWQPIEIQEKAVRGTISNRLKDAISSNELKLNAEIQKANLQRVDVAALPVDADTLKVMFTLRVLGNLSSPSVCNDMAYQEALSDVIEGYISEHGFKELALRYALNLANGRFLWRNRIGAEQIQVKVTANDKSWTFNSHDFSLRQFEQGQSSVTKLASTIEQGLSGKEWVMLTVEAQVRLGAGQEVFPSQELVLDSNSSKSRVLYQVAGIAGIHSQKIGNALRTIDTWHPKVDELGAIAVEPYGSVTSRGVACRQPKEKLDFYTLLDNWVTKGMKPDVEQQHYVMAVLIRGGVFGEKSE

SEQ ID NO: 10589 - protein, 337 aa, Acinetobacter; identical to SEQ ID NO: 9909

SEQ ID NO: 10590 - protein, 337 aa, Acinetobacter; identical to SEQ ID NO: 10015

SEQ ID NO: 10591 - protein, 337 aa, Acinetobacter baumannii; identical to SEQ ID NO: 10334

SEQ ID NO: 10592 - protein, 343 aa, Vibrio mimicus; identical to SEQ ID NO: 10052

SEQ ID NO: 10593 - protein, 343 aa, Vibrio; identical to SEQ ID NO: 10113

SEQ ID NO: 10594 - protein, 333 aa, Escherichia sp. KTE11; identical to SEQ ID NO: 10245

SEQ ID NO: 10595 - protein, 333 aa, Escherichia coli; identical to SEQ ID NO: 10303

SEQ ID NO: 10596 - protein, 333 aa, Escherichia coli; identical to SEQ ID NO: 10304

SEQ ID NO: 10597 - protein, 333 aa, Escherichia coli; identical to SEQ ID NO: 10306

SEQ ID NO: 10598 - protein, 333 aa, Escherichia coli; identical to SEQ ID NO: 10313

SEQ ID NO: 10599 - protein, 307 aa, Acinetobacter baumannii; identical to SEQ ID NO: 10203

SEQ ID NO: 10600 - protein, 78 aa, Acinetobacter baumannii; identical to SEQ ID NO: 10236

SEQ ID NO: 10601 - protein, 334 aa, Yersinia pseudotuberculosis complex; identical to SEQ ID NO: 55

SEQ ID NO: 10602 - protein, 304 aa, Yersinia pestis; identical to SEQ ID NO: 10060

SEQ ID NO: 10603 - protein, 40 aa, Yersinia pestis; identical to SEQ ID NO: 10062

SEQ ID NO: 10604 - protein, 345 aa, Grimontia indica; identical to SEQ ID NO: 10355

SEQ ID NO: 10605 - protein, 345 aa, Xanthomonas fragariae; identical to SEQ ID NO: 10354

SEQ ID NO: 10606 - protein, 357 aa, Nitrosococcus oceani; identical to SEQ ID NO: 9874

SEQ ID NO: 10607 - protein, 339 aa, Thauera sp. 28; identical to SEQ ID NO: 10316

SEQ ID NO: 10608 - protein, 247 aa, Acinetobacter baumannii; identical to SEQ ID NO: 10294

SEQ ID NO: 10609 - protein, 342 aa, Pseudomonas aeruginosa; identical to SEQ ID NO: 9958

SEQ ID NO: 10610 - protein, 72 aa, Acinetobacter baumannii; identical to SEQ ID NO: 10290

SEQ ID NO: 10611 - protein, 342 aa, Pseudomonas; identical to SEQ ID NO: 9879

SEQ ID NO: 10612 - protein, 342 aa, Pseudomonas; identical to SEQ ID NO: 10211

SEQ ID NO: 10613 - protein, 178 aa, Acinetobacter baumannii; identical to SEQ ID NO: 10295

SEQ ID NO: 10614 - protein, 301 aa, Pseudomonas aeruginosa; identical to SEQ ID NO: 10011

SEQ ID NO: 10615 - protein, 86 aa, Acinetobacter baumannii
QKIGNALRTIDTWYPEFDEKKAAIAIEPYGAVTNLGKAYRTPKDKKDFFSLFDKYALGESLENPEQEHYVMAVLVRGGVFGQSGKE

SEQ ID NO: 10616 - protein, 304 aa, Acinetobacter baumannii; identical to SEQ ID NO: 10293

SEQ ID NO: 10617 - protein, 33 aa, Acinetobacter baumannii; identical to SEQ ID NO: 10291

SEQ ID NO: 10618 - protein, 339 aa, Pseudomonas oleovorans; identical to SEQ ID NO: 10007

SEQ ID NO: 10619 - protein, 335 aa, Moraxella catarrhalis; identical to SEQ ID NO: 10094

SEQ ID NO: 10620 - protein, 335 aa, Moraxella catarrhalis; identical to SEQ ID NO: 10092

SEQ ID NO: 10621 - protein, 335 aa, Moraxella; identical to SEQ ID NO: 10095

SEQ ID NO: 10622 - protein, 341 aa, Hafnia alvei; identical to SEQ ID NO: 10128

SEQ ID NO: 10623 - protein, 338 aa, Morganella morganii; identical to SEQ ID NO: 10288

SEQ ID NO: 10624 - protein, 366 aa, Acinetobacter lwoffii; identical to SEQ ID NO: 10058

SEQ ID NO: 10625 - protein, 342 aa, Pseudomonas aeruginosa; identical to SEQ ID NO: 10023

SEQ ID NO: 10626 - protein, 342 aa, Pseudomonas; identical to SEQ ID NO: 10024

SEQ ID NO: 10627 - protein, 334 aa, Yersinia kristensenii; identical to SEQ ID NO: 10047

SEQ ID NO: 10628 - protein, 298 aa, Moraxella catarrhalis; identical to SEQ ID NO: 10093

SEQ ID NO: 10629 - protein, 337 aa, Acinetobacter bohemicus; identical to SEQ ID NO: 10317

SEQ ID NO: 10630 - protein, 337 aa, Acinetobacter proteolyticus; identical to SEQ ID NO: 10318

SEQ ID NO: 10631 - protein, 353 aa, Acinetobacter; identical to SEQ ID NO: 10319

SEQ ID NO: 10632 - protein, 234 aa, Acinetobacter sp. CIP-A165; identical to SEQ ID NO: 10320

SEQ ID NO: 10633 - protein, 337 aa, Acinetobacter; identical to SEQ ID NO: 10321

SEQ ID NO: 10634 - protein, 335 aa, Yersinia; identical to SEQ ID NO: 10048

SEQ ID NO: 10635 - protein, 340 aa, Acinetobacter lwoffii; identical to SEQ ID NO: 10322

SEQ ID NO: 10636 - protein, 109 aa, Acinetobacter calcoaceticus/baumannii complex
MFNEDEEKLAHENWYKNNDPIAYKFYRDLSPEFETDFYTSEIAWLARAKAQAVPDTHIVVPRNREVVVAIEKMVEQQVEASGITSDVFRLDGWRILDAIQEASESGAEG

SEQ ID NO: 10637 - protein, 346 aa, Acinetobacter sp. ANC 3789; identical to SEQ ID NO: 10325

SEQ ID NO: 10638 - protein, 337 aa, Acinetobacter sp. CIP 102129; identical to SEQ ID NO: 10327

SEQ ID NO: 10639 - protein, 353 aa, Acinetobacter sp. NIPH 758; identical to SEQ ID NO: 10329

SEQ ID NO: 10640 - protein, 337 aa, Acinetobacter sp. CIP 102637; identical to SEQ ID NO: 10331

SEQ ID NO: 10641 - protein, 337 aa, Acinetobacter sp. CIP 56.2; identical to SEQ ID NO: 10332

SEQ ID NO: 10642 - protein, 353 aa, Acinetobacter bereziniae; identical to SEQ ID NO: 10333

SEQ ID NO: 10643 - protein, 365 aa, Acinetobacter gerneri; identical to SEQ ID NO: 10335

SEQ ID NO: 10644 - protein, 353 aa, Acinetobacter venetianus; identical to SEQ ID NO: 10336

SEQ ID NO: 10645 - protein, 336 aa, Acinetobacter; identical to SEQ ID NO: 10337

SEQ ID NO: 10646 - protein, 337 aa, Acinetobacter; identical to SEQ ID NO: 10338

SEQ ID NO: 10647 - protein, 341 aa, Providencia stuartii; identical to SEQ ID NO: 9953

SEQ ID NO: 10648 - protein, 353 aa, Acinetobacter baylyi; identical to SEQ ID NO: 9984

SEQ ID NO: 10649 - protein, 353 aa, Acinetobacter; identical to SEQ ID NO: 10340

SEQ ID NO: 10650 - protein, 337 aa, Acinetobacter junii; identical to SEQ ID NO: 10341

SEQ ID NO: 10651 - protein, 337 aa, Acinetobacter; identical to SEQ ID NO: 10353

SEQ ID NO: 10652 - protein, 337 aa, Acinetobacter; identical to SEQ ID NO: 10342

SEQ ID NO: 10653 - protein, 353 aa, Bilophila wadsworthia; identical to SEQ ID NO: 10086

SEQ ID NO: 10654 - protein, 353 aa, Acinetobacter; identical to SEQ ID NO: 10343

SEQ ID NO: 10655 - protein, 353 aa, Acinetobacter calcoaceticus; identical to SEQ ID NO: 10344

SEQ ID NO: 10656 - protein, 337 aa, Acinetobacter haemolyticus; identical to SEQ ID NO: 10345

SEQ ID NO: 10657 - protein, 346 aa, Acinetobacter sp. NIPH 284; identical to SEQ ID NO: 10351

SEQ ID NO: 10658 - protein, 337 aa, Acinetobacter; identical to SEQ ID NO: 10352

SEQ ID NO: 10659 - protein, 159 aa, Enterococcus; identical to SEQ ID NO: 10091

SEQ ID NO: 10660 - protein, 345 aa, Photobacterium angustum; identical to SEQ ID NO: 10018

SEQ ID NO: 10661 - protein, 343 aa, Methylomicrobium album; identical to SEQ ID NO: 10133

SEQ ID NO: 10662 - protein, 343 aa, Vibrio alginolyticus; identical to SEQ ID NO: 10019

SEQ ID NO: 10663 - protein, 347 aa, Vibrio parahaemolyticus; identical to SEQ ID NO: 9963

SEQ ID NO: 10664 - protein, 345 aa, Vibrio sp. 16; identical to SEQ ID NO: 10040

SEQ ID NO: 10665 - protein, 347 aa, Vibrio parahaemolyticus; identical to SEQ ID NO: 9979

SEQ ID NO: 10666 - protein, 340 aa, Shewanella benthica; identical to SEQ ID NO: 10030

SEQ ID NO: 10667 - protein, 347 aa, Vibrio parahaemolyticus; identical to SEQ ID NO: 10102

SEQ ID NO: 10668 - protein, 343 aa, Vibrio campbellii; identical to SEQ ID NO: 10283

SEQ ID NO: 10669 - protein, 336 aa, Aggregatibacter actinomycetemcomitans; identical to SEQ ID NO: 9955

SEQ ID NO: 10670 - protein, 208 aa, Aggregatibacter actinomycetemcomitans; identical to SEQ ID NO: 10118

SEQ ID NO: 10671 - protein, 80 aa, Aggregatibacter actinomycetemcomitans; identical to SEQ ID NO: 10119

SEQ ID NO: 10672 - protein, 331 aa, Actinobacillus pleuropneumoniae; identical to SEQ ID NO: 10066

SEQ ID NO: 10673 - protein, 331 aa, Actinobacillus pleuropneumoniae; identical to SEQ ID NO: 10067

SEQ ID NO: 10674 - protein, 331 aa, Actinobacillus pleuropneumoniae; identical to SEQ ID NO: 10077

SEQ ID NO: 10675 - protein, 331 aa, Actinobacillus pleuropneumoniae; identical to SEQ ID NO: 9903

SEQ ID NO: 10676 - protein, 114 aa, Actinobacillus ureae; identical to SEQ ID NO: 10087

SEQ ID NO: 10677 - protein, 108 aa, Pasteurella multocida; identical to SEQ ID NO: 10111

SEQ ID NO: 10678 - protein, 46 aa, Pasteurella multocida; identical to SEQ ID NO: 10108

SEQ ID NO: 10679 - protein, 47 aa, Pasteurella multocida; identical to SEQ ID NO: 10109

SEQ ID NO: 10680 - protein, 48 aa, Pasteurella multocida; identical to SEQ ID NO: 10110

SEQ ID NO: 10681 - protein, 335 aa, Pasteurella multocida; identical to SEQ ID NO: 10112

SEQ ID NO: 10682 - protein, 400 aa, Pseudomonas amygdali; identical to SEQ ID NO: 10103

SEQ ID NO: 10683 - protein, 335 aa, Pasteurella multocida; identical to SEQ ID NO: 10204

SEQ ID NO: 10684 - protein, 335 aa, Pasteurella multocida; identical to SEQ ID NO: 10209

SEQ ID NO: 10685 - protein, 335 aa, Pasteurella multocida; identical to SEQ ID NO: 10212

SEQ ID NO: 10686 - protein, 334 aa, Pasteurella dagmatis; identical to SEQ ID NO: 10055

SEQ ID NO: 10687 - protein, 329 aa, Coxiella burnetii; identical to SEQ ID NO: 10022

SEQ ID NO: 10688 - protein, 96 aa, Bacteria; identical to SEQ ID NO: 9887

SEQ ID NO: 10689 - protein, 96 aa, Bacteroidales; identical to SEQ ID NO: 10215

SEQ ID NO: 10690 - protein, 340 aa, Mitsuokella multacida; identical to SEQ ID NO: 10056

SEQ ID NO: 10691 - protein, 357 aa, Oxalobacter formigenes; identical to SEQ ID NO: 10042

SEQ ID NO: 10692 - protein, 337 aa, Pectobacterium wasabiae; identical to SEQ ID NO: 10208

SEQ ID NO: 10693 - protein, 345 aa, Moritella sp. PE36; identical to SEQ ID NO: 10028

SEQ ID NO: 10694 - protein, 314 aa, Moritella sp. PE36; identical to SEQ ID NO: 10029

SEQ ID NO: 10695 - protein, 333 aa, Enterobacter cancerogenus; identical to SEQ ID NO: 10061

SEQ ID NO: 10696 - protein, 241 aa, Treponema vincentii; identical to SEQ ID NO: 10050

SEQ ID NO: 10697 - protein, 348 aa, Chlorobium ferrooxidans; identical to SEQ ID NO: 10021

SEQ ID NO: 10698 - protein, 99 aa, Clostridiales; identical to SEQ ID NO: 10063

SEQ ID NO: 10699 - protein, 315 aa, Anaeroglobus geminatus; identical to SEQ ID NO: 10127

SEQ ID NO: 10700 - protein, 490 aa, Prevotella marshii; identical to SEQ ID NO: 10068

SEQ ID NO: 10701 - protein, 359 aa, Dialister invisus; identical to SEQ ID NO: 10053

SEQ ID NO: 10702 - protein, 322 aa, Paraglaciecola polaris; identical to SEQ ID NO: 10559

SEQ ID NO: 10703 - protein, 341 aa, Halomonas boliviensis; identical to SEQ ID NO: 10124

SEQ ID NO: 10704 - protein, 353 aa, Proteobacteria; identical to SEQ ID NO: 10051

SEQ ID NO: 10705 - protein, 341 aa, delta proteobacterium MLMS-1; identical to SEQ ID NO: 10020

SEQ ID NO: 10706 - protein, 341 aa, Paraglaciecola arctica; identical to SEQ ID NO: 10558

SEQ ID NO: 10707 - protein, 345 aa, Cellvibrio sp. BR; identical to SEQ ID NO: 10136

SEQ ID NO: 10708 - protein, 332 aa, Cronobacter dublinensis; identical to SEQ ID NO: 10008

SEQ ID NO: 10709 - protein, 327 aa, Paraglaciecola chathamensis; identical to SEQ ID NO: 10556

SEQ ID NO: 10710 - protein, 342 aa, Pseudoalteromonas; identical to SEQ ID NO: 10552

SEQ ID NO: 10711 - protein, 342 aa, Pseudoalteromonas sp. BSi20495; identical to SEQ ID NO: 10553

SEQ ID NO: 10712 - protein, 327 aa, Pseudoalteromonas sp. BSi20495; identical to SEQ ID NO: 10554

SEQ ID NO: 10713 - protein, 342 aa, Pseudoalteromonas sp. BSi20652; identical to SEQ ID NO: 10549

SEQ ID NO: 10714 - protein, 91 aa, Pseudoalteromonas sp. BSi20652; identical to SEQ ID NO: 10550

SEQ ID NO: 10715 - protein, 258 aa, Pseudoalteromonas sp. BSi20652; identical to SEQ ID NO: 10551

SEQ ID NO: 10716 - protein, 342 aa, Rhodanobacter sp. 115; identical to SEQ ID NO: 10139

SEQ ID NO: 10717 - protein, 343 aa, Vibrionales bacterium SWAT-3; identical to SEQ ID NO: 10025

SEQ ID NO: 10718 - protein, 334 aa, Zhongshania aliphaticivorans; identical to SEQ ID NO: 10135

SEQ ID NO: 10719 - protein, 334 aa, Alishewanella aestuarii; identical to SEQ ID NO: 10201

SEQ ID NO: 10720 - protein, 333 aa, Rhodopirellula maiorica; identical to SEQ ID NO: 10287

SEQ ID NO: 10721 - protein, 98 aa, Clostridiales bacterium 1_7_47FAA; identical to SEQ ID NO: 10049

SEQ ID NO: 10722 - protein, 99 aa, Clostridium innocuum; identical to SEQ ID NO: 10130

SEQ ID NO: 10723 - protein, 327 aa, Aliiglaciecola lipolytica; identical to SEQ ID NO: 10557

SEQ ID NO: 10724 - protein, 354 aa, Desulfonatronospira thiodismutans; identical to SEQ ID NO: 10065

SEQ ID NO: 10725 - protein, 334 aa, Rheinheimera sp. A13L; identical to SEQ ID NO: 10107

SEQ ID NO: 10726 - protein, 343 aa, Providencia burhodogranariea; identical to SEQ ID NO: 10240

SEQ ID NO: 10727 - protein, 349 aa, Halomonas sp. GFAJ-1; identical to SEQ ID NO: 10125

SEQ ID NO: 10728 - protein, 390 aa, Thiorhodovibrio sp. 970; identical to SEQ ID NO: 10132

SEQ ID NO: 10729 - protein, 333 aa, Neisseria sp. oral taxon 014; identical to SEQ ID NO: 10064

SEQ ID NO: 10730 - protein, 349 aa, Halomonas titanicae; identical to SEQ ID NO: 10285

SEQ ID NO: 10731 - protein, 353 aa, Bilophila sp. 4_1_30; identical to SEQ ID NO: 10114

SEQ ID NO: 10732 - protein, 353 aa, Acinetobacter sp. WC-323; identical to SEQ ID NO: 10241

SEQ ID NO: 10733 - protein, 343 aa, Marinomonas sp. MED121; identical to SEQ ID NO: 10017

SEQ ID NO: 10734 - protein, 331 aa, Actinobacillus pleuropneumoniae; identical to SEQ ID NO: 9885

SEQ ID NO: 10735 - protein, 318 aa, Pseudomonas aeruginosa
MSAGAWAQRDASQEWPAVTVREKSVRGTISNRLKTKDRDPAKLDASIQSPNLQTVDVANLPSDADTLKVRFTLRVLGGAGTPSACNDAAYRDKLLQTVATYVNEQGFAELARRYAHNLANARFLWRNRVGAEAVEVRINHIRQGEVARAWRFDALAIGLRDFKADAELDALAELIASGLSGSRHVLLEVVAFARIGDGQEVFPSQELILDKGDKKGQKSKTLYSVRDAAAIHSQKIGNALRTIDTWYPDEDGLGPIAVEPYGSVTSQGKAYRQPKQKLDFYTLLDNWVLRDEAPAVEQQHYVIANLIRGGVFGEAEEK

SEQ ID NO: 10736 - protein, 356 aa, Verminephrobacter aporrectodeae
MSNDLKTASVLAFERKLDPSDATFHAGRWDDRDNASRWASVTIRSKSVRGTISNRLKTKGKDPAKLDADIVKPNLQTVDVATLPAGADTLKVRFTLRVLAGAGTPSACNNIHYQKELVQTVQAYKEKEGFTELAKRYAANLANGRFLWRNRIGAENVRVEVDLLKDGKAEQSWVFDALLLDLRKLDSINDDAVQSLGTVIADGLTGERHVLLQVTAFARMGAGQEVFPSQELILNNDKSKNKVKKGKTLYAVNDVAAIHSQKIGNALRTIDTWYEDTGELDPIAVEPYGAVTTQSMAYRQPKRKLDFYTLLDNWLLNGKEPSMKQQHYVMAVLIRGGVFGEAENKKTSDEASDDAS

SEQ ID NO: 10737 - protein, 347 aa, Psychrobacter sp. PAMC 21119
MSKSALKTASVLAFERNLDVSDAYLWQTNSQANIKSTDADKKLSRSPVTVKEKSVRGTISNRLKNPNKTDPAKLDAETEKANLQTVDSAALNEDNDTLIARFSLKVLPFTGKPNVCNDQNYQQALQQVVTDYVENQGLDELARRYAINILNARWLWRNRVGAEKISVTVKCNDQTISIDDAKSYGLKDFKASDAKVDQIADWIKAGLNDDAFIILYVEACAIIGYGQEVYPSQELILDTGSKKSKVLYRVSDRKGSEDNAGMHSQKVSNAIRTIDDWYTNAEFPIAIEPYGAVTTMGTAFRQPKDKMDFYSLFDNWVLKGETPDASQQHYVMGVLIRGGVFGASGKE

SEQ ID NO: 10738 - protein, 336 aa, Pectobacterium brasiliense
MAKASTSLKTASVLAFERKLANSDAVMYAGNWAQQDNWTPIAIQEKSVRGTISNRLKNALTSDPAKLDAEIQKANLQTVDVAALPFGSDTLKVVFTLRVLGNLAQPSVCNDQDYQTALGNIITGYAQGQGFGTLAARYAENIANGRFLWRNRVGAEAIRVVVTTGEQRWEFNGEDYSLRAFSQPTGDLAALAQAIEQGLAGDTSVLFTVEAYVQLGNGQEVFPSQELVLDEKARNGKSKILYQVNDVAAIHSQKIGNALRTVDDWYPAADEAGPIAVEPYGSVTSRGKAYRQPKEKMDFYTLLDNWVIKGDVPAPEQQHYVIATLIRGGVFGEKGE

SEQ ID NO: 10739 - protein, 336 aa, Pectobacterium carotovorum
MAKAPTSLKTASVLAFERKLANSDAVMYAGNWAQQDNWTPIAIQEKSVRGTISNRLKNALTSDPAKLDAEIQKANLQTVDVAALPFGADTLKVVFTLRVLGNLAQPSVCNDQDYQTALGNIITGYAQDQGFGTLAARYAENIANGRFLWRNRVGAEAIRVVVTTGELRWEFNGEDYSLRQFSQPTGDLAALAQAIEQGLAGDASTLFTVEAYVQLGNGQEVFPSQELVLDEKARNGKSKILYQVNDVAAIHSQKIGNALRTVDDWYPAADEAGPIAVEPYGSVTSRGKAYRQPKDKMDFYTLLDNWVIKGDVPAPEQQHYVIATLIRGGVFGEKGE

SEQ ID NO: 10740 - protein, 343 aa, Vibrio ordalii
MAKNNDTASVLAFEKKLVPSDAYLFGTNWETKEQITPLSLQEKSVRGTISNRLKAAVQNDPVKLNAEVEKANLQRVDACALGQDQDTLKLHFTLKVLGGLAQPSACNNALFKQSYSAAVNQYIEKYGCFELAKRYATNLANARFLWRNRVGAEEIEVQVKALNKGAEQAWTFNAKQFSTRHFDHSDSQINSLADRIAQALASETDHLMLQIDCYAKVGKAQEVYPSEELVLDKGNSKSKKSKILYAVNDNAAIHSQKIGNALRSIDTWYPDYSLPEQTAGAIAIEPYGAVTNLGKAFRIPKDKQDFYTFFDKWARGSELSREEDEHYVVAVLVRGGVFGESDK

SEQ ID NO: 10741 - protein, 341 aa, Pseudoalteromonas citrea; identical to SEQ ID NO: 10457

SEQ ID NO: 10742 - protein, 342 aa, Pseudoalteromonas undina; identical to SEQ ID NO: 10459

SEQ ID NO: 10743 - protein, 350 aa, Pseudoalteromonas arctica; identical to SEQ ID NO: 10456

SEQ ID NO: 10744 - protein, 340 aa, Pseudoalteromonas spongiae; identical to SEQ ID NO: 10458

SEQ ID NO: 10745 - protein, 340 aa, Pseudoalteromonas flavipulchra
MKLPRQLSYTRSLSPGKAVFFYKTPESDFEPLQIERQKIRGQKSGFAEAYKNEVTPKELAPQDLAFGNPHTIELCYVPPTVQQLYCRFSLRVEANSLEPNVCGEPKVSYWLTRFMNTYKQHGGFGELAKRYAKNILTCEWLWRNKTSPNVDLEIIGEGFDPISITKANRLRWDGKWREAENALHTLTEVVQTGLEDPYSFCFLEVTAKLDTYFGQEIYPSQSFAENGDIARTYAYTQVAGKDAACFHSQKVGAAIQMIDDWYDEDANKRLRIHEYGADYKNVIARRAPSNRLDFYSLLQKAALYVKEMEQNGLKNQEQASHIHYIAAVLIKGGLFQRTKE

SEQ ID NO: 10746 - protein, 335 aa, Pasteurella multocida; identical to SEQ ID NO: 9868

SEQ ID NO: 10747 - protein, 369 aa, Coxiella burnetii; identical to SEQ ID NO: 9870

SEQ ID NO: 10748 - protein, 337 aa, Pectobacterium atrosepticum; identical to SEQ ID NO: 9985

SEQ ID NO: 10749 - protein, 344 aa, Chromobacterium violaceum; identical to SEQ ID NO: 9871

SEQ ID NO: 10750 - protein, 337 aa, Photorhabdus laumondii; identical to SEQ ID NO: 9983

SEQ ID NO: 10751 - protein, 334 aa, Yersinia pseudotuberculosis; identical to SEQ ID NO: 9900

SEQ ID NO: 10752 - protein, 341 aa, Legionella pneumophila; identical to SEQ ID NO: 9987

SEQ ID NO: 10753 - protein, 341 aa, Legionella pneumophila; identical to SEQ ID NO: 9986

SEQ ID NO: 10754 - protein, 346 aa, Zymomonas mobilis; identical to SEQ ID NO: 9873

SEQ ID NO: 10755 - protein, 349 aa, Shewanella sp. ANA-3; identical to SEQ ID NO: 9880

SEQ ID NO: 10756 - protein, 341 aa, Psychromonas ingrahamii; identical to SEQ ID NO: 9881

SEQ ID NO: 10757 - protein, 342 aa, Shewanella; identical to SEQ ID NO: 9882

SEQ ID NO: 10758 - protein, 341 aa, Comamonadaceae; identical to SEQ ID NO: 9883

SEQ ID NO: 10759 - protein, 340 aa, Verminephrobacter eiseniae; identical to SEQ ID NO: 9884

SEQ ID NO: 10760 - protein, 336 aa, Dichelobacter nodosus; identical to SEQ ID NO: 9889

SEQ ID NO: 10761 - protein, 353 aa, Coxiella burnetii; identical to SEQ ID NO: 9893

SEQ ID NO: 10762 - protein, 369 aa, Coxiella burnetii; identical to SEQ ID NO: 9892

SEQ ID NO: 10763 - protein, 332 aa, Enterobacter sp. 638; identical to SEQ ID NO: 9888

SEQ ID NO: 10764 - protein, 327 aa, Shewanella baltica; identical to SEQ ID NO: 9890

SEQ ID NO: 10765 - protein, 352 aa, Vibrio campbellii; identical to SEQ ID NO: 9894

SEQ ID NO: 10766 - protein, 327 aa, Shewanella baltica; identical to SEQ ID NO: 9896

SEQ ID NO: 10767 - protein, 342 aa, Delftia acidovorans; identical to SEQ ID NO: 9895

SEQ ID NO: 10768 - protein, 356 aa, Coxiella burnetii; identical to SEQ ID NO: 9897

SEQ ID NO: 10769 - protein, 331 aa, Actinobacillus pleuropneumoniae; identical to SEQ ID NO: 9899

SEQ ID NO: 10770 - protein, 334 aa, Erwinia tasmaniensis; identical to SEQ ID NO: 9991

SEQ ID NO: 10771 - protein, 344 aa, Aliivibrio fischeri; identical to SEQ ID NO: 9904

SEQ ID NO: 10772 - protein, 369 aa, Coxiella burnetii; identical to SEQ ID NO: 9905

SEQ ID NO: 10773 - protein, 342 aa, Coxiella burnetii; identical to SEQ ID NO: 9906

SEQ ID NO: 10774 - protein, 349 aa, Shewanella baltica; identical to SEQ ID NO: 9910

SEQ ID NO: 10775 - protein, 334 aa, Erwinia pyrifoliae; identical to SEQ ID NO: 9996

SEQ ID NO: 10776 - protein, 290 aa, Laribacter hongkongensis; identical to SEQ ID NO: 9911

SEQ ID NO: 10777 - protein, 339 aa, Tolumonas auensis; identical to SEQ ID NO: 9912

SEQ ID NO: 10778 - protein, 336 aa, Dickeya paradisiaca; identical to SEQ ID NO: 9913

SEQ ID NO: 10779 - protein, 335 aa, Dickeya chrysanthemi; identical to SEQ ID NO: 9914

SEQ ID NO: 10780 - protein, 335 aa, Dickeya zeae; identical to SEQ ID NO: 9919

SEQ ID NO: 10781 - protein, 349 aa, Xanthomonas albilineans; identical to SEQ ID NO: 9998

SEQ ID NO: 10782 - protein, 346 aa, Thioalkalivibrio sp. K90mix; identical to SEQ ID NO: 9920

SEQ ID NO: 10783 - protein, 352 aa, Nitrosococcus halophilus; identical to SEQ ID NO: 9921

SEQ ID NO: 10784 - protein, 335 aa, Moraxella catarrhalis; identical to SEQ ID NO: 9924

SEQ ID NO: 10785 - protein, 339 aa, Desulfurivibrio alkaliphilus; identical to SEQ ID NO: 9925

SEQ ID NO: 10786 - protein, 354 aa, Nitrosococcus watsonii; identical to SEQ ID NO: 9926

SEQ ID NO: 10787 - protein, 39 aa, Acetohalobium arabaticum; identical to SEQ ID NO: 9927

SEQ ID NO: 10788 - protein, 335 aa, Dickeya dadantii; identical to SEQ ID NO: 9928

SEQ ID NO: 10789 - protein, 343 aa, Halomonas elongata; identical to SEQ ID NO: 10000

SEQ ID NO: 10790 - protein, 342 aa, Pseudoalteromonas; identical to SEQ ID NO: 9931

SEQ ID NO: 10791 - protein, 332 aa, Desulfurispirillum indicum; identical to SEQ ID NO: 9933

SEQ ID NO: 10792 - protein, 345 aa, Marinomonas mediterranea; identical to SEQ ID NO: 9937

SEQ ID NO: 10793 - protein, 344 aa, Sphaerochaeta coccoides; identical to SEQ ID NO: 9938

SEQ ID NO: 10794 - protein, 333 aa, Gallibacterium anatis; identical to SEQ ID NO: 9939

SEQ ID NO: 10795 - protein, 342 aa, Delftia sp. Cs1-4; identical to SEQ ID NO: 9940

SEQ ID NO: 10796 - protein, 338 aa, Methylomonas methanica; identical to SEQ ID NO: 9941

SEQ ID NO: 10797 - protein, 340 aa, Megasphaera elsdenii; identical to SEQ ID NO: 10003

SEQ ID NO: 10798 - protein, 333 aa, Klebsiella; identical to SEQ ID NO: 9948

SEQ ID NO: 10799 - protein, 351 aa, Vibrio sp. EJY3; identical to SEQ ID NO: 9949

SEQ ID NO: 10800 - protein, 335 aa, Pasteurella multocida; identical to SEQ ID NO: 9947

SEQ ID NO: 10801 - protein, 336 aa, Pasteurella multocida; identical to SEQ ID NO: 9951

SEQ ID NO: 10802 - protein, 336 aa, Selenomonas ruminantium; identical to SEQ ID NO: 9982

SEQ ID NO: 10803 - protein, 343 aa, Spirochaeta africana; identical to SEQ ID NO: 9952

SEQ ID NO: 10804 - protein, 347 aa, Zymomonas mobilis; identical to SEQ ID NO: 9942

SEQ ID NO: 10805 - protein, 345 aa, Xanthomonas campestris; identical to SEQ ID NO: 9943

SEQ ID NO: 10806 - protein, 337 aa, Pectobacterium parmentieri; identical to SEQ ID NO: 9956

SEQ ID NO: 10807 - protein, 341 aa, Methylophaga frappieri; identical to SEQ ID NO: 9957

SEQ ID NO: 10808 - protein, 346 aa, Zymomonas mobilis; identical to SEQ ID NO: 9959

SEQ ID NO: 10809 - protein, 336 aa, Pectobacterium carotovorum; identical to SEQ ID NO: 9960

SEQ ID NO: 10810 - protein, 345 aa, Alcanivorax dieselolei; identical to SEQ ID NO: 9961

SEQ ID NO: 10811 - protein, 346 aa, Thioalkalivibrio nitratireducens; identical to SEQ ID NO: 9962

SEQ ID NO: 10812 - protein, 342 aa, Desulfovibrio hydrothermalis; identical to SEQ ID NO: 10009

SEQ ID NO: 10813 - protein, 260 aa, Morganella morganii; identical to SEQ ID NO: 9967

SEQ ID NO: 10814 - protein, 341 aa, Taylorella asinigenitalis; identical to SEQ ID NO: 10005

SEQ ID NO: 10815 - protein, 341 aa, Taylorella equigenitalis; identical to SEQ ID NO: 10004

SEQ ID NO: 10816 - protein, 333 aa, Serratia sp. FGI94; identical to SEQ ID NO: 9964

SEQ ID NO: 10817 - protein, 339 aa, Rahnella aquatilis; identical to SEQ ID NO: 9950

SEQ ID NO: 10818 - protein, 337 aa, Pectobacterium parmentieri; identical to SEQ ID NO: 9916

SEQ ID NO: 10819 - protein, 337 aa, Photorhabdus asymbiotica; identical to SEQ ID NO: 9993

SEQ ID NO: 10820 - protein, 341 aa, Desulfovibrio magneticus; identical to SEQ ID NO: 9981

SEQ ID NO: 10821 - protein, 333 aa, Escherichia; identical to SEQ ID NO: 10356

SEQ ID NO: 10822 - protein, 353 aa, Acinetobacter sp. CIP 110321; identical to SEQ ID NO: 10357

SEQ ID NO: 10823 - protein, 333 aa, Escherichia coli; identical to SEQ ID NO: 10371

SEQ ID NO: 10824 - protein, 333 aa, Escherichia; identical to SEQ ID NO: 10366

SEQ ID NO: 10825 - protein, 333 aa, Escherichia; identical to SEQ ID NO: 10365

SEQ ID NO: 10826 - protein, 195 aa, Lactobacillus paracasei
MKFSKRPKLVGIVRRSAVIVFALITMTLFLQLNSGVEVYATTNPEFNETEINKETSKQLKMLDPYLKDVDGITSFDYDAAMHDNVDPVVLKIGAEINKWARSLKNDGPEKGMLLSMARFNLLVYGNYCGKGNNGKAPIDDLDGACQAHDTCYAWGGNNEKCNQKFRQRLLTIMQKTSLFDYKHIVAVAAYKLFGG

SEQ ID NO: 10827 - protein, 346 aa, Halomonas anticariensis; identical to SEQ ID NO: 10372

SEQ ID NO: 10828 - protein, 342 aa, Delftia; identical to SEQ ID NO: 10374

SEQ ID NO: 10829 - protein, 297 aa, Pasteurella multocida; identical to SEQ ID NO: 10377

SEQ ID NO: 10830 - protein, 36 aa, Pasteurella multocida; identical to SEQ ID NO: 10375

SEQ ID NO: 10831 - protein, 336 aa, Pasteurella multocida; identical to SEQ ID NO: 10380

SEQ ID NO: 10832 - protein, 312 aa, Yersinia pestis
MAKATIKTASVLAFERKLSNSDAMMYAGNWGQTDNWQPIIIKEKAVRGTISNRLKNALASDPAKLDAEIQKANLQRVDVAALPFDTDTLKMSFTLRVLGNLATPSVCNDQEYQAELASVINGYISEQSFSVLAARYAENLANGRFLWRNRVGAEDIKVCITSQTKSYQFDSNEFSLRQFSQPSKELTALAQEIEQGLAGNGFAFFTVDAFVRLGNGQEVFPSQELVLDSNSKKSKVLYQIDGIAALHSQKVGNALRTIDDWYPDATELALGPIAVEPYGSVTSRGKAYRQPKQKMDFYTLLDNWVTKGTVPA

SEQ ID NO: 10833 - protein, 315 aa, Yersinia pestis
MAKATIKTASVLAFERKLSNSDAMMYAGNWGQTDNWQPIIIKEKAVRGTISNRLKNALASDPAKLDAEIQKANLQRVDVAALPFDTDTLKMSFTLRVLGNLATPSVCNDQEYQAELASVINGYISEQSFSVLAARYAENLANGRFLWRNRVGAEDIKVCITSQTKSYQFDSNEFSLRQFSQPSKELTALAQEIEQGLAGNGFAFFTVDAFVRLGNGQEVFPSQELVLDSNSKKSKVLYQIDGIAALHSQKVGNALRTIDDWYPDATELALGPIAVEPYGSVTSRGKAYRQPKQKMDFYTLLDNWVTKGTVPAVEQ

SEQ ID NO: 10834 - protein, 159 aa, Enterococcus faecalis; identical to SEQ ID NO: 10383

SEQ ID NO: 10835 - protein, 343 aa, Vibrio cyclitrophicus
MELCTQLNYVRSLSAGKAYFYYLSKSGEMCPLEIDRTRLRAPKGGYAEAYKGGKFVKKNIAPQDLAYSNPQFIEECYVKPGVDDIYCAFPLRIRANSLTPDICSDDEVRSKLSLLANTYKELNGYQELAHRYAKNILLGSWLWRNRECRRLSIEVTTSDSQTLIIENATRLSWYGHWDEASAECLEKLTAYLMQALSDPTEYFYMDVKAKIGVGWGDEVYPSQEFLDSREDGVPTKQLATVELLNGKETVAFHGQKIGAALQSIDDWWHEEADKPLRVNEFGADREYVIARRHVAHGNDFYQLLRNTEKWIETMTASQTIPNDVHFIMSVLIKGGLFNCSKAK

SEQ ID NO: 10836 - protein, 353 aa, Vibrio cyclitrophicus
MELPTNLAYERSIDPSDVCFLVVWPDGRKTPLTYTSRTVLGQMETAALAYEPSGRTKDSATAEKLAQGNPHQVDFCHAPFGASHIECYFSVSFSSELRKPYKCNSSTVKHTLMQLIKAYEENIGWNELVSRYLVNICNGSWLWKNTKNAYCWDIELTPWPWAGGAVKFQDIRANYLERSDFENHKDWEAIAQMTRNAFSHSNGLAIFEVKATLRLPTNKQVFPSQAFTENESNNTNKSKKQSKGRIFQSTTVDGERSPILGIYKTGAAIATIDDWYPDATEALRVGRFGVHKEDVTCYRHPSTQKDFFSILQQTESYIKALTSSDKPSQETINDLHFLVANIIKGGMFQHKGD

SEQ ID NO: 10837 - protein, 327 aa, Enterovibrio norvegicus
MTNLTTPSVLAFESKLACSDALLSSGNWEQRADSTQWQAVNVIEKSVRGTISNRVKGAKASKIDAEVEKANLQTVDNAALPFDADTLKVSFSLRVLGDLSVPSTCNNPDYQKALAGLISEYVQENGFSALALRFATNLANGRFLWRNRVGAERVEVRISHADKQWVFDAQELSLRDFSHKDEQLSQLVAVIEQGLMGEKPTLIKVDAFSCLGEGQTVFPSQELVMNSSGNKSKYLYQLNQQAAMHSQKIGNALRTIDTWYPEASEFGPIAIEPYGSVTNRGVAYRKPKEKTDFYTLLDNWILKGQAPSNEQQHYVIAMLIRGGVFGE

SEQ ID NO: 10838 - protein, 344 aa, Aliivibrio fischeri
MKLCNNLNYTRSLSPGKAVFYYESKDGKMNPIKCEQTHLRAPKAGFSEAFNSDYSTKNTAPQDLSFSNPQFIEECYVPVGIDEIKIRFSLRIEANSLQPDKCSDIQIREILQAFATKYKENGGYQELGERYAKNLLSGTWLWRNEHNLGTSISIKTTSNQEFNIDNAFKLSRKTSAKDKKTISKLGSEIASALSDPDHYYFADITATINVAFCQEIYPSQEFLDTKEKGKPSKVYAKTSLLTDEKTVALHAQKIGAAIQLIDDWWADDADIPLRVNEFGADHHNVIARRHPSHRNDFYTLIQNADNYCAQLDENSDITDDMHYVMAVLVKGGLFQKSASSKKGK

SEQ ID NO: 10839 - protein, 341 aa, Vibrio rumoiensis
MKLCKQLNYVRSLSAGKACFYFVDAQEKIQPISIDRTRLRASKGDYSQAYTGELKRKNVASYELAQGNIQYIEECYVPPTVNTIYCAYSLRINANSLQPEICSDPEVRAMLTQLASLYAEKGGYEELAQRYAKNILLGTWLWRNRACRAVKIEVINSEQETFIIENALKLSWYGHWDQPSQQALKGLTQYITKALSNNQDYFYMDIKASMSVGWGDEIYPSQEFLDQKEKGKPTKKLATTHLPNGDETVAFHGQKIGAAIQSIDDWWQDNADKPLRVNEYGADREYVIARRHSALNTDFYYLVSQAEHWIEMLLKSDDIPDEVHFIMSVLVKGGLFNSGKE

SEQ ID NO: 10840 - protein, 348 aa, Vibrio breoganii
MELCTQLNYVRSLSAGKAYFYHLSKSGEMCPLEIDRTWLRAPKGGYAEAYKEGNKFVAKNVAPQDLAYANPQFIEECYVKPGVDDIYCAFSLRIRANSLNPDVCSDDEVRYKLSSLAKTYKELNGYSELAYRYAKNILLGTWVWRNRECRKLTIEVKTSDSETVVIENATRLSWYGHWDEASTECLEKLTAYLKQALSDPSEYFYMDVKAKIGVGWGDEVYPSQEYLDSREDGVPTKQLATIELTSGKETVAFHGQKVGAALQSIDDWWHEEADKPLRVNEYGADREYVIARRHVTLKNDFYQLLRNTENWIESMAASQTIPNDVHFIMSVLIKGGLFNRSKSKPKAK

SEQ ID NO: 10841 - protein, 343 aa, Vibrio ordalii
MELCNQLNYVRSLSAGKAYFYHLSNDGEMCPLEIDRTRLRAPKSGYAEAYKGDKFAEKNVAPQDLAYANPQYIEECYVKPGVDDIYCAFSLRIRANSLNPDVCSDDEVRSKLSMFAKIYKELNGYKELANRYAKNILLGTWLWRNRECRNITIEVTTSELDTFVVEHAQKLSWYGHWDGNSTECLERLTAYMERALSDPSEYFYMDIKAKLRVGWGDEVYPSQEFLDSREDGIPTKQLATVELLSGKETVAFHGQKVGAALQSIDDWWHEEADKLLRVNEYGADREYVIARRHVSHGNDFYQLVRNTENWIETMTVSQTIPNDVHFIMSVLSKGGLFNCSKAK

SEQ ID NO: 10842 - protein, 347 aa, Vibrio anguillarum
MELCNQLNYVRSLSAGKAYFYHLSNDGEMCPLEIDRTRLRAPKSGYAEAYKGDKFAEKNVAPQDLAYANPQYIEECYVKPGVDDIYCAFSLRIRANSLNPDVCSDDEVRHKLSSLAKTYKELNGYSELAHRYAKNILLGTWIWRNRECRKLTIEVKTSDSETVIIENAARLSWYGHWDEASTECLEKLTAYLTRALSDSSEYFYMDVKAKIGVGWGDEIYPSQEFLDSREDGVPTKQLATVELLSGKETVAFHGQKVGAALQSIDDWWHEDADKPLRVNEYGADREYVIARRHVTFKNDFYQLLRNTENWIESMTATQTIPNDVHFIMSVLIKGGLFNCSKSKAKAK

SEQ ID NO: 10843 - protein, 236 aa, Vibrio crassostreae
MRSKLSLLANTYKELNGYQELAHRYAKNILLGRWLWRNRECRNLSIEVTTSDSQTLIIENATRLSWYGHWDEASAEYLEKLTAYLMRALSDPTEYFYMDVKAKIGVGWGDEVYPSQEFLDSREDGVPTKQLATVELLNGKETVAFHGQKVGAALQSIDDWWHENADKPLRVNEYGADREYVIARRHVSHGNDFYQLVRNTENWIESMTASQVIPNDVHFIMSVLIKGGLFNCSKAK

SEQ ID NO: 10844 - protein, 343 aa, Vibrio crassostreae
MELCTQLNYVRSLSAGKAYFYHLSKSGEMCPLEIDRTRLRAPKGGYAEAYKGSKFVKKNVAPQDLAHSNPQFIEECYVKPGVDDIYCAFPLRIRANSLTPGICSDDEVRSKLSLLANTYKELNGYQELAHRYAKNILLGTWLWRNRECRKLSIEVTISDSETLIVENATKLSWYGHWDEASAECLEKLTAYLMRALSDPTEYFYMDVKAKIGVGWGDEVYPSQEFLDSREDGVPTKQLATVELLDGKETVAFHGQKVGAALQSIDDWWHEDADKPLRVNEYGADREYVIARRHSAHGNDFYQLLRNTESWIESMTASQVISNDVHFIMSVLIKGGLFNCSKAK

SEQ ID NO: 10845 - protein, 343 aa, Vibrio crassostreae
MELCTQLNYVRSLSAGKAYFYHLSKSGEMCPLEVDRTRLRAPKGGYAEAYKGGKFVKKNVAPQDLAHSNPQFIEECYVKPGVDDIYCAFPLRIRANSLTPDICSDDEVRSKLSLLANTYKELNGYQDLAHRYAKNILLGRWLWRNRECRNLSIEVTTSDSQTLIIENATRLSWYGHWDEASAEYLEKLTAYLMRALSDPTEYFYMDVKAKIGVGWGDEVYPSQEFLDSREDGVPTKQLATVELLNGKETVAFHGQKVGAALQSIDDWWHENADKPLRVNEYGADREYVIARRHVSHGNDFYQLVRNTENWIESMTASQVIPNDVHFIMSVLIKGGLFNCSKAK

SEQ ID NO: 10846 - protein, 343 aa, Vibrio splendidus
MELCTQLNYVRSLSAGKAYFYYLSKSGEMCPLEIDRTRLRAPKGGYAEAYKGGKFVKKNVAPQDLAHSNPQFIEECYVKPGVDDIYCAFPLRIRANSLTPDICSDDEVRSKLSLLANTYKELNGYQELAHRYAKNILLGRWLWRNRECRNLSIEVTTSDSQTLIIENATRLSWYGHWDEASAECLEKLTAYLMRALSDPTEYFYMDVKAKIGVGWGDEVYPSQEFLDSREDGVPTKQLATVELLNGKETVAFHGQKVGAALQSIDDWWHQDADKPLRVNEYGADREYVIARRHVAHGNDFYQLLRNTENWIESMTASQVIPNDVHFIMSVLIKGGLFNCSKAK

SEQ ID NO: 10847 - protein, 343 aa, Vibrio tasmaniensis
MELCTQLNYVRSLSAGKAYFYHLSKSGEMCPLEVDRTRLRAPKGGYAEAYKGGKFVKKNVAPQDLAYSNPQFIEECYVKPGVDDIYCAFPLRIRANSLTPDICSDDEVRSKLSLLANTYKELNGYQELAHRYAKNILLGSWLWRNRECRKLLIEVTTSDSQTLIVENATKLSWYGHWDEASAECLEKLTAYLMRALSDPTEYFYMDVKAKIGVGWGDEVYPSQEFLESREDGVPTKQLATVELLDGKETVAFHGQKVGAALQSIDDWWHENADKPLRVNEYGADREYVIARRHVSYGNDFYQLVRNTENWIETMTASQTIPNDVHFIMSVLIKGGLFNCSKAK

SEQ ID NO: 10848 - protein, 343 aa, Vibrio tasmaniensis
MELCTQLNYVRSLSAGKAYFYYLSKSGEMCPLEIDRARLRAPKGGYAEAYKGSKFVKKNVAPQDLAHSNPQFIEECYVKPGVDDIYCAFPLRIRANSLTPDICSDDEIRSKLSLLAKTYKELNGYHELAHRYAKNILLGSWLWRNRECRKLSIEVTTSDSQTLIVENATRLSWYGHWDEASAECLEKLTAYLMRALSDPTEYFYMDVKAKIGVGWGDEVFPSQEFLDSREDGVPTKQLATVELLDGKETVAFHGQKVGAALQSIDDWWHEDADKPLRVNEYGADREYVIARRHVSHGNDFYQLVRNTENWIETMTASQVIPNDVHFIMSVLIKGGLFNCSKAK

SEQ ID NO: 10849 - protein, 343 aa, Vibrio
MELCTQLNYVRSLSAGKAYFYHLSKSGEMCPLEIDRTRLRAPKGGYAEAYKGGKFVKKNVAPQDLAHSNPQFIEECYVKPGVDDIYCAFPLRIRANSLTPDICSDDEVRSKLSLLANTYKELNGYQELAHRYAKNILLGRWLWRNRECRNLSIEVTTSDSQTLIIENATRLSWYGHWDEASAECLEKLTAYLMRALSDPTEYFYMDVKAKIGVGWGDEVYPSQEFLDSREDGVPTKQLATVELLNGKETVAFHGQKVGAALQSIDDWWHEEADKPLRVNEYGADREYVIARRHVAHGNDFYQLLRNTENWIESMAASQVIPNDVHFIMSVLIKGGLFNCSKAK

SEQ ID NO: 10850 - protein, 340 aa, Pseudoalteromonas sp. NJ631
MKLPRQLSYTRSLSPGKAVFFYKTPESDFEPLQIERQKIRGQKSGFAEAYKNEVTPKELAPQDLAFGNPHTIELCYVPPTVQQLYCRFSLRVEANSLEPNVCGEPKVSYWLTRFMNTYKQHGGFGELAKRYAKNILTCEWLWRNKTSPNVDLEIIGEGFDPISITKANRLRWDGKWREAENALHTLTEVVQTGLEDPYSFCFLEVTAKLDTYFGQEIYPSQSFAENGDIARTYAYTQVAGKDAACFHSQKVGAAIQMIDDWYDEGANKRLRIHEYGADYKNVIARRAPSNRLDFYSLLQKVALYVKEMEQNGLKNQEQASHIHYIAAVLIKGGLFQRTKE

SEQ ID NO: 10851 - protein, 369 aa, Coxiella burnetii
MTNLVNLKLRRTTMAKKENIDIASVLSFEKKLIPSDGYMFGTSWDKKSEVTPLKLREKAVRGTISNRFNKNDSKTFLDDPMKLDADVERPNLQRVDACALDQNQDTLKLCFTLKVLGGITNPSACNNALFKQSYKAAAKIYIDTHGFTELATRYAENLANARFLWRNRFGAERIEVRVNASNKTVSQKWAFDATKFNLHTFDSSDTSVKELGALIANALSSEDDYLLLDVNCYVQVGSSQEVYPSEELVLDKSSSDKKGKKTKILYAVNDIAVMHSQKIGNAIRTIDTWYPDFTNQEQTAGPIAIEPYGAVTNLGRSYRTPKDKQDFYTFFDAWARGEQLARVEDEHYVMAVLVRGGVFGKSDKKESDK

SEQ ID NO: 10852 - protein, 337 aa, Acinetobacter haemolyticus
MAKNEKVVASVLAFEKKLVPSDGYFYGTSWGNREEQTALKLIQKSVRGTISNRLKPAVASDPLKLNAEVEKANLQTVDACALGEHQDTLKVGFTLKVLGGVENPSACNNEIFLQSYQSVAKNYIQQYGFTELAKRYALNIANARFLWRNRVGAEKVEVVVTVNDQLAVTFNALEYPLYDFDQVDEKVQNLANQISQALRGEIPYLLIKIEAYALVGKAQEVYPSEELVLDKGKGDKSKILYHVNDVAAMHSQKIGNALRTIDTWYPEFDDKKTAIAIEPYGAVTNLGKAYRTPKDKKDFFSLFDKYALGESLENTEQEHYVMAVLVRGGVFGQSGKE

SEQ ID NO: 10853 - protein, 343 aa, Vibrio parahaemolyticus
MAKNNDTASVLAFEKKLVPSDGYLYGTNWDTKDKATPLVLQEKSVRGTISNRLKAAVQKDPLKLNAEVEKANLQRVDACALGQEQDTLKLHFTLKVLGGLAQPSACNNALFKQSYSAAVNQYISKYGCSELAQRYATNIANARFLWRNRVGAEDIEVQVKALNKGTEQSWTFNAKEYKVHCFDHADEQIKSLAERIAQTLSSESEHLMLQIDCYAKVGNAQEVYPSEELVLDKGNSKSKKSKILYAVNDNAAMHSQKIGNALRSIDTWYPDFTNAEKRAGAIAIEPYGAVTNLGKAFRTPKDKQDFYTFFDKWARGEALSREEDEHYVVAVLVRGGVFGESDK

SEQ ID NO: 10854 - protein, 353 aa, Vibrio sp. 624788
MELPTNLAYERSIDPSDVCFVVVWPDGRKTPLTYTSRTVLGQMETAALAYEPSGRTKESATAEKLAQGNPHQVDFCHAPFGASHIECYFSVSFSSELRKPYKCNSSTVKHTLMQLIKAYEENIGWNELVSRYLVNICNGSWLWKNTKKAYCWDIELTPWPWAGGAVKFQDIKANYLERNDFENHKDWEAIAQMTRNAFSHSNGLAIFEVKATLQLPTNKEIFPSQAFTENESNNTNKSKKQSKGRIFQSTTVDGERSPILGIYKTGAAIATIDDWYPDATEALRVGRFGVHKEDVTCYRHPSTQKDFFSILKQTESYIEALTSSDKPNQETINDLHFLVANIIKGGMFQHKGD

SEQ ID NO: 10855 - protein, 344 aa, Aeromonas dhakensis
MAKATIKTASVLAFERKLANSDAQLYAGNWQDRDDTSAQWRPITLQEKAVRGTISNRLKKATAEDPAKLDNEIQKPNLQKVDVATLPFDADTLRVGFTLRVLGNLAQPSACNDQAYQAVLGEKIGDYVREHQFHELAARYAENLANGRFLWRNRVGAEEVEVCISRLEQGSVKQRWVFDALSFNLRTFTKSQGALAELSEVIRQGLLGGDFALLKVEAFVRLGAGQEVFPSQELVLDQSGGKEGKKSKHLYQVAGIAAMHSQKIGNAIRTIDTWYPGAEELGPIAVEPYGSVTSRGTAYRQPKEKLDFYNLLDGWMLKDNLPAVDQQHYVMATLVRGGVFGEAD

SEQ ID NO: 10856 - protein, 313 aa, Vibrio vulnificus
MVADSAVTTLWLSGYATATPYWFGSRLHLVAPQDLAYSNPQFIEECYVKPGVDEIYCAFSLRIRANSLTPDICSDDEARRKLSMLAKIYKDLNGYKELAHRYAKNILLGTWLWRNRQCRNITIEVTTSELDTFVVEHAQKLSWYGHWDGDSTECLERLTAYLERALSDPSEYFYMDVKARMRVGWGDEVYPSQEFLDSREDGVPTKQLAKIDLLSGKETVAFHGQKVGAALQSIDDWWHENADKPLRVNEYGADREYVIARRHLTHGNDFYQLVRNTESWIETMTASQTIPNDVHFIMSVLIKGGLFNCSKAK

SEQ ID NO: 10857 - protein, 333 aa, Oligella urethralis
MTKLKTASVLAFERNFDFSDAHFYQKSSVSTEQKLLPVVIQEKSIRGTISNRLKNTIANDPLKLDAEVQKPNLQRVDVAMLNDDCDTLVAFFTLKIIPFTGRPSVCNDQDYQSKLLEVVDNYTNEHGFSALAKRYAQNILNARWLWRNRIGSKSISITVENKDESITVSDAKSLSLMNFDNTSAELEKLSQWIDDGLKGRDAPVFLRVKAEAIVGNGQEVYPSQELILDRKDTKSKVLYTSNDKAAMHSQKVGNAIRTIDTWYEDDAQFPIAVEPYGSVTTLGTAFRQPRSKNDFYNLFDNWILKDQAPSLEQQHYVIAILIRGGVFGESGKE

SEQ ID NO: 10858 - protein, 354 aa, Wohlfahrtiimonas chitiniclastica
MSKNEKIKVASVLSFEKKLVPSDAFFYGTCWDQREKAGAEPLALIEKSVRGTISNRLKSALAKDTTKLDAEVEKANLQRVDACALGAAHDTLKMSFTLKVLNGLEHPSACNSKEFLASYRQMVTEYVKDFGFSELARRYAHNIANGRFLWRNRVGAEKVEVRVTLNATNDAKKETLIFDAKSFCINDNFKTPDNKETATHLQKLADYIANALEHSGDHFLIQVDAYALMGKAQEVYPSEELVLDKNESNKEKKSKILYAVNGTAAMHSQKVGNALRTIDTWYPNFTEHNAPIAIEPYGAVTNLGRAFRTPKDKQDFFTLFDAYATGGELERDDQKHYVMAVLIRGGVFGQSGKE

SEQ ID NO: 10859 - protein, 338 aa, Desulfovibrio oxyclinae
MKTASVLAFERKLDPSDALFYAGSWDRKDDANTWAPIAIREKYVRGTISNRLSKKESDPAKLDAQIEKPNLQSVDVATMPVDSDTLLVNFTLKILGGVGTPSACNNSEYQARLCEVVQGYTEGTGFGELARRYAVCLANARFLWRNRLGSEAVQVRISHVEDGEAKTSWEFDSLTFSLRDFEVPQGAAGGIEELSAVIKDGFSGGKPVILNVQAFARVGAGQEVFPSQELSLERGKGDKSKTLYHVEGVAGMHSQKIGNALRTIDDWHPLAEEVGPIAVEPYGSVTTIGRACRQPKMGVDFYSLLDKWVCKDKAPDTEGQHFVMATLIRGGVFGEKDS

SEQ ID NO: 10860 - protein, 371 aa, Thioalkalivibrio sp. AKL8
MDELATLKKIPGVTSFQRLAIVSDGVFFNLDADDVESPLEVIRHGIRGTQNVNKESAKARDVSNIQVTETARTRENANRFGVRFGLRFLPLRESLHSCAGDEAEAMREHFKVFAQAASESEGLKEVARRLARNVLNGRWLWRNRSLGQRIDVKVSVNNKEQASGPVETIEAEALAVPLQHFDAFTDPEKALAEHIENALAGRKGSKMLSFDVEAVIDPGFSGSIEVFPSQNYVENKPKGFARPLYKLGRAQPVNASGSNIGFNDVRVMGVAALRDQKIGNALRTIDTWYPESENNDHEPIPVEPEGASLGAMEFFRKHKARGASASSFTLARGMGLLDPNSPEGMYMMGALIRGGVYGETGKADTAEKAGK

SEQ ID NO: 10861 - protein, 343 aa, Fangia hongkongensis
MAKNNNTVSVLAFEKKLVPSDGYMYGTNWHDRSKQVPLKLTEKSVRGTISNRLKPAIKNDPVKLNAEVEKANLQTVDTCALSPEHDTLQLRFTLKILGGLQEPSACNNVEFKQSYAKAVSDYIEREAFTELGKRYAQNLANARFLWRNRVGAENIEVQIHILNNNIDQKWTFDATKFSTRNFDCNDDNVIALGKYIAKALASKDDFLMLKINCFVKVGSGQEVYPSEELVLDKGNSKTKKSKILYSVNGIAGMHSQKIGNALRSIDTWYAEFHDPEKTAGVIAIEPYGAVTNLGKAYRTPKEKQDFYTFFDQWARGTNLKRIEDEHYVMAVLVRGGVFGESDK

SEQ ID NO: 10862 - protein, 302 aa, Gallibacterium anatis
MPREKKKLKPEEMIEMPTVLAFTRAIENGPGYFYQKMLNDDDGEIGVYSTPSMKLCALTYKKKKDEAVRTLLQEVDEAFLKPYNDTLIIRWRLKTIPIKLHCCNVDEFGKLLIEKIKEFSEKGCLKELAKRYAYNIVNGRWLWRNRMEAQDIVIKVTCGEEEVIFNNVGDLSLLKPYENIQGVEKIAQWIEDGFNGNVQFIHVEAQLLMGKGQRVFPSLTLVPGENPKLFKMNGSLVFSAQKISNAIRTIDDWYCEKPEFLLPVEVYGQSTARLSAYRTKGNDFYALLGRIFVGKQEVSFDE

SEQ ID NO: 10863 - protein, 333 aa, Gallibacterium anatis
MSTITTATVLAFERRLDISDAVFSQKSSSTGQSAPVRITEKAVRGTISNRLKNAIANDPVKLDAEIQKANLQTVDIAALDHDKDTLIVSWSCKVLPFTGQPNVCNNPEYQKVLEETVQNYLNNTGLSELAYRYAYNIINARWLWRNRMNAEKINIKIKFNNSDEMLEFKDVKPFSLNNFDHKDEKLTKLAIYIEKGFKGEQFVLINIEAEVLMGKGQEVYPSQELILDNSSARKSKILYQINDIAGIHSQKIGNAIRTIDTWYEPNAAFPISVEPYGAVTTLGRAFRQPKQKLDFYTLFDDWILRGQAPTPEQQYFVIAVLIRGGIFGASGKE

SEQ ID NO: 10864 - protein, 339 aa, Teredinibacter turnerae
MAIKTASVLAFERKLANSDGLLFAGLWANRAQREAWQPIAIQSKDVRGTISNRLKSNIATNEAKLDAEIQKPNLQRVDVAALPFDADTLRLSFTLRVLGNLAMPSACNNQDYQRALAEKINGYINEHSFAELAARYATNIANGRFLWRNRVGAESVAVHVRHIEKSEVKAEWTFNSYDYNLREFSVADGDLAELSDVIRLGLQGESFAFLEVDAYARLGAGQEVFPSQELVLDGGRDSAKSKYLYQVNSVGALHSQKIGNALRTVDTWHPAADEVGPISVEPYGSVTSRGTAYRQPKEKMDFYTLLDGWITKDKVPEIEQQHYVIAGLIRGGVFGEKAD

SEQ ID NO: 10865 - protein, 337 aa, Acinetobacter tjernbergiae; identical to SEQ ID NO: 10500

SEQ ID NO: 10866 - protein, 346 aa, Arhodomonas aquaeolei
MAKTAELKTASVLAFERKLDPSDALMFAGHWSERDSAAEWPGIAIRAKSVRGTISNRLKAKDQDPAKIDAAIHNPNLQTVDVAALPTDADTLLTHFTLKVLGGAGEPSACNSAAYHEKLRAAVDAYETEQGFDELARRYAHNLANGRFLWRNRVGAEAVEVRVSHREHGELAASWTFDALDLSLRDFEPAAGARDDLAGLAALIRQGLAGERLVLLEVSAFARMGAGQEVFPSQELILERGRNDKSKTLYSVNGVAGIHSQKLGNAIRTIDTWYPEAESAGIGPIAVEPYGSVTTRGTAYRQPRQKVDFYSLLDDWLLRDRKPAVTDQHFVMATLIRGGVFGDKAE

SEQ ID NO: 10867 - protein, 373 aa, Thioalkalivibrio
MDDNIASLAKIPGVTSFQRGLIVSDGTFFNVGAESGETPLEVIRHGIRGTQNVNKESSKARDVSNIQITETARTSEDATAFGVRFGLRFLPIKEAIHSCAGDEAQQMREHFQRFVTSAVESDGLAEVSRRIARNILNGRWLWRNRSLGQRIDIKVVVSNKADSDRYPADTIQSAALDVPLLHFNDYSDDEKTLAGYIQGALAGDKDAKMLSFAVEAVIDAGFKGSIEVFPSQNYVENKPKGFARPLYKVGRAHPVNAAGSNIGFNDVRVMGIAALRDQKIGNALRTIDTWYPGAEDNDYEPIAIEPEGASLNAMQFFRKHKAKGGSSSSFRLARDMGNLDPNSDDGKYMIGCLIRGGVYGETGKSDSAEKASK

SEQ ID NO: 10868 - protein, 341 aa, Succinimonas amylolytica
MVAKKSDFPSVLAFERKLNPSDGFLYGTRWNDKGNAVPLKLVEKSVRGTISNRLKTAISGDPLKLNSEVQKPNLQTVDFCALPQDCDTLKMVFTVKVLGKVGEPSSCNMADFQNKLRSAVSAYSNTFGFKELGKRYAYNIASGRFLWRNRVGAEAIQVYVKVLGSEKAWVFDGKTYPIRTFDKSDEKIVALGELIADTLSGSESVTLEVTTYAKIENGQEVFPSEELVLDKGKNSSKSKILYAVDGIAAVHSQKIGNALRTVDTWYPEYTDPVNGAGPIAAEPYGAVTNMGKAFRNPKDKVDFYTLFDRFTCGTPLDNDNDKHYVMSVLIRGGVFGKGDKE

SEQ ID NO: 10869 - protein, 344 aa, Halomonas lutea
MIELARNLSYRRSLSPGKAVFFYKTKDSEFEPLEAESSRLRGVKASFSEAYDGEGKTKNDDAVGKLPFGNPIFIESCFVPPLIEHMYCRFSLRAESNVMQPLVCSDLALADHLKALAIQYRDSGGFDELARRYSKNLMRGTWLWHNQRARDIEISISVSDYDDVLTVSNLKQQGNDPLCWDENSQAVHRILSSGMSRAFYDPQKYWFADITAKVRVEFCQEIFPSQVFVDKEGLKDSPTKQFAKVATSDGRAAVCFTSKKVGAALQMIDNWWEEGAEKLLRVSEYGADREFLIARRNPSTGKDFYSILYDSENLLKDSVENEICPDYHYLMAVLTKGGMFQKGK

SEQ ID NO: 10870 - protein, 363 aa, Thioalkalivibrio sp. ALE23
MKLEPMKKLPAVLSFQRATVISHGEFFNILEDGAETPLTVIRHGIRGTQNVNKKEEHGVSNMQITESAMTDRNAIGFGIRFALRYLPIDEALHACAPGKKDDEENLRNMRNHVRAFTKAVKGSKGLKEVSERVATNILNGRWLWRNRSLASDLTIIVKMTNENGENVGEVTSKPAGETKLSYNNFENRPGEVKEVGEKIAESLSGEGSYNFEVTARVDLGFKGSLEVHPSQNYVEGKPSGKKGGFARPLFKIGHPEKPNMDESSTNLNDVRTMGVAAIRDQKIGNALRTIDTWYPGFEKNKKPIPVEPQGANLEQMTCFRKQRNSSAFDIAKDMGNLDPDSKNGMFLIAALMRGGVYGSESED

SEQ ID NO: 10871 - protein, 288 aa, Yersinia pestis
RGTISNRLKNALASDPAKLDAEIQKANLQRVDVAALPFDTDTLKMSFTLRVLGNLATPSVCNDQEYQAELASVINGYISEQSFSVLAARYAENLANGRFLWRNRVGAEDIKVCITSQTKSYQFDSNEFSLRQFSQPSKELTALAQEIEQGLAGNGFAFFTVDAFVRLGNGQEVFPSQELVLDSNSKKSKVLYQIDGIAALHSQKVGNALRTIDDWYPDATELALGPIAVEPYGSVTSRGKAYRQPKQKMDFYTLLDNWVTKGTVPAVEQQHYVMATLIRGGVFGEKGE

SEQ ID NO: 10872 - protein, 352 aa, Vibrio
MKLPTSLAYERSIDPSDVCFFVVWPDDKKTPLTYTSRTLLGQMETASLAYDASGQPIKSATAEALAQGNPHQVDICRVPFGASHVECCFSVSFSCELRKPYKCNSSSVKQTLVQLIELYEMKIGWTELATRYLINICNGAWLWENTRKAYCWNIELAPWPWNGNKVKFEDIRSSYRSRQDFESHKDWSAITKMIKTAFSSSNGLAIFEVKATLHLPTNAMVRPSQAFTEKESGSKSKSKSQNSRVFQSTTIDGERSPILGAFKTGAAIATIDDWYPGATESLRVGRFGVHREDVTCYRHPSTGKDLFSILQQAEHYIEVLNANKTPDQETINDMHFLLANLIKGGMFQHKGD

SEQ ID NO: 10873 - protein, 334 aa, Moraxella boevrei
MAKQPKNELPEVLAFSRKIEPSDALMQAGLWENKANHEAWQNIELHDKRNRATKSQYNLADKEKTQPNIVWGDDASIPHDMDTLKVTFTVKFLGNIDQAVANNRPEFLDKLQNAYQAYQQEITLLPLAKRYVQNFANGRFLWRNRVGAEQIEIKITDTENHDKSWIFNAHNIALQDFDITDAQLDDLAQYVADSFSTGKYLLLKVEAFAKVGLGQRVFPSQEMRDKDKDNKSKFLYQIKTPKGLCAGMHSEKIGNAIRTIDTWYTCDENQIVKQAIAIEPYGSVPTQGKAYRMSKTDLYSLMVKFINNEAMAIDEKHFVVANLIRGGVFGGKDS

SEQ ID NO: 10874 - protein, 351 aa, Selenomonas bovis
MAKAKNNIPSVLAFEKKLVPSDGFFYGTTWENRLDAASSRPLSLVEKAVRGTISNRLSAKDADPAKLNAKMEVPNLQRVDSCALGMEQDTLRLSFTLKVLSGIAHPSACNLPEFQESYEKTVKAYMEQYGFREIAHRYAINLANGRYLWRNRLSAEEIEVHVTDDVHTWIFSAYDFPWKDFEEDDLTDEEKQGVKELAAEIADALCGKKSSAFFHIDAYARVGEGQEVYPSQELVLDTNSRKNEKGKKSKILYQVDGIAAMHSQKIGNALRTIDTWYPAYEKKLGPIAVEPYGAVTSRSQAFRTSKEKADFYTLFDSYALGNQLSTEEDEHYVMAMLVRGGVFGQGSKENE

SEQ ID NO: 10875 - protein, 323 aa, Psychrobacter lutiphocae
MNIDLPNLLSFERKLENSDALMFSGNWDDKDANDWQPIKIIPRLNRSTQSAQGISDDKKTRPNPVASSNDDANLPLEHDTLKVSFTLRLIGNLGLPFACNSPEFETAIKQKVDEFKQTDMLDELAKRYAYNIANGRFLWRNRVGAKNITIKVTIDRQDSDGQSESLRFNAYDYSLNNFNDADEKITKLADAIKEGLASDTFVFIAVDAFVELGSGQRVFPSQEMNMGEKRKVLFKINDQAAMHNVKVGNALRTVDDWFADAEFPIAAEPFGAVTQRGQAYRKSKNDLYTLMVAWVNDAELADEDKAYIVANLIRGGVFSKGGD

SEQ ID NO: 10876 - protein, 343 aa, Vibrio
MELCTQLNYVRSLSAGKAYFYYLSKSGEMCPLEIDRTRLRAPKGGYAEAYKGGQFVKKNVAPQDLAYSNPQFIEECYVKPGVDDIYCAFPLRIRANSLTPDICSDDEVRSKLSLLANTYKELNGYQELALRYAKNILLGTWLWRNRECRKLSIEVTTSDSQTLIVENATRLSWYGHWDEASAECLEKLTAYLMRALADPTEYFYMDVKAKIGVGWGDEVYPSQEFLDSREDGVPTKQLATVEFLNGKETVAFHGQKVGAALQSIDDWWHENADKPLRVNEYGADREYVIARRHVSHGNDFYQLLRNTESWIESMTASQVIPNDVHFIMSVLIKGGLFNCSKAK

SEQ ID NO: 10877 - protein, 335 aa, Dickeya zeae
MAKAATTLKTASVLAFERKLANSDALMLAGNWQQDNWQPVVIQEKSVRGTISNRLKNAISSDPAKLDAEIQKANLQTVDVAALPFDADTLKVAFTLRVLGNLALPSVCNDQDYQQALTELINGYAREQGFGVLAARYAENIASGRFLWRNRIGAEAVQVVVTHDDKRWEFNGEDYSLRQFSQPSGALAELAHAIEQALAGSDSAFFRVEAQVKLGNGQEVFPSQELVLDERARNGKSKILYQVNGVAAMHSQKIGNALRTVDDWHPDAAETGPIAVEPYGSVTSRGRAYRQPKDKMDFYTLLDNWVIKGNVPDVAQQHYVIATLIRGGVFGEKGE

SEQ ID NO: 10878 - protein, 354 aa, Hydrogenovibrio halophilus
MKEPETFKKLPGVLSFKRGTIITDAVMLNEFDDGTTSPLMVVRHGIRGTQNVNKEGGKTNAKGESSDRDPSNIQQTDTAKMHPDSVAMRVNFDLSFLPLKETLFASSPGKELKPEEFKSFKKSLEEFIERACQSNGMKEIANRFARNILNGRWLWRNRTLASHVEITVLNGSEKLCSADALDIPLTSFENVNDEEKVLGRVIELALTGKNHMPKLRVSARVTFPVQGALEVYPSQNYLENKEKGFARPLYYLQTAVVTDEHGVSEKGQAAIRDQKIGNALRTFDTWYDDFDEIGRPIPVEPNGASLDIQDFMRPLSKKTSAFSYAKRLNEIDPDSKEGMFMIASLIRGGVYSEK

SEQ ID NO: 10879 - protein, 345 aa, Oceanimonas smirnovii
MAKQDTLKTASVLAFERKLDVSDALMFAGNWEERDQTSNWQPVEVREKSVRGTISNRLKTKDQDPAKLDAAIENPNLQTVDVATLPANADTLMVKFTLRVLAGAGIPSACNNADYQHKLTEVIKEYVQQHGFAPLAQRYACNLANARFLWRNRVGAEQVEVQVARLKQGKHEQVWNFDAHSYSLRNFEEAGNNPAGLQELAQHIELGLANEQHVLLEVTAFTRLGAGQEVFPSQELILDKGKSDKSRTLYQVQSIAGIHSQKIGNALRTIDTWYPQDENVLLGPIAVEPYGSVTTQGKAYRQPKAKADFYNLLDNWVLKDKVPAEGDQHFVMATLIRGGVFGEAG

SEQ ID NO: 10880 - protein, 344 aa, Kushneria aurantia
MAKNDALKTASVLAFERKLDPSDAMFSAGRWEELSTYKAWPGIPVREKSVRGTISNRLKAKDQDPAKLDAAIENPNLQTVDVAALPHDADTLAVSFTLRVLAGAGTPSACNNAEYQKKLAQTVSGYVSEQGFNELAHRYACNLANGRFLWRNRMGAEQVEVRVSQMKAGQAEKTWTFDALDHSTRDFTGTDQTRELGETIAKALAGEQYLLLDVVAFAREGAGQEVFPSQELILERSRGDKSKTLYSIGDDKNAAIHSQKLGNALRTIDTWYPAPEDGSNLGPIAVEPYGSVTTQGTAYRQPKQKVDFYNLLDNWLLKDQVPSVENQHFVMATLVRGGVFGDAG

SEQ ID NO: 10881 - protein, 337 aa, Vitreoscilla stercoraria
MAKNEKAVASVLAFEKKLVPSDGFFYGTTWDNRHDQSALKLIEKSVRGTISNRLKSAVANDPLKLNAEVEKANLQKVDACALGENQDTLKVTFTLKVLGGIENPSACNNEIFLASYQQIAKAYIQEHSFNELAKRYAINIANARFLWRNRVGAEKIEVVVNINEQEAITFNALDYALNDFDQSDDKLQNLADHIAQAFRGEVPYLLIKVQAFALVGKAQEVYPSEELVLDKGKGDKSKILYQVNDVAAMHSQKIGNALRTIDTWYPEFDDQQTAIAIEPYGAVTNLGKAYRTPKAKQDFFTLFDKYALGGQLDNVDQEHYVMAVLVRGGVFGQSSKD

SEQ ID NO: 10882 - protein, 335 aa, Cycloclasticus pugetii
MSKIPASVLAFEKKLVPSDGLMYGTTWENRGNESVPLKLQEKSVRGTISNRLKKSEEGKIDAKIESANLQTVDSCALAPNQDTLKLNFTLKVLSGVETPSACNHEGFNQTYSEAVSNYIADYGFAELSQRYASNLANGRFLWRNRVGSENVEVHINVLNNDILKNWVFNSLEFSTQNFDNASSEINELAELIAKTLSGENEFLLLEITAFAKVGKSQDVYPSEELVLDKNNSKEGKSKILYEVGQVAAMHSQKIGNAIRTIDTWYPEFEQCQKAISIDPYGAVTNLGRAYRQPKDKKDFFSLFDRFSQGEKLELPEDEHFVMAVLVRGGVFGEKQ

SEQ ID NO: 10883 - protein, 343 aa, Vibrio; identical to SEQ ID NO: 10385

SEQ ID NO: 10884 - protein, 345 aa, Vibrio harveyi group; identical to SEQ ID NO: 10384

SEQ ID NO: 10885 - protein, 152 aa, Kribbella catacumbae
MILEVVPPESVGPVRIGMSMAEARGALAAIEGYRPASGQESAAVYESGMSIELEPGPGDTVGAIQVYRPYGPVRVEYEGIDLLRTPAARVVEQLGAITELEDDEGGRSYTAPELLLALWRPFVEDEDPSEEQGHYFQSVLVARPGYYDGPMG

SEQ ID NO: 10886 - protein, 336 aa, Thiolinea disciformis
MAKEPKKGKASMPSVLAFEKKLVPSDAQMFAVSWADRHGTAQGLKLQLKSVRGTISNRLSTALENDPAKLDAEVEKANLQTVDHCALPNDKDTLKVRFTLKVLSGVATPSACNNPDFHETYKAAVNAYVEKTGFKELAQRYATNIANARFLWRNRVGAEQLEVRVTHVNSDAKTQWVFDAKAIGLIGFDSQAVQALATVIADSLSGKTDFALLDIEAYSQLGEGQEVYPSEELVTEKGDKSKILYETDGIAALHSQKVGNALRTIDTWYAASVERPIAVEAYGSVTNLGTAYRLPKKNDFYTLFDKFGTGETIGENEAHYVMAMLVRGGVFGQSSK

SEQ ID NO: 10887 - protein, 320 aa, Psychrobacter sp. G; identical to SEQ ID NO: 9968

SEQ ID NO: 10888 - protein, 337 aa, Flexithrix dorotheae
MEEKFERLALRFFNKEATKEEIDSLKKLINENEFFKREFETLKITWEKEIFPQQKFDLARGRKILNQKIDESPTTKTRQLHTTTLNRRQVFAFAASVSVVLIFLSGLFLNRNFFQFNNSPIVQMVEKFVPAGKKQTIRLKDGTMVKLNAETKLMFPKNFKSTERVVHLEGEAFFEVARDTSRPFKIISGELETQVLGTSFNISAYPENKEIKVSVATGKVEVKNKNNKVHLIPGEQVIFSKQDASLIEKPFNYKQEFSWKDSTLFFEDTPMSLVAKSMERWYGISIKFENQEILDCQLTGEFKNESLINVLESIKYTNDITYRIVNETIFLDGKGCD

SEQ ID NO: 10889 - protein, 345 aa, Marinobacterium rhizophilum
MANNDLKTASVLAFERKLDPSDALFSAGNWNDRQNGANWEPVSVREKSVRGTISNRLKTKDQDPGKLDASIQSPNLQTVDVATLPNTADTLRVRFTLRVLGGAGTPSACNNADYQQKLQATVQNYSDNVGFAELAKRYACNLANGRFLWRNRIGAEQVEVQIRHLQRGEAAELGTFDAHSLSLRKFDEPDNAKAPLAALAQAIESGLSGEGYVLLDVIAYARMGDGQEVYPSQELILDRGDKKGQKSKTLYTVGDVAAMHSQKIGNALRTIDTWYPDENGLGPIAVEPYGSVTSQGKAYRQPKQKADFYNLLDSWVLKDQTPSEGDQHFVMATLVRGGVFGEKDS

SEQ ID NO: 10890 - protein, 347 aa, Vibrio parahaemolyticus; identical to SEQ ID NO: 9969

SEQ ID NO: 10891 - protein, 370 aa, Shewanella piezotolerans; identical to SEQ ID NO: 9907

SEQ ID NO: 10892 - protein, 335 aa, Serratia sp. ATCC 39006; identical to SEQ ID NO: 10506

SEQ ID NO: 10893 - protein, 336 aa, Photorhabdus temperata
MSKSTIKTASVLAFERKLSNSDAIMFAGNWEQNGGEWKPIVIQEKAVRGTISNRLKNALTSDPAKLDAEIQKANLQRVDVAALPFDADTLKVSFTLRVLGNLSTPSVCNDQDYQAELANVINGYIAEHGFKTLAARYAENLANGRFLWRNRVGAEEIKVRVKGKSGEWWTFNSEDFSLREFGKVEGNLAKLAAEIEEGLAGSGSTFFNVEAFVRLGCGQEVFPSQELVLDSNSKKSKVLYQVNEIAALHSQKVGNALRTIDTWYPDASELALGPIAVEPYGSVTSRGKAYRQPKVKMDFYTLLDNWVVKGKAPEVEQQHYVMAILIRGGVFGEKGE

SEQ ID NO: 10894 - protein, 333 aa, Gallibacterium anatis; identical to SEQ ID NO: 10455

SEQ ID NO: 10895 - protein, 353 aa, Acinetobacter baumannii; identical to SEQ ID NO: 10460

SEQ ID NO: 10896 - protein, 239 aa, Escherichia coli; identical to SEQ ID NO: 10414

SEQ ID NO: 10897 - protein, 93 aa, Escherichia coli; identical to SEQ ID NO: 10415

SEQ ID NO: 10898 - protein, 333 aa, Escherichia coli; identical to SEQ ID NO: 10419

SEQ ID NO: 10899 - protein, 333 aa, Escherichia coli; identical to SEQ ID NO: 10450

SEQ ID NO: 10900 - protein, 346 aa, Vibrio azureus; identical to SEQ ID NO: 10560

SEQ ID NO: 10901 - protein, 345 aa, Desulfovibrio gigas; identical to SEQ ID NO: 9971

SEQ ID NO: 10902 - protein, 161 aa, Dialister invisus; identical to SEQ ID NO: 10012

SEQ ID NO: 10903 - protein, 343 aa, Dialister; identical to SEQ ID NO: 10013

SEQ ID NO: 10904 - protein, 340 aa, Megasphaera elsdenii CAG:570; identical to SEQ ID NO: 10014

SEQ ID NO: 10905 - protein, 60 aa, Pseudomonas sp. CMAA1215; identical to SEQ ID NO: 10462

SEQ ID NO: 10906 - protein, 347 aa, Aquaspirillum serpens
MAKNDALKTASVLAFERKLDASDALFKAGQWNDMAQGNLWPDVVVHEKSVRGTISNRLSTKDQDPAKLDAQIQNPNLQTVDVASLPNDADTLRVRFTLRVLAGAGEPSACNNLDYQHKLQATVKSYIETQGFGELARRYAINLANGRFLWRNRIGAEQIMVEITRRAEGEIQQQWRFNALDFSLRNFDVPTDQATELNTLASVIEQGLSGKCHVLLEVVAFVRVGDGQEVYPSQELILDKGKGDKSKTLYVVNGIAGMHSQKISNALRTIDTWYPQDDDSDSHNSPIAVEPYGSVTSQGKAYRQPKQKADFYNLLDNWVLKDQAPSVENQHYVMATLIRGGVFGDKD

SEQ ID NO: 10907 - protein, 579 aa, Butyrivibrio sp. AD3002
MEYRKKCNVCGKVFCYTDQDLKNNSTARAMTAISAVGTIAAVFGGTRLDAYALDAKTDRESKKIVDYDHCPNCHSTNLTSLSDLDWIAYCKEQQQAVAAASISINSNASVESLITRIEIFLEEGAWKKAEVYCEQALDMDPTNGALYYYKLLAEQKKSTIEAAVIDNSKITEEKNFIFARKYGDSEIQKKLDHAEDVLKKARYDFLIECFKNDQTIENYQLTLEKFISIQPFEDSDMYIEKCRERIIALKAEEHQKEVTDAINELRGAYTAEAANKAWDKIVSIGTPEEVKNSEVEFKNVKESIAKKEKLAKSNVLKVLIAFFIVSILVIFVMTVIKPKIDRQNSYKIAEELSAKGDYATAIEKYELARGYSDSESKIKALSYTLAVEQYKNAQYKEAMDYASKANGYKDADSYYEKANQMYLLTEANLKFALHNYIAGYELLDQITNPTEDANEIYSFYQKYKPYAGKWIATKSEYLSNVSNKWMPYEEELPKGVAEAEFCPFMNIKTREAEFVLIWGNTNNEKDRELQGVVEGNIFSYNQKGGMQCHLTFDLETGVLVNEIDIDLWNDAKYYYSKKE

SEQ ID NO: 10908 - protein, 345 aa, Candidatus Symbiobacter mobilis; identical to SEQ ID NO: 9972

SEQ ID NO: 10909 - protein, 345 aa, Geovibrio sp. L21-Ace-BES
MSNVKTPTVLAFDRKLDVSDGLFYAGNWENRGKEGWETIPVREKAVRGTISNWMKTSKQDPAKMDAAVQSPNLQTVDIAALPDTADTLKINFTLRVLGGTGKPSACNDYGYMAKLKDIVDEYNTEHGFGILAERYAQNIANGRFLWRNRIGVEDAEIHVSRIKKGEAVEKWVFDAHKFSLKRFGDNKSEDFKALVKTIEEGLTSEDNYVLLDITAYSRFGRGQEVFPSQELSLDKSNVKGTKSKLLYTVEETAAMHSQKIGNAIRTIDTWYPEADELEQGPIAVEPYGSVTSMGKAFRQPKIGKKDFYNLLDNWMEKDKKPEEEQQHYIMAVFVRGGVFGKGKEK

SEQ ID NO: 10910 - protein, 359 aa, Psychromonas hadalis
MEICNILKYDRSLYPGKAVFFYKTDDCDFVPLEAEVSRIRGQKAGFTEAFTPQFTPKNLAPQDLTHCNPLIIEECSVPPNIEYLYCRFSLRVQANSLNPSGCSSPEVFTLLKEFANTFKECGGYKELATRYCKNIILGTWLWKNQNTGNTEIEIKTSGGNSYKVKNTRLLAWESTWPPEEKELLDKLSEEVHQALTDPSVFWSADITAKIETVFCQEIYPSQILTINNKQTEVPKPVEATKQFAKVKCVDGRYAVSFNSVKIGAALQSIDDWWGDNACKRLRVHEFGADKELGITRRSPEVEKDFYSLLINAESYKAELTKNAKEETGAITANIYYLFSVLIKGGMFQKKAEHKKKEKV

SEQ ID NO: 10911 - protein, 498 aa, Labrenzia
MTRLATSSPTSLAFLLASLILAYEPLRWLVGTWTDPSYPSTGALYLIAVAALVLWSMTSPVRQNSIGHRQMAVLLLLGAALIRLASQVLAINVIGGLALAIDVFALATLLRTGERQRAVSPFWLSVLFLFTLPVERILQRLIGYPLQELSAKLSCGGLGLFFSDLSCSGIRIGLAGKDVLVDLPCSGTSGLMLAMAFLVILTALYRPNLLTAVLWIGITLGLALIGNSLRIALLAVGIAYPESVLEADAMAQPLHDFIGYLTLLLSMAPVLAFYKPRPAEWRAAQAVFSLPVMSRPLQKMSALVFLSLALFIVSLPRHALDVSSSTRPQPLPLTLAGEVGVDEALLPIEEQYFLQYGGHAQKRRYGPMALTLVHTSSPLRHLHAPDDCLRGLGFDVTFLGSRFEPVPTALYRARSKTGGDWRVAVTFTSSTGETTHNIAEAIWLWLKRPGTIWTSIQRITPWTLDEPQRAAFEAAAGAALDLNTRTSGIFPAQKEKRI

SEQ ID NO: 10912 - protein, 336 aa, Photorhabdus temperata; identical to SEQ ID NO: 10468

SEQ ID NO: 10913 - protein, 316 aa, Megasphaera sp. BV3C16-1; identical to SEQ ID NO: 10469

SEQ ID NO: 10914 - protein, 342 aa, Pseudomonas aeruginosa; identical to SEQ ID NO: 10481

SEQ ID NO: 10915 - protein, 342 aa, Pseudomonas aeruginosa; identical to SEQ ID NO: 9974

SEQ ID NO: 10916 - protein, 342 aa, Pseudomonas aeruginosa; identical to SEQ ID NO: 10488

SEQ ID NO: 10917 - protein, 337 aa, Acinetobacter gyllenbergii; identical to SEQ ID NO: 10499

SEQ ID NO: 10918 - protein, 333 aa, Klebsiella oxytoca; identical to SEQ ID NO: 10501

SEQ ID NO: 10919 - protein, 332 aa, Enterobacter roggenkampii; identical to SEQ ID NO: 10502

SEQ ID NO: 10920 - protein, 332 aa, Enterobacter cloacae complex; identical to SEQ ID NO: 10504

SEQ ID NO: 10921 - protein, 346 aa, Zymomonas mobilis; identical to SEQ ID NO: 9973

SEQ ID NO: 10922 - protein, 335 aa, Dickeya zeae
MAKAATTLKTASVLAFERKLANSDALMLAGNWQQDNWQPVVIQEKSVRGTISNRLKNAISSDPAKLDAEIQKANLQTVDVAALPFDADTLKVAFTLRVLGNLALPSVCNDQDYQQALTELINGYAREQGFGVLAARYAENIASGRFLWRNRIGAEAVQVVVTHEDKRWEFNGEDYSLRQFSQPSGALAELAHAIEQALAGSDSAFFRVEAQVKLGNGQEVFPSQELVLDERARNGKSKILYQVNGVAAMHSQKIGNALRTVDDWHPEAAETGPIAVEPYGSVTSRGRAYRQPKDKMDFYTLLDNWVIKGNVPDVAQQHYVIATLIRGGVFGEKGE

SEQ ID NO: 10923 - protein, 334 aa, Erwinia piriflorinigrans; identical to SEQ ID NO: 10006

SEQ ID NO: 10924 - protein, 111 aa, Escherichia coli; identical to SEQ ID NO: 10515

SEQ ID NO: 10925 - protein, 342 aa, Pseudoalteromonas agarivorans; identical to SEQ ID NO: 10517

SEQ ID NO: 10926 - protein, 335 aa, Dickeya dianthicola
MAKAATTLKTASVLAFERKLANSDALMLAGNWQQENWQPVVIQEKSVRGTISNRLKNAISSDPAKLDAEIQKPNLQTVDVASLPFDADTLKVVFTLRVLGNLALPSVCNSQDYQQALTDLINGYAREQGFGVLAARYAENIASGRFLWRNRIGAEAVQVVVTHDDKRWEFNGEDYSLRQFSQPAGALAELAGVIEQALAGSDAAFLRVEAQVKLGNGQEVFPSQELVLDERARNGKSKILYQVNDVAAIHSQKIGNALRTVDDWHPQAAETGPIAVEPYGSVTSRGRAYRQPKDKMDFYTLLDNWVRKGDVPAVAQQHYVIATLIRGGVFGEKGE

SEQ ID NO: 10927 - protein, 703 aa, Tetrahymena thermophila
MATKVGLEPTTFRLEVCCATIAPLGFDEEFVNCISQTHEKSTKRSVICNNSAILKQCNTYENKCNYQEFKLALKSLKAIFQDDQNMKETKNIFAKNNDQIIINDLVQWDDHTDHIDITKKYRNPLIQQRTFYNHNRSFYNLNGFDSTTSKNSNSNYIFQNYIDVQQPSVFNVDTENIDEFKKIKLPRPKNLRNEINLRPFAQKDITNTTTAISKTNKKEFTLLEKIQLNHIGYHHLLALEKILAELDPENQGIADKEKYGKIVKKHMSKILNEELLQEIIDSISEGDFISCKKLSGLLDAYKFAPRFPVKSEKNNSDNFKRKMMDYDITIPKQSNVHELYVLLIEKLEEKFEKFLKAFKFFDCQQSGQIQYMDFKQTLDKLCIRFKDEEARELFNILDKKQDGFIDYEEFCQLVPNKLELEMLDRNGESLAQKTRQIYEKFGDFHNYSPDPYRVLERSRCQNPRFMDETTEKIGKEIFYTEKLKKVIENNIVVRKGRCDPGSAFKYGYNTPSDINQQFAYGIKSKNTENMFDIMNNNYSKEWTMDLENKRIQQDLMLQQIKFKKQNKNTYTNLLRQMHNTQTYKDDSRSLPKVKKLAELNQIKPVFEKTFTELKKRNHSTVIQNAYDFQDDTKSNIGSLMRELKTPNSCVNKNTQDINMQNANTEQYTNRSKSLLRNYMNTNQQKGRNNGPNFDVLNRTFTCY

SEQ ID NO: 10928 - protein, 102 aa, Ixodes scapularis; identical to SEQ ID NO: 10039

SEQ ID NO: 10929 - protein, 339 aa, Caenorhabditis remanei; identical to SEQ ID NO: 10083

SEQ ID NO: 10930 - protein, 169 aa, Pyrenophora teres f. teres 0-1; identical to SEQ ID NO: 10084

SEQ ID NO: 10931 - protein, 2106 aa, Bombus impatiens; identical to SEQ ID NO: 8481

SEQ ID NO: 10932 - protein, 464 aa, Thermothielavioides terrestris NRRL 8126; identical to SEQ ID NO: 9945

SEQ ID NO: 10933 - protein, 93 aa, Odobenus rosmarus divergens
MFCIGGGILVAILVLMGVVICLYYKISDALKPSKAPLCLALKSNPAMLTQDKVAAAAALTPGSYPNVQCCDECSLYADYDPLPPCFCDVNEGL

SEQ ID NO: 10934 - protein, 333 aa, Ceratitis capitata
MAKAPTSIKTASVLAFERKLATSDAVLYAGSWQGDRWQPIALQEKAVRGTISNRLKNPNSVDATKLDADIQKPNLQVVDTAALPADADTLKVVFTLRVLGDLATPSVCNDMAYQDALQAVIGKYVQETGFSELALRYAANLANGRFLWRNRIGAEAVQITVTAGENDWHFDGYSYSLRDFSQRDAQLKALAEVIERGLAGESWVMLTVEAQVKLGAGQEVFPSQELVLDSNSKKSRVLYQVAGVAGIHSQKIGNALRTIDTWHPKADQLGAIAVEPYGSVTSRGVACRQPKEKLDFYTLLDNWVTKGVVPEPDQQHFVMAVLIRGGVFGEKSE

SEQ ID NO: 10935 - protein, 97 aa, Equus caballus
MFDFTIMIAIGCGLLIVAFVLMGVIISLCCTIANTLKAPMVPACLALKNNPAMVTQDKVATAITTGSYPNLQCCDECRLYADFDSLPPCFCDVNEGL

SEQ ID NO: 10936 - protein, 97 aa, Equus caballus; identical to SEQ ID NO: 10935

SEQ ID NO: 10937 - protein, 130 aa, Canis lupus familiaris
MYCSLKFILIVIFFYCGHSSNMEDLEDKANSSKVNTIIMFCIGGGILMAILVLMGVVIGLYHKISNALKPPKSPLCLALKNNPAILTQDKVAAAALSAGSYPNLQCCDECSLYADFDPLPPCFCDVNEGL

SEQ ID NO: 10938 - protein, 292 aa, Candida albicans SC5314
MHCSARLYLFSSGVWAIDVCCYRRKKSSPRDIEWILRRRFLISNNFLFIENEWQNRKFGTRKKILRDFSHSSTSHRNISTPIYQLNLSPPTMAGLEQSLFQLKFTAKQLNRQATKASKEELQEKAKIKKALSQGNNDIAQLYAQNAIRKSNERINLLRLASRIDAVASRVQTAVTMRSVTGNMTQVIRGMDKALQTMNLERISLVMDKFETQFEDLDASTNYYETTTNNVNALTTPQDQVDELLNQVADEAGIEMKQGLNATKVEITSPVAPNSISEEKEDKLAERLRALRN

SEQ ID NO: 10939 - protein, 292 aa, Candida albicans SC5314; identical to SEQ ID NO: 10938

SEQ ID NO: 10940 - protein, 331 aa, Actinobacillus pleuropneumoniae serovar 5b str. L20; identical to SEQ ID NO: 9885

SEQ ID NO: 10941 - protein, 334 aa, Yersinia pestis Pestoides F; identical to SEQ ID NO: 55

SEQ ID NO: 10942 - protein, 332 aa, Enterobacter sp. 638; identical to SEQ ID NO: 9888

SEQ ID NO: 10943 - protein, 336 aa, Dichelobacter nodosus VCS1703A; identical to SEQ ID NO: 9889

SEQ ID NO: 10944 - protein, 327 aa, Shewanella baltica OS185; identical to SEQ ID NO: 9890

SEQ ID NO: 10945 - protein, 334 aa, Yersinia pseudotuberculosis IP 31758; identical to SEQ ID NO: 55

SEQ ID NO: 10946 - protein, 353 aa, Coxiella burnetii Dugway 5J108-111; identical to SEQ ID NO: 9893

SEQ ID NO: 10947 - protein, 369 aa, Coxiella burnetii Dugway 5J108-111; identical to SEQ ID NO: 9892

SEQ ID NO: 10948 - protein, 352 aa, Vibrio campbellii ATCC BAA-1116; identical to SEQ ID NO: 9894

SEQ ID NO: 10949 - protein, 327 aa, Shewanella baltica OS195; identical to SEQ ID NO: 9896

SEQ ID NO: 10950 - protein, 342 aa, Delftia acidovorans SPH-1; identical to SEQ ID NO: 9895

SEQ ID NO: 10951 - protein, 356 aa, Coxiella burnetii RSA 331; identical to SEQ ID NO: 9897

SEQ ID NO: 10952 - protein, 334 aa, Yersinia pestis Angola; identical to SEQ ID NO: 55

SEQ ID NO: 10953 - protein, 331 aa, Actinobacillus pleuropneumoniae serovar 3 str. JL03; identical to SEQ ID NO: 9899

SEQ ID NO: 10954 - protein, 337 aa, Acinetobacter baumannii AYE; identical to SEQ ID NO: 9909

SEQ ID NO: 10955 - protein, 334 aa, Yersinia pseudotuberculosis YPIII; identical to SEQ ID NO: 9900

SEQ ID NO: 10956 - protein, 334 aa, Yersinia pseudotuberculosis PB1/+; identical to SEQ ID NO: 9900

SEQ ID NO: 10957 - protein, 334 aa, Erwinia tasmaniensis Et1/99; identical to SEQ ID NO: 9991

SEQ ID NO: 10958 - protein, 331 aa, Actinobacillus pleuropneumoniae serovar 7 str. AP76; identical to SEQ ID NO: 9903

SEQ ID NO: 10959 - protein, 344 aa, Vibrio fischeri MJ11; identical to SEQ ID NO: 9904

SEQ ID NO: 10960 - protein, 369 aa, Coxiella burnetii CbuG_Q212; identical to SEQ ID NO: 9905

SEQ ID NO: 10961 - protein, 342 aa, Coxiella burnetii CbuK_Q154; identical to SEQ ID NO: 9906

SEQ ID NO: 10962 - protein, 370 aa, Shewanella piezotolerans WP3; identical to SEQ ID NO: 9907

SEQ ID NO: 10963 - protein, 275 aa, Acinetobacter baumannii AB0057; identical to SEQ ID NO: 9908

SEQ ID NO: 10964 - protein, 337 aa, Acinetobacter baumannii AB307-0294; identical to SEQ ID NO: 9909

SEQ ID NO: 10965 - protein, 334 aa, Yersinia pestis CO92; identical to SEQ ID NO: 55

SEQ ID NO: 10966 - protein, 349 aa, Shewanella baltica OS223; identical to SEQ ID NO: 9910

SEQ ID NO: 10967 - protein, 333 aa, Escherichia coli S88; identical to SEQ ID NO: 9875

SEQ ID NO: 10968 - protein, 333 aa, Escherichia coli ED1a; identical to SEQ ID NO: 9995

SEQ ID NO: 10969 - protein, 333 aa, Escherichia coli LF82; identical to SEQ ID NO: 9930

SEQ ID NO: 10970 - protein, 334 aa, Erwinia pyrifoliae Ep1/96; identical to SEQ ID NO: 9996

SEQ ID NO: 10971 - protein, 290 aa, Laribacter hongkongensis HLHK9; identical to SEQ ID NO: 9911

SEQ ID NO: 10972 - protein, 339 aa, Tolumonas auensis DSM 9187; identical to SEQ ID NO: 9912

SEQ ID NO: 10973 - protein, 341 aa, Desulfovibrio magneticus RS-1; identical to SEQ ID NO: 9981

SEQ ID NO: 10974 - protein, 336 aa, Dickeya dadantii Ech703; identical to SEQ ID NO: 9913

SEQ ID NO: 10975 - protein, 335 aa, Dickeya zeae Ech1591; identical to SEQ ID NO: 9914

SEQ ID NO: 10976 - protein, 337 aa, Photorhabdus asymbiotica; identical to SEQ ID NO: 9993

SEQ ID NO: 10977 - protein, 346 aa, Zymomonas mobilis subsp. mobilis NCIMB 11163; identical to SEQ ID NO: 9873

SEQ ID NO: 10978 - protein, 337 aa, Pectobacterium wasabiae WPP163; identical to SEQ ID NO: 9916

SEQ ID NO: 10979 - protein, 335 aa, Dickeya dadantii Ech586; identical to SEQ ID NO: 9919

SEQ ID NO: 10980 - protein, 349 aa, Xanthomonas albilineans GPE PC73; identical to SEQ ID NO: 9998

SEQ ID NO: 10981 - protein, 346 aa, Thioalkalivibrio sp. K90mix; identical to SEQ ID NO: 9920

SEQ ID NO: 10982 - protein, 352 aa, Nitrosococcus halophilus Nc 4; identical to SEQ ID NO: 9921

SEQ ID NO: 10983 - protein, 334 aa, Yersinia pestis Z176003; identical to SEQ ID NO: 55

SEQ ID NO: 10984 - protein, 335 aa, Moraxella catarrhalis RH4; identical to SEQ ID NO: 9924

SEQ ID NO: 10985 - protein, 339 aa, Desulfurivibrio alkaliphilus AHT2; identical to SEQ ID NO: 9925

SEQ ID NO: 10986 - protein, 354 aa, Nitrosococcus watsonii C-113; identical to SEQ ID NO: 9926

SEQ ID NO: 10987 - protein, 39 aa, Acetohalobium arabaticum DSM 5501; identical to SEQ ID NO: 9927

SEQ ID NO: 10988 - protein, 335 aa, Dickeya dadantii 3937; identical to SEQ ID NO: 9928

SEQ ID NO: 10989 - protein, 343 aa, Halomonas elongata DSM 2581; identical to SEQ ID NO: 10000

SEQ ID NO: 10990 - protein, 342 aa, Pseudoalteromonas sp. SM9913; identical to SEQ ID NO: 9931

SEQ ID NO: 10991 - protein, 332 aa, Desulfurispirillum indicum S5; identical to SEQ ID NO: 9933

SEQ ID NO: 10992 - protein, 345 aa, Marinomonas mediterranea MMB-1; identical to SEQ ID NO: 9937

SEQ ID NO: 10993 - protein, 344 aa, Sphaerochaeta coccoides DSM 17374; identical to SEQ ID NO: 9938

SEQ ID NO: 10994 - protein, 333 aa, Gallibacterium anatis UMN179; identical to SEQ ID NO: 9939

SEQ ID NO: 10995 - protein, 342 aa, Delftia sp. Cs1-4; identical to SEQ ID NO: 9940

SEQ ID NO: 10996 - protein, 338 aa, Methylomonas methanica MC09; identical to SEQ ID NO: 9941

SEQ ID NO: 10997 - protein, 340 aa, Megasphaera elsdenii DSM 20460; identical to SEQ ID NO: 10003

SEQ ID NO: 10998 - protein, 333 aa, Klebsiella oxytoca KCTC 1686; identical to SEQ ID NO: 9948

SEQ ID NO: 10999 - protein, 351 aa, Vibrio sp. EJY3; identical to SEQ ID NO: 9949

SEQ ID NO: 11000 - protein, 335 aa, Pasteurella multocida 36950; identical to SEQ ID NO: 9947

SEQ ID NO: 11001 - protein, 339 aa, Rahnella aquatilis CIP 78.65 = ATCC 33071; identical to SEQ ID NO: 9950

SEQ ID NO: 11002 - protein, 327 aa, Shewanella baltica OS678; identical to SEQ ID NO: 9896

SEQ ID NO: 11003 - protein, 336 aa, Pasteurella multocida subsp. multocida str. HN06; identical to SEQ ID NO: 9951

SEQ ID NO: 11004 - protein, 336 aa, Selenomonas ruminantium subsp. lactilytica TAM6421; identical to SEQ ID NO: 9982

SEQ ID NO: 11005 - protein, 343 aa, Spirochaeta africana DSM 8902; identical to SEQ ID NO: 9952

SEQ ID NO: 11006 - protein, 334 aa, Yersinia pestis D106004; identical to SEQ ID NO: 55

SEQ ID NO: 11007 - protein, 334 aa, Yersinia pestis D182038; identical to SEQ ID NO: 55

SEQ ID NO: 11008 - protein, 334 aa, Yersinia pestis A1122; identical to SEQ ID NO: 55

SEQ ID NO: 11009 - protein, 347 aa, Zymomonas mobilis subsp. mobilis ATCC 10988; identical to SEQ ID NO: 9942

SEQ ID NO: 11010 - protein, 334 aa, Yersinia pestis biovar Medievalis str. Harbin 35; identical to SEQ ID NO: 55

SEQ ID NO: 11011 - protein, 345 aa, Xanthomonas campestris pv. raphani 756C; identical to SEQ ID NO: 9943

SEQ ID NO: 11012 - protein, 334 aa, Erwinia pyrifoliae DSM 12163; identical to SEQ ID NO: 9996

SEQ ID NO: 11013 - protein, 342 aa, Pseudomonas aeruginosa M18; identical to SEQ ID NO: 9879

SEQ ID NO: 11014 - protein, 333 aa, Escherichia coli IHE3034; identical to SEQ ID NO: 9875

SEQ ID NO: 11015 - protein, 333 aa, Escherichia coli UM146; identical to SEQ ID NO: 9875

SEQ ID NO: 11016 - protein, 333 aa, Escherichia coli O83:H1 str. NRG 857C; identical to SEQ ID NO: 9930

SEQ ID NO: 11017 - protein, 341 aa, Providencia stuartii MRSN 2154; identical to SEQ ID NO: 9953

SEQ ID NO: 11018 - protein, 336 aa, Pasteurella multocida subsp. multocida str. 3480; identical to SEQ ID NO: 9951

SEQ ID NO: 11019 - protein, 337 aa, Pectobacterium sp. SCC3193; identical to SEQ ID NO: 9956

SEQ ID NO: 11020 - protein, 336 aa, Aggregatibacter actinomycetemcomitans D7S-1; identical to SEQ ID NO: 9955

SEQ ID NO: 11021 - protein, 341 aa, Methylophaga frappieri; identical to SEQ ID NO: 9957

SEQ ID NO: 11022 - protein, 342 aa, Pseudomonas aeruginosa DK2; identical to SEQ ID NO: 9958

SEQ ID NO: 11023 - protein, 346 aa, Zymomonas mobilis subsp. mobilis ATCC 29191; identical to SEQ ID NO: 9959

SEQ ID NO: 11024 - protein, 336 aa, Pectobacterium carotovorum subsp. carotovorum PCC21; identical to SEQ ID NO: 9960

SEQ ID NO: 11025 - protein, 345 aa, Alcanivorax dieselolei B5; identical to SEQ ID NO: 9961

SEQ ID NO: 11026 - protein, 346 aa, Thioalkalivibrio nitratireducens DSM 14787; identical to SEQ ID NO: 9962

SEQ ID NO: 11027 - protein, 347 aa, Vibrio parahaemolyticus BB22OP; identical to SEQ ID NO: 9963

SEQ ID NO: 11028 - protein, 342 aa, Desulfovibrio hydrothermalis AM13 = DSM 14728; identical to SEQ ID NO: 10009

SEQ ID NO: 11029 - protein, 333 aa, Serratia marcescens FGI94; identical to SEQ ID NO: 9964

SEQ ID NO: 11030 - protein, 260 aa, Morganella morganii subsp. morganii KT; identical to SEQ ID NO: 9967

SEQ ID NO: 11031 - protein, 341 aa, Taylorella asinigenitalis 14/45; identical to SEQ ID NO: 10005

SEQ ID NO: 11032 - protein, 341 aa, Taylorella equigenitalis 14/56; identical to SEQ ID NO: 10004

SEQ ID NO: 11033 - protein, 320 aa, Psychrobacter sp. G; identical to SEQ ID NO: 9968

SEQ ID NO: 11034 - protein, 347 aa, Vibrio parahaemolyticus O1:Kuk str. FDA_R31; identical to SEQ ID NO: 9969

SEQ ID NO: 11035 - protein, 352 aa, Vibrio campbellii ATCC BAA-1116; identical to SEQ ID NO: 9894

SEQ ID NO: 11036 - protein, 333 aa, Escherichia coli PMV-1; identical to SEQ ID NO: 9875

SEQ ID NO: 11037 - protein, 345 aa, Desulfovibrio gigas DSM 1382 = ATCC 19364; identical to SEQ ID NO: 9971

SEQ ID NO: 11038 - protein, 345 aa, Candidatus Symbiobacter mobilis CR; identical to SEQ ID NO: 9972

SEQ ID NO: 11039 - protein, 342 aa, Desulfovibrio hydrothermalis; identical to SEQ ID NO: 10009

SEQ ID NO: 11040 - protein, 342 aa, Pseudomonas aeruginosa SCV20265; identical to SEQ ID NO: 9974

SEQ ID NO: 11041 - protein, 353 aa, Acinetobacter sp. ADP1; identical to SEQ ID NO: 9984

SEQ ID NO: 11042 - protein, 337 aa, Pectobacterium atrosepticum SCRI1043; identical to SEQ ID NO: 9985

SEQ ID NO: 11043 - protein, 334 aa, Yersinia pseudotuberculosis IP 32953; identical to SEQ ID NO: 9900

SEQ ID NO: 11044 - protein, 341 aa, Legionella pneumophila str. Lens; identical to SEQ ID NO: 9987

SEQ ID NO: 11045 - protein, 341 aa, Legionella pneumophila str. Lens; identical to SEQ ID NO: 9986

SEQ ID NO: 11046 - protein, 346 aa, Zymomonas mobilis subsp. mobilis ZM4 = ATCC 31821; identical to SEQ ID NO: 9873

SEQ ID NO: 11047 - protein, 357 aa, Nitrosococcus oceani ATCC 19707; identical to SEQ ID NO: 9874

SEQ ID NO: 11048 - protein, 333 aa, Escherichia coli UTI89; identical to SEQ ID NO: 9875

SEQ ID NO: 11049 - protein, 334 aa, Yersinia pestis Nepal516; identical to SEQ ID NO: 55

SEQ ID NO: 11050 - protein, 334 aa, Yersinia pestis Antiqua; identical to SEQ ID NO: 55

SEQ ID NO: 11051 - protein, 342 aa, Pseudomonas aeruginosa UCBPP-PA14; identical to SEQ ID NO: 9879

SEQ ID NO: 11052 - protein, 333 aa, Escherichia coli APEC O1; identical to SEQ ID NO: 9875

SEQ ID NO: 11053 - protein, 349 aa, Shewanella sp. ANA-3; identical to SEQ ID NO: 9880

SEQ ID NO: 11054 - protein, 341 aa, Psychromonas ingrahamii 37; identical to SEQ ID NO: 9881

SEQ ID NO: 11055 - protein, 342 aa, Shewanella sp. W3-18-1; identical to SEQ ID NO: 9882

SEQ ID NO: 11056 - protein, 341 aa, Acidovorax sp. JS42; identical to SEQ ID NO: 9883

SEQ ID NO: 11057 - protein, 340 aa, Verminephrobacter eiseniae EF01-2; identical to SEQ ID NO: 9884

SEQ ID NO: 11058 - protein, 193 aa, Zymomonas mobilis subsp. mobilis ZM4 = ATCC 31821
MLANPVDSYQDIYILPNQEIAPHIIMEKLFSLLHLELVRLGSQHIGISFPEHDNNKPCLGSRLRLHGTGADLHELALSGWITRLDDYLYCEDIKSVPEIRQYCVVSRVQAKSSPARLRRRAIRRHGFHDEEAKKVIPDTAFERLELPFIMTGSCSTKQPRFPVFISHKIIQNKLMNGNFNSYGLSLGASVPWF

SEQ ID NO: 11059 - protein, 201 aa, Nitrosococcus oceani ATCC 19707
MFSDYFEIQSIGQPEDTHFILSKLFTRIHGVLKSESLNIGLGFPKLSQHSPGSIVRCFGTPRELEQLQRNSGITHLEGRGMITIEPIAAVPSDANAIAYRRDRSAEKDLAGFRQRQMRRRVRRAEHAPNQPETNLRIEAKSRLQDNEKAERPPYLLLERDGRRLPIHISTASFQINTNICQFSSYGLARKVEDKYSAVPMF

SEQ ID NO: 11060 - protein, 184 aa, Yersinia pestis Antiqua
MDHYLDIRVLPDPEFSAQTLLEALFAKLHRALVATIPGRVGVSFPTAGKTLGSQLRLHGSRGDLLELQSAGWLKGLQDYCECSEILPVPADVKHRTIRRVQVKSSAQRLRRRSVSKGWLTEEQARLRIPDSHDKRCDLPFLRLKSRSSEQYFLLFIEQGTLQASATTGEFSAYGLSVNATIPWF

SEQ ID NO: 11061 - protein, 184 aa, Yersinia pestis Nepal516; identical to SEQ ID NO: 11060

SEQ ID NO: 11062 - protein, 203 aa, Shewanella sp. ANA-3
MQRYYFMVRFLPQEANLALLMGRCISVMHGYICKHEIKGLGLTFPAWSDASIGNVIAFVHSDEIVLSELKQQSYFQYMKECGFFSLGNVEMVPDDCAEVMFKRNQAIAKIFVGEARRRLKRLEKRALVRGETFNPIKNIQPREFYTFHRIAISSGSNKQDYLLHIQKMVAKEQTEPLFSSYGVASNLQLNGTVPELSHLVDKI

SEQ ID NO: 11063 - protein, 193 aa, Psychromonas ingrahamii 37
MKYYLDITLLPDIEIPLGFIWQKVFQQVHIALADNKVGENESDIALSLPNYGDKAFPLGNKLRLFSVSEQALERLAITKWLKRFTDHTHITSVKAVPESANEYACFTRKQFNTNISRLARRRAKRHMETFEKALQYYDNFAEEQTKLPFMNIKSLTNNAQFRIFIERSITKIPKQGTFNCYGLSQAIATVPWF

SEQ ID NO: 11064 - protein, 224 aa, Shewanella sp. W3-18-1
MKYYLDITLLPDAEANLGFLWHKVYQQIHLMLVEHKVSVENSAIGLSFPKYDAKSFSDNTKFPLGDKLRLFAGTEQQLADLKVAQWLARLADYVHIKAIKAVPDNVSEYAYFKRRHFKSPDKLRRNIDARAIVIAQKNGFAINEVKTRLLASIDNLDTKSKLPFINLRSLSTEKDVSPADRRKFLLFIECEKVTKPSQNNGLFNCYGLSRRAQTEQAAVPWFEG

SEQ ID NO: 11065 - protein, 191 aa, Acidovorax sp. JS42
MTTHYINITLLPDPEFSHAHLLGALVAKLHRALVQGHTTDIGVSYPQHVSQPLTKRTLGAVLRLHGTPEALQRLMEEDWLKGMRDHTQVGELLPVPANAQHRTVRRRQFKTNADRLRRRRMQRKGETAEQAAAAIPDTVERRPDLPFVQLRSSSTGQSFCLCVEHGPLQPLPVAGAFNAYGLGHDATVPWF

SEQ ID NO: 11066 - protein, 190 aa, Verminephrobacter eiseniae EF01-2
MSTHYIDITLRPDPEFSPAHLLNALHAQLHLALVQLGTGDVGVSFPGFILRGEHSHLGTTLRLHGATSALQRLQALSWLRGMRDHVKTSEVAPVPTHTQHRVVRRVQAKSSPERSRRRLMRRLEIDEAQALQRIPDQEGRRLALPYLRLQSASKGQVFRLFIEHGPLLDTPSPGSFGTYGLSTQATIPWF

SEQ ID NO: 11067 - protein, 184 aa, Yersinia pestis Pestoides F; identical to SEQ ID NO: 11060

SEQ ID NO: 11068 - protein, 184 aa, Enterobacter sp. 638
MDHYLEIRVLSDPEFSEETLMAALFAKLHRALGARGQGDIGVSFPRYSLKPGDTLRLHGSAQSLDELEKMAWRKGLSDYCLCKGVLPAPDVNAWRCVSRVQVKSSPQRLMRRSVKKGWLTEEEAQQRLLNLQEARTDLPWLNLQSLSTGQSFRLFIRHGDIVDMPMCGEFSSYGLSATATIPWF

SEQ ID NO: 11069 - protein, 183 aa, Shewanella putrefaciens CN-32
MNSYIDIRLKPDAEMREAELSSKVFTKFHKALVTLNSHKIGISFPQMKLSLGQLFRIHGDASLLHDLQGLDWLGPLAGYCQVTAVSAVPDHVQYRIVSVKRSNLSKAKLKRLIARGSIDKDGEKRYKVKMLGQGFDNPYLDLFSSSTGQVYRKFFEFSDIQAHPLDGEFDSYGLSKTATVPWF

SEQ ID NO: 11070 - protein, 202 aa, Dichelobacter nodosus VCS1703A
MNFYQEITLLPDAEVSLYFLWSKVYGQLHIALADVRNRYGIDTIGVNFPHYVYEEQNHKVVAARLGDQLRIFALAENDLEKLQINQWLERLSDYVHIKRISKIEPNKVTGYVVVKRYRYPSLDKVALRFAQFRKINFEEARKHCTKYKHQAKNYPFIMLKSQSNQEYYKLSIRQENAQESVSGRFNVYGINSATGIVTVPNW

SEQ ID NO: 11071 - protein, 199 aa, Marinomonas sp. MWYL1
MKHYIDITLLPSDDIGVHFLWSKLMMQVHLALVEIQNEQKQVPVAVSFPKYQPRENEKLGFVGNKLRLFANDKTDLERLNFGKWLHRLEDYVHIKSIADVPNDVISYESFNRRSKSGSPDKHIKRRMQRHNETWEQAAAFFKGYSMEKADKDLPFIRMKSLHSDNEFCMSIIRKEAAPSNKHIMFNTYGLSAEGVLPKF

SEQ ID NO: 11072 - protein, 194 aa, Shewanella baltica OS185
MNHYLDITLLPNEEVGHYFLWEKLYHQMHLALVEHKNRVGQFEIAAAFPQFNEMDNNLGSKLRLLATQPQHLEDLKVSNWLRHFTDYLHISSIRPVPDKIEVYVAYSRPAIRANKAREIARRMKRHNETLVQATAHFEGFKPKKTKAPFVYMQSYTKDSRFPLFIQQTHSAVVKEGNVSFDSYGLSSRGYLPKF

SEQ ID NO: 11073 - protein, 184 aa, Yersinia pseudotuberculosis IP 31758; identical to SEQ ID NO: 11060

SEQ ID NO: 11074 - protein, 190 aa, Delftia acidovorans SPH-1
MAMTSHYIDTTLLPDPEFSHAHLLGALVAKLHRALVQLGSTDIGISFPGYSLRPRTLGTILRLHGSEAALRGLMEQPWLQGMRDHVHCTPPALVPEGAVPCLVQRRQFKTSPDRLRRRRMRRKGETAEQAAAAIPDSVERTPDLPYVQLRSASTGQPFCLFVEQKAVQGTAGQEGFNTYGLSLGTAVPWF

SEQ ID NO: 11075 - protein, 194 aa, Shewanella baltica OS195
MNHYLDITLLPNEEVGHYFLWEKLYHQVHLALVEHKNRVGQFEIAAAFPQFNEMDNSLGSKLRLLATQPQHLEDLKVSNWLRHFTDYLHISSIRPVPEKIEVYVAYSRPAIRANKAREIARRMKRHNETLEQATAHFEGFKPKKTKAPFVYMQSYTKDSRFPLFIQQTHSAVVKEGSVSFDSYGLSSRGYLPKF

SEQ ID NO: 11076 - protein, 185 aa, Coxiella burnetii RSA 331
MNYYFDINLLSDAEIPSTVLMNAVCKKLHKLLCDLDSTRIAISFPKYKITLGNVLRLHGTEFDLQKLHEVSWLGGMNGYCKISEVATVPVNTKHRTVYRKQPTMSQSKLKRLLKRGTITNDEVKSYKAKMVAEKGLNNPYLDLVSGTNCQRHRRYIVLGELLDEPVEGGFDQFGLSKTVTVPWFD

SEQ ID NO: 11077 - protein, 184 aa, Yersinia pestis Angola; identical to SEQ ID NO: 11060

SEQ ID NO: 11078 - protein, 184 aa, Yersinia pseudotuberculosis YPIII; identical to SEQ ID NO: 11060

SEQ ID NO: 11079 - protein, 184 aa, Yersinia pseudotuberculosis PB1/+; identical to SEQ ID NO: 11060

SEQ ID NO: 11080 - protein, 213 aa, Aliivibrio fischeri MJ11
MLTHYFSITYVPDDCDNELLAGRCIAEFHKFISSLRLIENNSFAIGFPNWSEQSVGNEFAIFSDNSELLSAIKYQPYFNLMRNEELFSITDIKPVPNNLPQIRFIRNQSIGKIFIGSKKRRIQRSITRNNKEHTPISNEDREFDTFHKVSCSSKSKQQQYILHIQKDITPRTIDSKGSYNSYGLATNSKHLGTVPDLSKIPFYCEEKLSNKDQ

SEQ ID NO: 11081 - protein, 203 aa, Acinetobacter baumannii AB0057
MNWYQEITLIDQDEISLYFIWSKVYTQLHIAFAEHSNEQGRISFGVSFPQYRINEQKKIGFLGTKIRVFASSENDLQQLNLGKWLERFIDYVHITQPREVPRAKITGYAHYYRVNHRMSVEERIVHQAQRRNISLDQARQHFKQYVEQPVVEPYVSLKSLSAKREENVDRPYRLYIGKSLVDEARDGMFGTYGLSRMTTVPEF

SEQ ID NO: 11082 - protein, 203 aa, Acinetobacter baumannii AB307-0294; identical to SEQ ID NO: 11081

SEQ ID NO: 11083 - protein, 137 aa, Laribacter hongkongensis HLHK9
MPPTLGDTLRLHGSAAALDSLMAVNWLAGMRDHVTLGHILPVPAAASPVCVRRKQVKSNPAKEREQLMRRKGISEAEALRLIPDDKAKWLDLPYLTLESQSTGQRFLLFIAQQAATQAASGEFNAYALSQTATLPAF

SEQ ID NO: 11084 - protein, 184 aa, Tolumonas auensis DSM 9187
MDHYLDIRLLPEEPEVSESFLLNALFAKLHVRLGQQAQGRVGVSFPDHHKRLGDLLRLHGQRTDLQALMADDWLQGLKGYTQCSEVLPIPATVSYRAVKRVQAKSAHNKRQRSIAKGWLTESEAQIRIPDTQQKELHLPFVQLKSRSNGQMMRVYVEHGPVLAVPVSGYFNAYGLSSIATIPWF

SEQ ID NO: 11085 - protein, 184 aa, Dickeya paradisiaca Ech703
MDHYIEIRVLPDLEFSAVQLLSALFAKLHRALGQRATGAIGVSFPDVDKTLGERLRLHGSVQELAALEQTGWLKGLRDYTAITEPLPVPAGAKHRTVRRVQVKSSAERLRRRAVSKGRMTEDEAATRIPYAVEKRSSLPYLPLRSLSSGQTFLLFVEHGPLQDKPVAGAFSSYGLSATTTIPWF

SEQ ID NO: 11086 - protein, 184 aa, Dickeya chrysanthemi Ech1591
MDHYIEIRVLPDLEFSAVQLLSALFAKLHRALGQQATGAIGVSFPDVGKTLGERLRLHGSEQALTALEQTGWRTGLRDYSTITDVLTVPTGAQYRTVRRVQVKSSAERLRRRAVSKGWLTADEAAARIPYAVEKRTSLPYLPLRSLSSGQPFLLFVEHGPLQDKPVAGTFSSYGLSATATIPWF

SEQ ID NO: 11087 - protein, 193 aa, Zymomonas mobilis subsp. mobilis NCIMB 11163
MLANPVDSYQDIYILPNQEIAPHIIMEKLFSLLHLELVRLGSQHIGISFPEHDNNKPCLGSRLRLHGAGADLHELALSGWITRLDDYLYCEDIKSVPEIRQYCVVSRVQAKSSPARLRRRAIRRHGFHDEEAKKVIPDTAFERLELPFIMTGSCSTKQPRFPVFISHKIIQDKLMNGNFNSYGLSLGASVPWF

SEQ ID NO: 11088 - protein, 184 aa, Pectobacterium parmentieri WPP163
MDHYIDIRVQPDPEFTAPQLLNALFAKLHRALGQLADGKIGISFPEVGKTLGECLRLHGTADALSTLEKTSWLKGLRDYTQVSECKAVPNNVKFRTVRRVQLKTSAERLRRRSVNKGWLTEAEAAARIPDAVEKRSTLPFVQIKSLSNGQMFFVFVEHGPLQNAPATGRFSSYGLSAEATVPWF

SEQ ID NO: 11089 - protein, 184 aa, Dickeya zeae Ech586
MDHYIEIRVLPDPEFSAVQLLSALFAKLHRALGQRATGDIGVSFPDAGKTLGERLRLHGSVQALAALEQTGWLKGLRDYSTITDVLTVPTGAQYRTVRRVQVKSSAERLRRRAVSKGRMTADEAAARIPYAAEKRTSLPYLPLRSLSSGQTFLLFVEHGPLQEKPVAGVFSSYGLSAIATIPWF

SEQ ID NO: 11090 - protein, 186 aa, Thioalkalivibrio sp. K90mix
MDHYLDLRVMPDPEFKETTLLGALVSKLHRRLVSMSADDIGISLPDHEQEPPLGRRLRVHGTQGRLNLLMQDEWLGGMQSLVDATPVQPVPDQVTYRPVRRRQYKTNAERLRRRRMRRHGESYEEARQHIPDTVERRVNTPFLSVQSASTGQRFSLFIEHGPPQQHASPGRFNTYGLSQDATVPWF

SEQ ID NO: 11091 - protein, 199 aa, Nitrosococcus halophilus Nc 4
MFSDYFEIQSIGLPEDTHFILSKLFTRIHGVLKSESLNIGLGFPELSPRSPGSIVRCFGTLQELDQLRCNSGITHLEGRGMISIRPIMAVPSNATAIAYRRDRNAEKHLAGFRQRQMRRRIRRADCTQKQLGMDFKSEDRLQDNEETKRPPYLLLERDGRRLPIHISTVNLQIDTDICQFSSYGLARKVESKYSAVPMF

SEQ ID NO: 11092 - protein, 184 aa, Escherichia coli IHE3034
MDHYLEIRVLPDPEFSSEMLMAALFAKLHRVLGARGQGDIGVSFPDVNVMPGARLRLHGSAQALQALEASTWRKGLTDYCQCSPVTPVPEIKGWRVVSRVQVKSNPQRLLRRSVKKGWLTEEQAIERLATQAEQRTDLPFLNMKSLSSQQLFKLFIRHGDLLKEPVKGEFSSYGLSATATIPWF

SEQ ID NO: 11093 - protein, 196 aa, Moraxella catarrhalis BBH18
MKFYQEITLIPQADISPHAVWSKLYTQLHLAFVEQKDEQDKTIYGVSFPQYRTIADKKIAYLGCKLRVFAPTEQALSALNLDKRLEHLADYIHISSIRSVPDDIKGYANYYRAIPKMTLDERITHQAKRHGVPYHKAAERFENYKEQSLVYPHIQLTSKSNHRSYPLHIGKQATEVLTDGRFGTYGLSRTSSVPEF

SEQ ID NO: 11094 - protein, 188 aa, Desulfurivibrio alkaliphilus AHT 2
MVMAMDCYVEISLLPDPEFPDSILMNALFAKLHRALAENGKQEIGVSFPEFGKKLNSKLRIHGSEESLKRLMDLNWIQGMKDYTRVSGIAKVPDSCQYRTVKRVQAKSSVDRLYRRSVKKGWLSEENAEQQKERAREGRLKLPFVQLKSQTTGQQFRLFIQHGSLQEKPVTGRFSSYGLSNEATVPWF

SEQ ID NO: 11095 - protein, 201 aa, Nitrosococcus watsonii C-113
MFSDYFEIQSIGLPEDTHFILSKLFTRIHGVLKSESLNIGLGFPELSRHSPGSIVRCFGVSRELEQLQRNNGITHLEGRGMIAIKPIATVPPDAIAIAYRRDRSAEKDLAGFRQRQMRRRVRRAEHAQNQPETSLRIEAKSRLQDNEKAERPPYLLLEREGRRLPIHINTASLQINTNICQFSSYGLARKVEDKYSAVPMF

SEQ ID NO: 11096 - protein, 194 aa, Shewanella baltica OS678; identical to SEQ ID NO: 11075

SEQ ID NO: 11097 - protein, 182 aa, Desulfurispirillum indicum S5
MDSYIEIRILPDQEFEATTLMSTVFAKLHRALVESGRSDIGVSFPEAGKTPGALLRLHGSLAALESIMTLSWLTGLQDYTQTSGILQVPAQAAYVQVARVQSKMTASRIRRALKRGSLSEERALELLQSRDQLNQPFFRLLSASTAQKFPLFIEQRNAEKAGKQSVYSAYGLSVGGSTVPWF

SEQ ID NO: 11098 - protein, 185 aa, Shewanella putrefaciens 200
MDHYLDIKLMEDPEFSAPILMNALFSKLHRALVDVSQGDIGISFPAMSSKCLGQHLRIHGSRAALERLEQLTWRKGLSDYAQVSDILVVPNTSQHCLVSRVHAQSNLESLRRRAMKRRSISYEEACLQIPEDLSKQLDFPFVQIKSQSTHQLFRLFIKQSLSPPLQAESAFSKYGLSNTATVPWF

SEQ ID NO: 11099 - protein, 183 aa, Shewanella putrefaciens 200; identical to SEQ ID NO: 11069

SEQ ID NO: 11100 - protein, 201 aa, Marinomonas mediterranea MMB-1
MNYYQDITLLPSDDIGMHFLWSKVMMQLHLALVEIQDANQKAPVASSFPNYREAAQNKPAYVGNKIRLFATNKADLERLNIQKWMNRLEDYLHIKSISEVDPSKVQGYESFSRLRKPGNVDYMIRRRMKGLDKSHEEASDYFKDYKVSDNFKRLPFIQMKSLQKDREFRLVVKRKTLEQAVETDFVFNTYGLNKDVALPKF

SEQ ID NO: 11101 - protein, 193 aa, Sphaerochaeta coccoides DSM 17374
MKYVEITLLPGIEVPLPFLWKKIFMRLHLRFVGLQDAFRTVPYGVSFPGYAENPLSVGSKLRVFAESEQNLISLDAKRTFADFADYVHVTGIGNIPDGCTYALYKRLQPNGNLPKIARRKASREGLSYDEALARLKVPGSNKSSDNLFPYIYMKSLSSHQDFCLFIKKELAEVSREFSFSTYGLSAICTVPEF

SEQ ID NO: 11102 - protein, 188 aa, Delftia sp. Cs1-4
MTSHYIDITLLPDPEFSHAHLLGALVAKLHRALVQLGSADIGISFPGYSLRPRTLGTILRLHGSEAALRCLMEQPWLQGMRDHVQCTPPALVPEGAVPYLVQRRQFKTSPDRLRRRRMRRKGETAEQAAAAIPDSVERTPDLPYVQLRSASTGQPFCLFVEQKAVQGTVGQEGFNTYGLSLGTAVPWF

SEQ ID NO: 11103 - protein, 213 aa, Methylomonas methanica MC09
MHIYLEITLLPNPEIGLNFLWSKVFQQLHLGFVEMQGGEGRSPIGVGFPKYWIKDAKFGLGDKCRLFAADEASLERFAAPQRLARLSDYVHCTGIRPVPEKLSGYAVYRRERPKTNPERLARRYAKRHGLDLETALNTTVELKAPVGDAVYPATFRYADMAIPSVALPFIRLQSLSGGQTFCLWIAKTEVAEPVVGRFSTYGLSSSAATVPEF

SEQ ID NO: 11104 - protein, 188 aa, Xanthomonas campestris pv. raphani 756C
MDHYVDLQLRPDPELAPHQLLSGLYVRLHRALVQQQRQDIGVSFPRHDARKPSLGAHLRLHGRQSALQALMASGWLQGMHDHLTASDIFSAPAGAQHRQVTRVQAKSSPSRLRRRAIRRHGIDADTATQRIPDTAAEHLQLPFVVLGSRSTGQASFPLFIRHGSLLSEPRAGSFNSYGLSQEATVPWF

SEQ ID NO: 11105 - protein, 186 aa, Pasteurella multocida 36950
MTTHYIELKAIPQMDMLQSEVIGHCMQILHQFLPHFEGRVGVAFPAYGLGRTLGGIVRLFANQEDCNQLHQQLLRSGLSDYALISEVSKTPLSTECRSYSRVHRKGQSAIRRTEKRLKSQGRWDESIRADMQQRQQNVAFFPHCHLKSASTGQRFILAVKENRMPQSCVGVFNAYGLSNSATVPHF

SEQ ID NO: 11106 - protein, 184 aa, Rahnella aquatilis CIP 78.65 = ATCC 33071
MESYQEIRVLPDPEFGTELLMAALFAKLHRALGQYAAGKIGISFPHYGHKPGDIIRLHSRADTLTAFSQTLWLKGLNDHVDVSEIRDVPSGAQHCCFSRVQVKSSAERLRRRSVKKGWMSEEEAPERIPDSKSQVTTLPFIQVKSLSTGEAFRLFIRRGALQPVSVKGEFGAYGLSAVATVPWF

SEQ ID NO: 11107 - protein, 186 aa, Pasteurella multocida subsp. multocida str. HN06
MTTHYIELKAIPQMDMLQSEVIGHCMQILHQFLPHFEGRVGVAFPAYGLGRTLGGIVRLFANQEDCNQLHQQLLRSGLSDYALISEVSKTPWSTEHRSYSRVHRKGQSAIRRTEKRLKSQGRWDESIRADMQQRQQNVAFFPHCHLKSASTGQRFILAVKENRMPQSCVGVFNAYGLSNSATVPHF

SEQ ID NO: 11108 - protein, 193 aa, Spirochaeta africana DSM 8902
MNYYSEITLLPGADIGLYQLWSKVFTQVHLRLVEFQNPDGNVPIGVDWPEYKADIPSLGTKLRIFSSTRETLEQFDLNVVLLRFSDYVKVSGIRSVPQNISSYVAYERVQKKQNPDRIARRRARRSNLDYTEALRAVAEKNAPVITLPYVQLISLSTKRKYSLFLAKRLTEEPGGNISFNSFGINKHSTVPSF

SEQ ID NO: 11109 - protein, 211 aa, Providencia stuartii MRSN 2154
MDYYQEITLLPDSTIPLDFLWQKVYQQIHIALVENKSEAGDSEVAVAFPEYGSVGFRLGKKLRLLAKTEKTLTQLNISHWLMRLADYVHIKSIQAVPEHATPISYVRQHVKGAKRLELDRYKKAQLYSVKSGQPIEVCLSAIKEPQTRSRLPFIWMESQQTKSKTEGDGHRPFPLFIRCVAAKEAKAGTFNCYGLSQSMGKGEEVATVPHF

SEQ ID NO: 11110 - protein, 183 aa, Methylophaga nitratireducenticrescens
MNFYIDVLINPNAEMRINVLLNTVYTKLHKAIFDLRAKNIGVSFPNHNITLGNILRIHGDEKTLRVLQDQNWIGGMSGYCNISGIQPVPDSAKFCTVSRKQTTMSQSKLRRLLKRGSISEDEIQQYKAKMFARGLDNPYLELVSSSTGQKHRRYIEFGELKGEATHGQFDCFGLSKSATVPWF

SEQ ID NO: 11111 - protein, 187 aa, Aggregatibacter actinomycetemcomitans D7S-1
MTVQTHYIEIKAIPQVDMLQTEVIGFCLQKLHQILPHFEGRIGLAFPAYGNDKTLGGIIRLFGTENDCGFIHFKLQSLRDYALISEVMPIPEKVRSYRIYQRIQPKGQSSIRRAEKRLTAQGKWNEEVLQNMLQKQATQRIYPHAHLKSSSTKQQFILAIKSVHQTKAVEGVFSAYGLSQTTTVPHF

SEQ ID NO: 11112 - protein, 184 aa, Pectobacterium parmentieri; identical to SEQ ID NO: 11088

SEQ ID NO: 11113 - protein, 183 aa, Methylophaga frappieri
MNYYLDIHILPDPEFKETVLMNAIYTKLHKALCDSQSTDIGVSFPNHNLTLGNTLRLHGTAEALDKIQCRNWIGSMSVYCQNSDIQSVPADVKFRTISRQQPTMSAAKLKRLIKRGSITEAEAKNYKAKMFTKGLDNPYVELVSGSNGHRHRRYIEFGSLHDNPVDGDFDQFGLSKTATIPWF

SEQ ID NO: 11114 - protein, 193 aa, Zymomonas mobilis subsp. mobilis ATCC 29191
MLANPVDSYQDIYILPNQEIAPHIVMEKLFSLLHLELVRLGSQHIGISFPEHDNNKPCLGSRLRLHGTGADLHELALSGWITRLDDYLYCEDIKSVPEIRQYCVVSRVQAKSSPARLRRRAIRRHGFHDEEAKKVIPDTAFERLELPFIMTGSCSTKQPRFPVFISHKIIQDKLMNGNFNSYGLSLGASVPWF

SEQ ID NO: 11115 - protein, 186 aa, Thioalkalivibrio nitratireducens DSM 14787
MDHYLDFTVLPDPEFRETTLLGALVSKLHRRLVVLEADDIGISLPDFEKAPPLGNRLRVHGTQERIETLMQEEWLGGMRGQLEIAPLRAVPAEVLHRGVRRRQYKTNVERLRRRRMRRHGETHEEARERIPDTVARKVKTPFLTVYSTSSGQRFSLFIEHEPVQTRCVVGAFNSYGISREATIPWF

SEQ ID NO: 11116 - protein, 184 aa, Serratia sp. FGI94
MDHYIELRVLPDPEFSAPMLLEALFAKLHRTLGAVGKGRIGVSFPDAGKTLGERLRLHGSQEALTELEQHGWRKGLRDYTESSAILPVPADAAYRTVRRVQVKSSAERLQRRSVAKGWLTMEQAQERISAVKEQRSTLPFIRLKSLSNGQSFLLFIEQGTLRTTPTAGEFSAYGLSATATIPWF

SEQ ID NO: 11117 - protein, 168 aa, Vibrio phage ICP1_2006_E
MYNTISITVVDADDVGVNFVVSKVLSTLHNKGIFNGEVGVTFPRMDKNVGEVITLFSKAEIDRKVLTSTLNTLTDFVHIGKQKEADSVKTYRKVDTKSKGKLIRRCIKRKGVSEETAESLYGKYKTDKCKLPYIIVNSKSNGNKFSMFLAECENSEKFNSYGLCIVSC

SEQ ID NO: 11118 - protein, 168 aa, Vibrio phage ICP1_2011_A
MYNTISITVVDADDVGVNFVVSKVLSTLHNKGIFNGEVGVTFPRMDKNVGDIITLFSKTGVDRKVLTSTLNTLTDFIHIGKPKEADKVKTYRKVDTKSKGKLIRRCIKRKGVSAETAESLYGNYKGEKCKLPYIVVNSKSTGQRFSMFLEECENSEKFNSYGLCIVSC

SEQ ID NO: 11119 - protein, 185 aa, Morganella morganii subsp. morganii KT
MRFYQTITILPDALISAVFLRQQIWRQLHLILAENKTGENSSAVAVAFPDYCRKPQTPGNRLRLLAGDYPSLAELGLSVRLAAFYPYIRLSGILPVPEKTLPVSYIREHVKGLRRSQTAGAGRLFIPETLPFIWTKSLSGGRHHRPFPFFIRKLDAKSAAEGRFTCYGLSQKRAENGRVATVPHF

SEQ ID NO: 11120 - protein, 198 aa, Vibrio parahaemolyticus O1:Kuk str. FDA_R31
MDWYYRTITFLPEYRNNEAIAAKCIKELHRFNYKYETRSIGVSFPLWGQETVGRKITFVSTNKMELDFLISRRYFVQMTKLGYFSISTTQTVPDDCSYVLFKRAHSIDKGTSAGRARELKRLERRALERGEIFDPMAYSKTTSHAFQSYHSLEEDSSSGNKFRLNIQMKERSGTVDTGTFSSYGLGNTDNSLQVVPLI

SEQ ID NO: 11121 - protein, 186 aa, Desulfovibrio gigas DSM 1382 = ATCC 19364
MDHYIEFRLLEDPEFAPAQLMNVLFGKLHLALAERGCDDIGVSFPDGDNCRTLGTRLRLHGTAAALGRLMQGNWTAGIRDHVAQSPVQPVPAGARYRALYRVQAKSNPERLRRRRMKRHGVDAEAAARQIPDNAVEVLKLPYVQVASQSSGQRFRLFFQYGPVEAEARNGEFNAYGLSRGATIPWF

SEQ ID NO: 11122 - protein, 188 aa, Candidatus Symbiobacter mobilis CR
MTTLSHYVNMDVRPDGDFPSSQLMGALYVRLHRALVAHGAGDIGVCFPAHNEHWLGNRMRLHGSAEALGKLMGVDWLQGMRDHLDLTPVSPVPDQMGYRQVKRVQPQSSPERLRRRLMLRHKLTAEEAAERIPDTVAQLVALPSVFVRSSSTGQSFRLFVCHGPLTPEPKEGGFSTYGLSLGGAVPWF

SEQ ID NO: 11123 - protein, 193 aa, Zymomonas mobilis subsp. mobilis str. CP4 = NRRL B-14023
MLANPVDSYQDIYILPNQEIAPHIIMEKLFSLLHLELVRLGSQHIGISFPEHDNNKPCLGSRLRLHGTGADLHELALSGWITRLDDYLYCEDIKSVPEIRQYCVVSRVQAKSSPARLRRRAIRRHGFHEEEAKKVIPDTAFERLELPFIMTGSCSTKQPRFPVFISHKIIQDKLMNGNFNSYGLSLGASVPWF

SEQ ID NO: 11124 - protein, 187 aa, Pseudomonas aeruginosa SCV20265
MDHYLDIRLRPDPEFPPAQLMSVLFGKLHQALVAQGGDRIGVSFPDLDESRSRLGERLRIHASADDLHALLARPWLEGLRDHLQFGEAAVVPHPTPYRQVSRVQAKSNPERLRRRLMRRHDLSEEEARKRIPDTVARTLDLPFVTLRSQSTGQHFRLFIRHGPLQATAEEGGFTCYGLSKGGSVPWF

SEQ ID NO: 11125 - protein, 187 aa, Pasteurella multocida subsp. multocida str. HB03
MMTTHYIELKAIPQMDMLQSEVIGHCMQILHQFLPHFEGRVGVAFPAYGLGRTLGGIVRLFANQEDCNQLHQQLLRSGLSDYALISEVSKTPLSTECRSYSRVHRKGQSAIRRTEKRLKSQGRWDESIRADMQQRQQNVAFFPHYHLKSASTGQRFILAVKENRMPQSCVGVFNAYGLSNSATVPHF

SEQ ID NO: 11126 - protein, 186 aa, Thioalkalivibrio paradoxus ARh 1
MDHYLDFTVLPDPEFRETTLLGALVSKLHRRLVVLEADDIGISLPDFEKAPPLGNRLRVHGTQERIETLMQEEWLGGMRGQLEIAPLRAIPAEVSHRGVRRRQYKTNVERLRRRRMRRHGETHEEARERIPDTVARKVKTPFLTVYSSSSGQRFSLFIEHEPVQARPVVGAFNSYGISRDATIPWF

SEQ ID NO: 11127 - protein, 188 aa, Thiomicrospira aerophila AL3
MKYYQEITLLPSPEVSINFLWQKLYQPLHLLMVETKTQPATEWLRISFPEYTQRFLGKKMRVFSEGEAVLQKLDLKKKFHNYDDYLHITQIRQVPENVNGVIIFKRYQPKQNSQSHATRLAKRHGLSVDEAFGLLNAKPAQPLPFINLKSLSSKQDYRLRIQKQSIDSSQQQEVIFNAYGLNNPVPDF

SEQ ID NO: 11128 - protein, 192 aa, Selenomonas ruminantium subsp. lactilytica TAM6421
MKFYQELTLLPDAEINENHIWSKLYQQLHLALATQMEDGSKGHIGVSFPQYEDGRKVQLGSKLRIFAETEAQLEALAIKKWLQRYEDYIHMTSIRPVPKRVHGYAIYRRYHQEASSMQKARRYAKRHDVSYDEALKLFPQECRDKKVPFVQMHSETNQQKYRLCIERIVQESYQDVGFGSYGLDNQSTVPEF

SEQ ID NO: 11129 - protein, 184 aa, Erwinia pyrifoliae Ep1/96
MDHYQDIRVRVDEENGEAVLLAQVFMHLHQVLMRAANGRIGISFPNVKRTLGDRIRLHGTLDDLSALQQSGWNKCLRDYIACSDIAPVPKGAAWRTVRRVQVKSSAERLRRRSVNKGWLSEQEAAERISVLNEQRSNLPFLQIKSGSNGQAWRLFIEHGSLVSAPSDGSFSSYGLSAAATIPWF

SEQ ID NO: 11130 - protein, 184 aa, Erwinia pyrifoliae DSM 12163; identical to SEQ ID NO: 11129

SEQ ID NO: 11131 - protein, 188 aa, Xanthomonas albilineans GPE PC73
MQHYLDLHLRPDPELAPYQLLGALYARLHRSLVTLNTTRIGVSFPGHDNRVPTLGTHLRLHGDDSTLHHLMATTWLHGVRDHVTITSIGAVPSEAVHRQVTRVQAKSSPERLRRRAMRRHGISEDLAVQRIPDSAAEQLRLPFVVLGSRSTGQTAFPVFVRHGPVQQEPVPGDFSSYGLSRGATVPWF

SEQ ID NO: 11132 - protein, 184 aa, Erwinia piriflorinigrans CFBP 5888
MDRYQDIRVRVDEEIGEAVLLAQVFMRLHQVLRQTANGRIGISFPGVKVTLGDRIRLHGTQDDLHALQHSGWDRGLTDYISCTDIAPVPPQAVWRSVRRVQVKSSAERLRRRSVNKGWLNEAQAAERISVVNEQRSDLPYLQIKSGSNGHAWRLFIEHGPLLSARCEGSFSSYGLSATATVPWF

SEQ ID NO: 11133 - protein, 190 aa, Dialister invisus CAG:218
MEYYQEITLLPCAEVSLAFLWTKVFTQLHIAFADGKNKSEHNPYAVSFPEYRETGLGEKIRIFAEAQELERLNLSKVLGRLFDYVHCTGIRKVPERKLRGYAVYSRYQPEGSIWVKARRYAKRHPGVTIEEAARLLQGKRKSVRLPYIQMKSLSRGGTFSLFIKKRVEKESVLTECGTYGLSNNRTVPEF

SEQ ID NO: 11134 - protein, 192 aa, Dialister sp. CAG:357
MMKYYQEITLIPDAEIPPDFLWTKVYAQIHLAFADRENIDHKQIYGVSFPEYADESMGEKARVFAPEEADLKKLDLKKALRRLSDYVHITSIREVPESKVKGYVKFARYQPDSSIARKARRYAKRHPEVTEKAAFKMLKQREEKYDLPFIQLKSLSTGQTFNLFVKKEEKKEEGQGGFTTYGLSKGAAVPEF

SEQ ID NO: 11135 - protein, 193 aa, Megasphaera elsdenii CAG:570
MWFFQDVILQPTEDISASFLWSRVYRQVHLALVNSKDEQGIIRCGVAFPEYSEENLTLGHRLRLLAPEESDLQRLNLADALMRFAPDYVKITTIRQVPIRKCKGYVTYSRYQPEATVMQKARRYAKRHGISIEEAQKLFPTDVSKNRYPYIQLESMTNHHRFSLFIQKQEAVEQPCNGFSAYGFSKKSSVPDF

SEQ ID NO: 11136 - protein, 185 aa, Morganella morganii IS15
MRFYQTITILPDALISAVFLRQQIWRQLHLILAENKTGENSSAVAVAFPDYCRKPQTPGNRLRLLAGDYPSLAELGLSVRLAAFYPYIRLSGILPVPEKTLPVSYIREHVKGLRRSQAAEAGRLFIPETLPFIWTKSLSGGRHHRPFPFFIRKLDAKSAAEGRFTCYGLSQKRTESGRVATVPHF

SEQ ID NO: 11137 - protein, 185 aa, Coxiella burnetii 'MSU Goat Q177'
MNYYFDINLLSDAEIPSTVLMNAVCKKLHKLLCDLDSTRIGISFPKYKITLGNVLRLHGTEFDLQKLHEVSWLGGMNGYCKISEVATVPVNTKHRTVYRKQPTMSQSKLKRLLKRGTITNDEVKSYKAKMVAEKGLNNPYLDLVSGTNCQRHRRYIVLGELLDEPVEGGFDQFGLSKTVTVPWFD

SEQ ID NO: 11138 - protein, 184 aa, Yersinia pestis biovar Orientalis str. IP275; identical to SEQ ID NO: 11060

SEQ ID NO: 11139 - protein, 185 aa, Coxiella burnetii Q321; identical to SEQ ID NO: 11137

SEQ ID NO: 11140 - protein, 184 aa, Yersinia pestis biovar Orientalis str. F1991016; identical to SEQ ID NO: 11060

SEQ ID NO: 11141 - protein, 184 aa, Yersinia pestis biovar Antiqua str. E1979001; identical to SEQ ID NO: 11060

SEQ ID NO: 11142 - protein, 184 aa, Yersinia pestis biovar Antiqua str. B42003004; identical to SEQ ID NO: 11060

SEQ ID NO: 11143 - protein, 184 aa, Yersinia pestis biovar Orientalis str. MG05-1020; identical to SEQ ID NO: 11060

SEQ ID NO: 11144 - protein, 184 aa, Yersinia pestis biovar Antiqua str. UG05-0454; identical to SEQ ID NO: 11060

SEQ ID NO: 11145 - protein, 184 aa, Yersinia pestis biovar Mediaevalis str. K1973002; identical to SEQ ID NO: 11060

SEQ ID NO: 11146 - protein, 211 aa, Providencia stuartii ATCC 25827; identical to SEQ ID NO: 11109

SEQ ID NO: 11147 - protein, 184 aa, Escherichia coli B7A
MDHYLEIRVLPDPEFSSEMLMAALFAKLHRALGARGQGDIGVSFPDVNVTPGARLRLHGSAPALQELEASTWRKGLTDYCQCSPVTPVPEIKGWRVVSRVQVKSNPQRLLRRSVKKGWLTEEQAIERLATQAELRTDLPFLNMKSLSSQQQFKLFIRHGDLLTEPVKGEFSSYGLSATATIPWF

SEQ ID NO: 11148 - protein, 201 aa, Nitrosococcus oceani AFC27; identical to SEQ ID NO: 11059

SEQ ID NO: 11149 - protein, 200 aa, Vibrio sp. 16
MNKRYFFYIRYLPEQVDCGLLAGRCISQMHKFMVNNKQAMNQIGVSFPCWCADSVGNSIAFISEDKDLLIGLTFQPYFSVMKEEELFELSDVHQVPEGATELRFVRNQTIGKSFIGSKKRRMKRSIARAELTDSQSLPVADEDREVEHFHRIPISSGSSRQDFILHVQKEHVGESVPTNFNSYGFATNQDKRGTVPDIHI

SEQ ID NO: 11150 - protein, 184 aa, Escherichia coli; identical to SEQ ID NO: 11092

SEQ ID NO: 11151 - protein, 199 aa, Oxalobacter formigenes OXCC13
MHHPWRRLFRERQLMKPNWYFELDMPEGGRDEFSPAPAMRNRLLGILHAFFSQNPHNYAVALPKERNRLRVFASSRDDLDKLVAYLTPNRWIRDYVRLSYPVSVETLSVKKWQSYCRYRIPTDKSDRKTGEEKGLLRQRRMKEARDKGMEFFIVHSKSTGQSYSFFINRIDGLPSGEECLPNSYGFSTTDKPFYLPEPS

SEQ ID NO: 11152 - protein, 197 aa, Oxalobacter formigenes OXCC13
MKHYIEITLTGSPDFPLYHLWSKLYTQLHLALVENRDASDQVNIGVSFPEYYFNEEKGMGFLGTKLRLFAEDETSLQKIDIQKWFVRLNDCIHITPVCRVPLNEITGYATFSRKHIKSNAERLARRQMKRHKDLSFHETVQRYQKNLAKSPLPFIQLESLTNSHPFKLFIEKKPAINASLKVFTTYGLSAESTIPEF

SEQ ID NO: 11153 - protein, 176 aa, Yersinia kristensenii ATCC 33638
MLADPEFSTQALLEALFAKLHRALVATGHGRIGVSFPSAGKTLGSQLRLHGGSGDLVELQSAGWLKGLRDYCECSEIIPIPTRVQYRVVRRVQVKSNAQRLRRRSVSKGWLTEEEALLRIPDNREQHCHLPFLRLKSLSSEQSFLLFIDQGELQQAPVSGTFSAYGLSAIATVPWF

SEQ ID NO: 11154 - protein, 185 aa, Yersinia rohdei ATCC 43380
MIMDHYLDIKVQPDLETSAQDLLNNLFAKLHRALGHYAAGRIGVSFPCSDKTLDCVLRLHGSAQDIDNLMQQNWLQGMRDYVRCSAVLPVPEAVQYRTVRRVQAKSAHNKRQRSIAKGWLTEQQAFEQIPDTQQKSLRLPFIQLRSLSNGNTMRIYIQHGELQEQAQLGSFSAYGLSSSTTIPWF

SEQ ID NO: 11155 - protein, 47 aa, Yersinia intermedia ATCC 29909
MSFIQLRSLSNGNTMRIYIQHGELQEQAQLGSFSAYGLSNSTTIPWF

SEQ ID NO: 11156 - protein, 207 aa, Enhydrobacter aerosaccus SK60
MSFEFYVDVRVIESADTVDLSLPTIRNQIYAVLHGTFRALALVDKSPYAIALVASPKLKAKQADFEKKYGKSPRFDFDIFRVFSDSSEALQRLVDSISQHWKVRDYSVVGTPTPVPTAKITGWQSYRRFRIPTAKMERTQLSDNNVPLRERRLATAKDLPYLKVASKSTGQVFTLTIDIVPMENAGDGVPDGYGLARASQPFALPIF

SEQ ID NO: 11157 - protein, 215 aa, Vibrio mimicus VM603
MAVMNYYQEITLLPDADIALGFLWQNVFQQVHIALVEHKVASNQSLVAVGFPDYRQAQFPLGSKLRLFAKEQVTLEKLDIHRWLTRLEDYVHIKGIKPVPSYVTYVSFVRKQVKSPGRIERDMQQKAALWAAKSGKQLVECLADLQQSKPTALCSLPFIYLHSQQTKQRSPEKNSKFPLFIEMQQQSTSQDGSFDCYGLSSKANGQSAFATVPHF

SEQ ID NO: 11158 - protein, 190 aa, Dialister invisus DSM 15470
MEYYQEITLLPCAEVSLAFLWTKVFTQLHIAFADEKNKSGHNLYAVSFPEYRETGLGEKIRVFAEAQELERLNLSKVLGRLLDYVHCTSIRKVPERKLRGYAVYSRYQPEGSIWVKARRYAKRHPGVTIEEAARLLQGKRKSVRLPYIQMKSLSRGGTFSLFIKKRVEKESALTECGTYGLSNNRTVPEF

SEQ ID NO: 11159 - protein, 202 aa, Acinetobacter baumannii ATCC 19606 = CIP 70.34 = JCM 6841
MDANYYLDIRVLESSDDTDLKLGHIRNQIYTVIHGAFRKLPAHYALALEISDKLKAKQEQFEKKHGRSAKPNFDILRIFAEKQDELDELIEAIKGHWKIRDYTVLGAAIPVPTAKISGWKSYRKFRIPTLKSERTKLSHQNEPLRDRRLKTAKGMPFFQVVSSTGHGFTVIIDVQESENAGYGLPDSYGLARKESPFALPVF

SEQ ID NO: 11160 - protein, 186 aa, Pasteurella dagmatis ATCC 43325
MTTHYIELKAIPQMDMLQSEVVGHCMQTLHKFLPHFEGRIGIAFPAYGLGRTLGGILRAFGNEADCNALYQQLLQSGLEDYALISQVKVTPTSTEHRCYSRVHRKGQSCIRRTEAFLKSINKWNEGIREEMQNRHQSTAFFPHIHLKSASTSQRFILAVKERKMLKACEGQFGSYGLSKIATVPHF

SEQ ID NO: 11161 - protein, 199 aa, Mitsuokella multacida DSM 20544
MKGMKDMWFYQDVILKPTEDITTSFLWSRVYRQIHLALASSKDEQGMIRCGVAFPEYSDATPTLGRTLRLLAPEESDLQHLNLIDALKHFTPDYVKIKSIRPVPVRSCKGFVTYRRYQPEATAAQKARRYAKRHNMSIKEAQKLFPTPVNETHYPYIQLESMTNHHRFSLFIQKKEADEHPYEGFSAYGFSKRSSVPDF

SEQ ID NO: 11162 - protein, 204 aa, Acinetobacter lwoffii SH145
MQPNYYLDIRILDSADDGELTLTHLRNQIYSIVHGVFRKMPEKFALALEISPRQQRKMQVKEAKYNYPITQNYDVLRIFATEQNDLDQLIESIKDHWKIRDYAVLNHPIAVPMAKVTGWRSYFRFRIPTLKSERNVAEKAESRRAKRLKEAKQLPYFKVISQSTEQNFTVTIHIVNATEHIQGKPDGYGLARKSQPFTLPVFEV

SEQ ID NO: 11163 - protein, 184 aa, Yersinia pestis KIM D27; identical to SEQ ID NO: 11060

SEQ ID NO: 11164 - protein, 185 aa, Enterobacter cancerogenus ATCC 35316
MMDHYLEIHVRPDPEFHEEMLMAALFAKLHRALGARGKGDIGVSFPLHNLKPGTCLRLHGSAPALQALESTAWRKGLTDYCHCSDVRPIPAGVSWRCVSRVQVKSSPERLLRRSVKKGWLTEEEARLRLPGMSEQQTDLPWLTLRSLSTGQTFRLFIRHGEIGNTPVPGTFSTYGLSGTATIPWF

SEQ ID NO: 11165 - protein, 189 aa, Neisseria sp. oral taxon 014 str. F0314
MSSHYADLKAIPQAEMLQSQVVAHIVQTLHGLLPRFGGRIGIGFPAYGQNRTLGGIVRLFGSETDLDDLHCLLQNTGLSDYALIGRIEEVPSEKVYAHARFVRRQPKHGSDLRRAEKRMAAQDLPPEEIRRRLAAKAAKRSACTLPHIFLNSKSTRQRYLLAVDKKIAARTEGTFNSHGLSLGASVPLF

SEQ ID NO: 11166 - protein, 197 aa, Desulfonatronospira thiodismutans ASO3-1
MQPLYYMDIEIKRPKVEADSPIYTRIEKIFSRIHLRIKEGYKFAVAFPSMLSLPGLGDSIRVFGETREDLWGLEDYLGGAPNFEYEYIATNSDVAPVPDERVVGYEYYARFRIPSKKNSKRFSENLEAHQKQQQLRQKRLKIAASLPFVNVTSKSTARSFKLFVEKGACTNGLHGSPDGYGLSRQGNIISLPVFYDE

SEQ ID NO: 11167 - protein, 189 aa, Actinobacillus pleuropneumoniae serovar 1 str. 4074
MSELTHYIELKAIPQVDILQTDVIAHGLQILHKFLPLYQGEIGLSFPAYGLGRTLGGIIRVFGNEQHCAQIKVQLTAEGLQDYALITSVTPIPEEIAEHRRYQRVHRKGQSAIRRTEKFLVQQGKWTEEIRQEMLIHQQNQKVFPYVKLKSGSTKQHFVLAIRQLRLAEPVSGLFNAYGLSKIATVPHF

SEQ ID NO: 11168 - protein, 189 aa, Actinobacillus pleuropneumoniae serovar 2 str. S1536
MSELTHYIELKAIPQVDILQTDVIAHGLQILHKFLPLYQGEIGLSFPAYGLGRTLGGIIRVFGNEQHCTQIKTQLIGEGLQDYVLITSVTPVPEEIVEYHRYQRVHRKGQSAIRRTEQFLVQQGKWTEEIRQEMLIHQQNQKVFPHVKLKSGSTKQHFVLAIRQLRLAEPSFGLFNTYGLSKIATVPHF

SEQ ID NO: 11169 - protein, 189 aa, Actinobacillus pleuropneumoniae serovar 4 str. M62; identical to SEQ ID NO: 11168

SEQ ID NO: 11170 - protein, 189 aa, Actinobacillus pleuropneumoniae serovar 6 str. Femo
MSELTHYIELKAIPQVDILQTDVIAHGLQILHKFLPLYQGEIGLSFPAYGLGRTLGGIIRVLGNEQHCTQIKTQLIGEGLQDYVLITSVTPVPEEIVEYHRYQRVHRKGQSAIRRTEQFLVQQGKWTEEIRQEMLIHQQNQKVFPHVKLKSGSTKQHFVLAIRQLRLAEPSFGLFNTYGLSKIATVPHF

SEQ ID NO: 11171 - protein, 189 aa, Actinobacillus pleuropneumoniae serovar 9 str. CVJ13261; identical to SEQ ID NO: 11167

SEQ ID NO: 11172 - protein, 189 aa, Actinobacillus pleuropneumoniae serovar 10 str. D13039
MSELTHYIELKAIPQVDILQTDVIAHGLQILHKFLPLYQGEIGLSFPAYGLGRTLGGIIRVFGNEQHCAQIKVQLTAEGLQDYALITSVTPIPEEIAEHRRYQRVHRKGQSAIRRTEKFLVQQGKWTEEIRQEMLIHQQNQKVFPYVKLKSGSTKQHFVLAIRQLRLAEPSFGLFNTYGLSKIATVPHF

SEQ ID NO: 11173 - protein, 189 aa, Actinobacillus pleuropneumoniae serovar 11 str. 56153; identical to SEQ ID NO: 11167

SEQ ID NO: 11174 - protein, 189 aa, Actinobacillus pleuropneumoniae serovar 12 str. 1096
MSELTHYIELKAIPQVDILQTDVIAHGLQILHKFLPLYQGEIGLSFPAYGLGRTLGGIIRVFGNEQHCTQIKTQLIGEGLQDYVLITSVTPVPEEIVEYHRYQRVHRKGQSAIRRTEKFLVRQGKWTEEIRQEMLIHQQNQKVFPYVKLKSGSTKQHFVLAIRQLRLAEPVSGLFNAYGLSKIATVPHF

SEQ ID NO: 11175 - protein, 189 aa, Actinobacillus pleuropneumoniae serovar 13 str. N273
MSELTHYIELKAIPQVDILQTDVIAHGLQILHKFLPLYQGEIGLSFPAYGLGRTLGGIIRVFGNEQHCTQIKTQLIGEGLQDYVLITSVTPVPEEIVEYHRYQRVHRKGQSAIRRTEQFLVQQGKWTEEIRQEMLIHQQNQKVFPYVKLKSGSTKQHFVLAIRQLRLAEPVSGLFNAYGLSKIATVPHF

SEQ ID NO: 11176 - protein, 198 aa, Vibrio parahaemolyticus Peru-466
MDWHYRTITFLPEYRNNEAIAAKCIKELHRFNYKYETRSIGVSFPLWGQETVGRKITFVSTNKMELDFLISRRYFVQMTKLGYFSISTTQTVPDDCSYVLFKRAHSIDKGTFAGRARELKRLERRALERGEIFDPIAYSKTTSHAFQSYHSLEEDSSSGNKFRLNIQMKERSGTVGTGKFSSYGLGNTDNSLQVVPLI

SEQ ID NO: 11177 - protein, 198 aa, Vibrio parahaemolyticus AN-5034; identical to SEQ ID NO: 11176

SEQ ID NO: 11178 - protein, 198 aa, Vibrio parahaemolyticus K5030; identical to SEQ ID NO: 11176

SEQ ID NO: 11179 - protein, 184 aa, Escherichia coli MS 145-7; identical to SEQ ID NO: 11147

SEQ ID NO: 11180 - protein, 184 aa, Escherichia coli MS 110-3; identical to SEQ ID NO: 11092

SEQ ID NO: 11181 - protein, 184 aa, Escherichia coli MS 57-2
MDHYLEIRVLPDPEFSSEMLMAALFAKLHRVLGARGQGDIGVSFPDVNVMPGTHLRLHGSAQALQELEASTWRKGLTDYCQCSPVTPVPEIKGWRVVSRVQVKSNPQRLLRRSVKKGWLTEEQAIERLATQAEQRTDLPFLNMKSLSSQQQFKLFIRHGDLLKEPVKGEFSSYGLSATATIPWF

SEQ ID NO: 11182 - protein, 196 aa, Moraxella catarrhalis 46P47B1
MKFYQEITLIPQADISPYTVWSKLYTQLHLAFVEQKDEQDKTVYGVSFPQYRTRADKKIAYLGYKLRVFAPTEQALSALNLDKWIERLADYIHISSIRSVPDDIKGYANYYRAIPKMTLDERITHQAKRHGVPYHKAAERFENYKEQSLVYPHIQLTSKSNHRSYPLHIGKQAAEVLTDGRFGTYGLSRTSSVPEF

SEQ ID NO: 11183 - protein, 196 aa, Moraxella catarrhalis 7169
MKFYQEITLIPQADISPHAVWSKLYTQLHLAFVEQKDEQDKTIYGVSFPQYRTIADKKIAYLGCKLRVFAPTEQALSALNLDKRLEHLADYIHISSIRSVPDDIKGYANYYRAIPKMTLDERITHQAKRHGVPYHKAAERFENYKEQSLVYPHIQLTSKSNHRSYPLHIGKQAAEVLTDGRFGTYGLSRTSSVPEF

SEQ ID NO: 11184 - protein, 196 aa, Moraxella catarrhalis 103P14B1
MKFYQEITLIPQADISPYTVWSTLYTQLHLAFVEQKDEQDKTIYGVSFPQYRTIADKKIAYLGCKLRVFAPTEQALSALNLDKWIERLADYIHISSIRSVPDDIKGYANYYRAIPKMTLDERITHQAKRHGVPYHKAAERFENYKEQSLVYPHIQLTSKSNHRSYPLHIGKRAAEVLTDGRFGTYGLSRTSSVPEF

SEQ ID NO: 11185 - protein, 196 aa, Moraxella catarrhalis 12P80B1
MKFYQEITLIPQADISPHAVWSKLYTQLHLAFVEQKDEQDKTIYGVSFPQYRTIADKKIAYLGCKLRVFAPTEQALSALNLDKQLEHLADYIHISSIRSVPDDIKGYANYYRAIPKMTLDERITHQAKRHGVPYHKAAERFENYKEQSLVYPHIQLTSKSNHRSYPLHIGKQAAEVLTDGRFGTYGLSRTSSVPEF

SEQ ID NO: 11186 - protein, 196 aa, Moraxella catarrhalis BC1; identical to SEQ ID NO: 11183

SEQ ID NO: 11187 - protein, 196 aa, Moraxella catarrhalis BC7
MKFYQEITLIPQADISPYTVWSTLYTQLHLAFVEQKDEQDKTIYGVSFPQYRTIADKKIAYLGCKLRVFAPTEQALSALNLDKQLEHLADYIHISSIRSVPDDIKGYANYYRAIPKMTLDERITHQAKRHGVPYHKAAERFENYKEQSLVYPHIQLTSKSNHRSYPLHIGKQAAEVLTDGRFGTYGLSRTSSVPEF

SEQ ID NO: 11188 - protein, 196 aa, Moraxella catarrhalis BC8
MKFYQEITLIPQADISPHAVWSKLYTQLHLAFVEQKDEQDKTIYGVSFPQYRTIADKKIAYLGCKLRVFAPTEQALSALNLDKQLEHLADYIHISSIRSVPDDIKGYANYYRAIPKMTLDERITHQAKRHGVPYHKAAERFENYKEQSLVCPHIQLTSKSNHRSYPLHIGKQAAEVLTDGRFGTYGLSRTSSVPEF

SEQ ID NO: 11189 - protein, 196 aa, Moraxella catarrhalis CO72
MKFYQEITLIPQADISPYTVWSTLYTQLHLAFVEQKDEQDKTIYGVSFPQYRTIADKKIAYLGCKLRVFAPTEQALSALNLDKWIERLADYIHISSIRSVPDDIKGYANYYRAIPKMTLDERITHQAKRHGVPYHKAAERFENYKEQSLVYPHIQLTSKSNHRSYPLHIGKQAAEVLTDGRFGTYGLSRTSSVPEF

SEQ ID NO: 11190 - protein, 196 aa, Moraxella catarrhalis 101P30B1; identical to SEQ ID NO: 11184

SEQ ID NO: 11191 - protein, 196 aa, Moraxella catarrhalis O35E; identical to SEQ ID NO: 11185

SEQ ID NO: 11192 - protein, 184 aa, Escherichia coli D9; identical to SEQ ID NO: 11147

SEQ ID NO: 11193 - protein, 204 aa, Acinetobacter baumannii 6013150
MMNWYQEITLIDQDEISLYFIWSKVYTQLHIAFAEHSNEQGRISFGVSFPQYRINEQKKIGFLGTKIRVFASSENDLQQLNLGKWLERFIDYVHITQPREVPRAKITGYAHYYRVNHRMSVEERIVHQAQRRNISLDQARQHFKQYVEQPVVEPYVSLKSLSAKREENVDRPYRLYIGKSLVDEARDGMFGTYGLSRMTTVPEF

SEQ ID NO: 11194 - protein, 204 aa, Acinetobacter baumannii 6013113; identical to SEQ ID NO: 11193

SEQ ID NO: 11195 - protein, 189 aa, Rheinheimera sp. A13L
MDRYIEITVLPDLEADASFLMNNLCSKLHAVLGQVTMGKVGVSFPGYAQAGKNLGTKLRIHGSAIMLEKLMAENWLKGLRDYSQCSAVLPVPTDAKQRYFARRQLKSAYNKQQRSVSKGWLTQEEAVVQISEQSSRLLKLPFIQLTSRGNKQQMKVFIEQGPIVDHPTKGGFNSYGLSRLSEKVTVPWF

SEQ ID NO: 11196 - protein, 212 aa, Vibrio cholerae HC-02A1
MNYYQEITLLPDADIALGFLWQNVFQQVHIALVEHKVASNQSLVAVGFPDYRQAKFPLGSKLRLFAKEQATLETLDIHRWLTRLEDYVHIKGVKPVPSDVTYVSFVRKLVKSPERIERDMQQKAELWAAKSGKPLVECLAALQQSKPTALCTLPFIYLHSQQTKQRSPEKNSKFPLFIEMQPQSTSQDGSFDCYGLSSKANGQSMLATVPHF

SEQ ID NO: 11197 - protein, 187 aa, Aggregatibacter actinomycetemcomitans serotype a str. H5P1; identical to SEQ ID NO: 11111

SEQ ID NO: 11198 - protein, 187 aa, Aggregatibacter actinomycetemcomitans serotype d str. I63B; identical to SEQ ID NO: 11111

SEQ ID NO: 11199 - protein, 187 aa, Aggregatibacter actinomycetemcomitans serotype e str. SCC393
MTVQTHYIEIKAIPQVDMLQTEVISFCLQKLHQILPHFEGRIGLAFPAYGNDKTLGGIIRLFGTENDCGFIHFKLQSLRDYALISEVMPIPEKVRSYRIYQRIQPKGQSSIRRAEKRLTAQGKWNEEVLQNMLQKQATQRIYPHVHLKSSSTKQQFILAIKSVHQTKAVEGVFSAYGLSQTTTVPHF

SEQ ID NO: 11200 - protein, 187 aa, Aggregatibacter actinomycetemcomitans serotype f str. D18P1
MTVQTHYIEIKAIPQVDMLQTEVISFCLQKLHQILPHFEGRIGLAFPAYGNDKTLGSIIRLFGTENDCGFIHFKLQSLRDYALISEVMPIPEKVRSYRIYQRIQPKGQSSIRRAEKRLTAQGKWNEEVLQNMLQKQATQRIYPHVHLKSSSTKQQFILAIKSVHQTKAVEGVFSAYGLSQTTTVPHF

SEQ ID NO: 11201 - protein, 187 aa, Aggregatibacter actinomycetemcomitans D17P-3; identical to SEQ ID NO: 11111

SEQ ID NO: 11202 - protein, 185 aa, Shewanella baltica OS625
MDHYLDIKLMEDPEFSAPILMNALFSKLHRALVEVSQGDIAVSFPTLSGKTLGKQLRIHGCYEVLTRLEQLPWRKGLSDYTQVMEVLPVPASDTHCLVSRVHVQSNLDRLRRRAMKRRSISYEEACLQIPEDKTTRLDLPFVQIKSQSTGEMFRLFIKQTQCPPSQADQAFSKYGLSNTATVPLF

SEQ ID NO: 11203 - protein, 143 aa, Halomonas sp. GFAJ-1
MSKDINALSYLSSARCFKNMADEGFIDVSDIKMVPEKLEEVRFIRNQHIAKSFPGEIKRRLIRSKNRAEKRGETFMPSSAVSDRFVDQCHVIPIDSRSSGQRFPLYVQLEALGEESKYNNYNSYGLATQYTYSGSVPNLKQIT

SEQ ID NO: 11204 - protein, 190 aa, Anaeroglobus geminatus F0357
MKYYQDITLLPDTEIPLHFLLSKVFSQIHLEFAEVKNREGNIPYALSFPEYGENTLGTKLRIFSNEKAELEKLDLRIKLSKFEDYIHITRIRDVPTNVKEYEIFSRYQVDGSVHQKANQYVKRHDGVTYEEAVKFLQQKVSKTKLPYIQMISLSNRNHFRLFVKRTTVNSPLQGECGSYGLSLQCAIPKF

SEQ ID NO: 11205 - protein, 184 aa, Hafnia alvei ATCC 51873
MNFYQDIRVLEDPEFSEPMLMAALFAKLHRVLGAQANGAVGISFPRAGKMLGDTLRLHGSQDALQTLQATPWLKGLRDYTQCSDIQRIPENVMHCTVSRVQVKSSAERLRRRSVKKGWLTEEQAREQILDANEQRTSLPFISLKSLSTGQMFQLFIRQGKAQPHPQTGTFSSYGLSSTATVPWF

SEQ ID NO: 11206 - protein, 184 aa, Escherichia coli H397; identical to SEQ ID NO: 11092

SEQ ID NO: 11207 - protein, 179 aa, Thiorhodovibrio sp. 970
MRPKAFFDVAPEERREKLMRVASRALREMHGIFRETPGQYALALPDHPRVGRGRLRIFAEKSGDLERLAYRLRELPVRFSDIANVPQDYSGPYRRYSRYRIQSRKQERDYKGTLRLRRMREAEAEQMPWFNMRSGSTGQEFRLYVSVADDAEGSLADSCEPDSYGLSVATRPFALPLLD

SEQ ID NO: 11208 - protein, 195 aa, Methylomicrobium album BG8
MKVYQDINLLPDAEIGLHFLWEKVYQQVHLALVEMQDADGKVPIGIALPAYDAENRRLGHKLRLLAETERQLEQCNVREWLSRLSDYVHLTQIRAIPDRVRTYAYYRRIQSKSSSARLARLARRKAERENIGIELAIATFENCVEQRIEAPFVWMKSQSSGERFRLFIEYVETGEPTKGGFSTYGLSHSSSVPVF

SEQ ID NO: 11209 - protein, 188 aa, gamma proteobacterium BDW918
MDHYFEIKAIPDPELLQSAVVGQLMQVLHGLLPAFCGRIGLSFPGYGQARTLGGILRLHGTSKDLDQLAFRLKALPIISSYALVTPIALVPSRLKGYARFQRLHVKGESDRRRMEARHKARGTWTPELAHAIAEKYQQAIVCPHVILRSQSTGQPRVPLFVEKLSVTGLVVGEFSAYGLSKTATVPWF

SEQ ID NO: 11210 - protein, 196 aa, Cellvibrio sp. BR
MQHYVEITLLPTDDIGHYFLWSKIYQQLHLALVELTAGQGGSVGFSFPEYSAKQPRLGRKVRVFAPSEAQLVQFNAQKWLERLSDYCHISSIRGVPEKMLYAVFNRKQCVNNPERLARRRAKRKGETFEQALAHFAGFDGEFSSLPFVELESLSTAPATDANHRFKLFIDQKIVSQPQEGSFNCYGLSNTATIPWF

SEQ ID NO: 11211 - protein, 188 aa, Rhodanobacter sp. 115
MTTHYIDLTVVPDPESGTTQLLGALYDRLHLALVQQGLDSIGVSFPGYSVNPRSLGSKLRLHGSDASLRQLFAADWLKGMRDHVRMTDIAPAPADAPHRTVQRKQFKTNVERLRRRRMKRKGETVEQAQEAIPYSVERTPSLPYLHIRSRSTAQPFCLFIAVGALGPSAVPGNFNSYGLGGPATIPWF

SEQ ID NO: 11212 - protein, 184 aa, Pectobacterium wasabiae CFBP 3304
MDHYIDIRVQPDPEFTAPQLLNALFAKLHRALGQLADGKIGISFPEVGKTLGECLRLHGTADALSTLEQTAWLKGLRDYTQISACKAVPDGVKFRTVRRVQIKSSAERLRRRSVSKGWLTATEAAARIPDAIEKRSALPFVQIKSLSNGQMFFVFVEHGPLQNTPAAGRFSSYGLSAEATVPWF

SEQ ID NO: 11213 - protein, 38 aa, bacterium
SNGQRHRRYIVLGELQDQPVEGEFDQFGLSKTSTVPWF

SEQ ID NO: 11214 - protein, 187 aa, bacterium
MDSYIELQLLPDPEFPATTLMNALFAKLHRGLVSNGEGRIGISFPVVASKEPGLGSRLRLHGQAVDLEKLMALNWLQGMRDHLSVGAISTVPVNASYRIVRRVQAKSSPERERRRLVARKGITPEAAVLAIPDSAAESLTLPYLLLTSQSTQQQFRLFIEHRPLQDQPASGLFNAYGLSAGATIPWF

SEQ ID NO: 11215 - protein, 196 aa, Moraxella catarrhalis RH4; identical to SEQ ID NO: 11185

SEQ ID NO: 11216 - protein, 212 aa, Vibrio cholerae HC-50A1; identical to SEQ ID NO: 11196

SEQ ID NO: 11217 - protein, 212 aa, Vibrio cholerae HC-52A1; identical to SEQ ID NO: 11196

SEQ ID NO: 11218 - protein, 212 aa, Vibrio cholerae HC-56A1; identical to SEQ ID NO: 11196

SEQ ID NO: 11219 - protein, 215 aa, Vibrio cholerae HC-55A1
MAVMNYYQEITLLPDADIALGFLWQNVFQQVHIALVEHKVASNQSLVAVGFPDYRQAKFPLGSKLRLFAKEQATLETLDIHRWLTRLEDYVHIKGVKPVPSDVTYVSFVRKLVKSPERIERDMQQKAELWAAKSGKPLVECLAALQQSKPTALCTLPFIYLHSQQTKQRSPEKNSKFPLFIEMQPQSTSQDGSFDCYGLSSKANGQSMLATVPHF

SEQ ID NO: 11220 - protein, 212 aa, Vibrio cholerae HC-57A1; identical to SEQ ID NO: 11196

SEQ ID NO: 11221 - protein, 212 aa, Vibrio cholerae HC-51A1; identical to SEQ ID NO: 11196

SEQ ID NO: 11222 - protein, 213 aa, Providencia burhodogranariea DSM 19968
MNYYQEITLLPDPTIPLDFLWQKVYQQIHIALVENKSSDGHSAIAVAFPEYGSVGFRLGRKIRLFAMTEGELTQLNMTKWLSRLADYVHIKSIQSVPEHTRAVSYVRQHVKGERRIESDMHKKAQLWAEKTGQSKDVCLAVLKKNRPEAHNRLPFLWMESQQTKAQSGEGVHRPFPLFIKRISAEQAQVGLFNCYGLSQITGGEANLATVPHF

SEQ ID NO: 11223 - protein, 187 aa, Aggregatibacter actinomycetemcomitans Y4; identical to SEQ ID NO: 11111

SEQ ID NO: 11224 - protein, 212 aa, Vibrio cholerae HC-78A1; identical to SEQ ID NO: 11196

SEQ ID NO: 11225 - protein, 189 aa, Halomonas titanicae BH1
MDHYIDIRLRPDPDFAPAMLMGALYNKLHRALFDLQATDLGVSFPGHKHGVRARTLGDHLRLHGTQARLGQLMGADWLTGMRDHTQVSEVLAVPANSQHFNVARKQFNTGSPSRAKRYAKRHDISEDEAQQIYAKLAARRIELPFVQINSRSTQQRFSLFIEHGKPQEKPVAGSFNHYGLSPDATVPWF

SEQ ID NO: 11226 - protein, 202 aa, Halomonas titanicae BH1
MRYFFHIRYLMPSANHAFLAGRCIACLHSFMTGPKITNHGVGVSFPLWATDTVGGSIAFVSKDNNALSNLSSARYFKNIADEGFIEVSGVKMVPSTLEEVRFIRNQHIAKSFPGEIKRRLARGKKRAEKRGETFMPISVVSDRLVDHCHVIPIDSRSSGQRFPLYVQLEALSEESKHDSYNSYGLATQHSHTGSVPNLKHIT

SEQ ID NO: 11227 - protein, 185 aa, Morganella morganii SC01; identical to SEQ ID NO: 11136

SEQ ID NO: 11228 - protein, 187 aa, Thauera sp. 28
MDHYIDITVLPDPEFPATTLMNALFAKLHRGLVDHGGQDIGVSFPEVMLGKRTLGQRLRLHGNSVSLDRLMAIGWMQGMRDHVTITSVQPVPAGVQHRVVRRVQAKSSPERLRRRLMARKSIDAETARTAIPDSAAEMLELPYIEIASRSTEQRFRLFIEHVEPVPTPREGTYGSYGLSSSATIPWF

SEQ ID NO: 11229 - protein, 188 aa, Xanthomonas fragariae LMG 25863
MDHYVDLQLRPDPELAPHQLLSGLYVRLHRALVQQQRQDIGVSFPRHDARKPSLGAHLRLHGRQTALQMLMARPWLHGMLDHLAVSAILAAPADTQHRHVTRVQAKSSPSRLRRRAMRRHGIDAETAAQRIPDAAAEQLPLPFVVLGSRSTGQASFPLFIRHGPLLSEPTNGSFNSYGLSQEATVPWF

SEQ ID NO: 11230 - protein, 187 aa, Pasteurella multocida 1500E
MMTTHYIELKAIPQMDMLQSEVIGHCMQILHQFLPHFEGRVGVAFPAYGLGRTLGGIVRLFANQEDCNQLHQQLLRSGLSDYALISEVSKTPLSTECRSYSRVHRKGQSAIRRTEKRLKSQGRWDESIRADMQQRQQNVAFFPHCHLKSASTGQRFILAVKENRMPQSCVGVFNAYGLSNSATVPHF

SEQ ID NO: 11231 - protein, 187 aa, Pasteurella multocida P1933; identical to SEQ ID NO: 11230

SEQ ID NO: 11232 - protein, 187 aa, Pasteurella multocida 2000; identical to SEQ ID NO: 11230

SEQ ID NO: 11233 - protein, 187 aa, Pasteurella multocida 93002; identical to SEQ ID NO: 11230

SEQ ID NO: 11234 - protein, 186 aa, Pasteurella multocida 671/90; identical to SEQ ID NO: 11105

SEQ ID NO: 11235 - protein, 212 aa, Vibrio fluvialis PG41
MNYYQEITLLPDADIALGFLWQNVFQQVHIALVEHKVASNQSLVAVGFPDYRQAKFPLGAKLRLFAKEQATLEKLAIHRWLTRLEDYVHIKGIKPVPNDVTYVSFVRKQVKSPERIERDMQQKAELWAAKSGKPLVECLADLRQSKPTALCSLPFIYLHSQQTKQRSPEKNSKFPLFIQMQQQSTSQDGGFDCYGLSSKANGQSALATVPHF

SEQ ID NO: 11236 - protein, 213 aa, Acinetobacter gerneri MTCC 9824
MQANFYIDIRILDSADDGELALPHLRNQIYNIVHGAFRELPERFALALEISPRQQRKMQATELKYGRKPSNQYDILRIFSAEKNELEQLIENIKSHWKIQDYAVLSQAALDVPTAKITGWKSYNRFRIPTLKMERNLPSNPEQKTLHQRRLEIARRLPYFRVKSQSTGQLFTVPIDIRDVELSDTKDMGNGLPDSYGLARQTQPFALPVFEVI

SEQ ID NO: 11237 - protein, 204 aa, Acinetobacter junii MTCC 11364
MKFYQEITLIDQAEISPYFIWSKLYTQLHIALAEIKDDSDKVGIGASFPQYIFEEKVENQKARINLGNKLRLFAESEADLKKLDIRKWLERLEDYVHITSIREVPSDIKGYAIYKRKQVKTNAQRLARHRIKRGDIGFDEALARYSNVVTTTNFPYIEMKSLSTSDQQSEKRFKLFIEKQPAEKTETQVFSTYGLSSVSSVPEF

SEQ ID NO: 11238 - protein, 203 aa, Acinetobacter haemolyticus MTCC 9819
MDWYQEITLIDQDEISPYFIWSKVYTQLHIAFAEHSNEQGRISFGVSFPQYRMNEQKKIGFLGTKIRIFANTENELQQLNLGQWLERLMDYVHIIQPREVPQAKVTGHAHYYRVNPKMSIEERIAHQAQRHNIPLAEAKQHFKQYVEQPVVEPYVSLKSLSAKREENIDRPYRLYIGKSVADEAKDGKFGTYGLSRMATVPEF

SEQ ID NO: 11239 - protein, 187 aa, Pseudomonas aeruginosa WC55
MDHYLDIRLRPDPEFPPAQLMSVLFGKLHQALVAQGGDRIGVSFPDLDESRSRLGERLRIHASADDLHALLARPWLEGLRDHLQFGEAAVVPHPTPYRQVSRVQAKSNPERLRRRLMRRHDLSEEEARKRIPDTVARTLDLPFVTLRSQSTGQHFRLFIRHGPLQATAEEGGFTCYGLSKGGFVPWF

SEQ ID NO: 11240 - protein, 203 aa, Pseudoalteromonas arctica A 37-1-2
MQRYYFTVHFLPKQANLALLTGRCISIMHGFILKHNIEGMGVTFPAWSDSSIGNVIAFVHKDMEVLNSLKEQAYFVDMQDCGFFKISQISTVPDSCQEVRFIRNQSVAKIFTGESRRRLKRLQKRALARGEDFNPKKLEAPREIDIFHRVAMTSKSSQEDYILHIQKQDADCQAEPVLSNYGFSSNEKFKGTVPDLSPLIESN

SEQ ID NO: 11241 - protein, 226 aa, Pseudoalteromonas citrea DSM 8771
MKYYLDITLLPDAETNLGFLWHKVYQQIHIMLVEHKISDKNSEIALSFPKYRHLGSSDKDSKVFPLGNKLRMFAQTYEKLDGLKIAQWLNRLDDYVHIKAIKEVPNDVTEYAYFKRKNFKSPAKLIKEIDSRAAKIAAKNGFDLAKVKERLMVSITKLEERSTLPYINLRSLSSDKLLSAEDRKKFLLFIECEIVTQPLNQIGLFTCHGLSRRSEEEQSAVPWFEG

SEQ ID NO: 11242 - protein, 197 aa, Pseudoalteromonas spongiae UST010723-006
MSRAYFTITYLPENCDVTLLAGRCIGILHGFMNKLSCNHIGVSFPKWTDKHLGNQIAFVSEDKTALKNLSQQNYFEMMAHDKLFEISVIKPVPADATEVRIIRDQSLGKLFMGEKRRRMERAKRRAEARGEEYTPQYVSSDIEISTFHKIPIASKRNQNDFVLHLRLELANSIQNTFNSYGFATNEEYKGSVPLLAF

SEQ ID NO: 11243 - protein, 201 aa, Pseudoalteromonas undina DSM 6065
MKRYYFTITYLPKNCDVSLLAGRCIGILHGFMSSRKVSNIGVCFPKWNKKTIGNELAFVSTDKKQLTNLSQQSYFEMMAHDKLLGLSKILEVPPNQSEVMFVRNQSVAKAFVGEKQRRLKRAKKRAEARGEIYNPEYKFEGKDIGHFHSIPLTSKGNGENFILHIQKIEKAESIRNQFNNYGFATNQTFQGTVPSLNSLFE

SEQ ID NO: 11244 - protein, 202 aa, Acinetobacter baumannii EGD-HP18; identical to SEQ ID NO: 11159

SEQ ID NO: 11245 - protein, 212 aa, Vibrio cholerae HC-36A1; identical to SEQ ID NO: 11196

SEQ ID NO: 11246 - protein, 184 aa, Yersinia pestis S3; identical to SEQ ID NO: 11060

SEQ ID NO: 11247 - protein, 184 aa, Yersinia pestis 24H; identical to SEQ ID NO: 11060

SEQ ID NO: 11248 - protein, 184 aa, Yersinia pestis 113; identical to SEQ ID NO: 11060

SEQ ID NO: 11249 - protein, 184 aa, Yersinia pestis 9; identical to SEQ ID NO: 11060

SEQ ID NO: 11250 - protein, 184 aa, Escherichia coli 908519; identical to SEQ ID NO: 11181

SEQ ID NO: 11251 - protein, 184 aa, Escherichia coli 908675; identical to SEQ ID NO: 11092

SEQ ID NO: 11252 - protein, 184 aa, Serratia sp. ATCC 39006
MDHYIDIRVLPDPEFNASQLLSAVFAKLHRALAQLADGTVGVSFPDMGKTLGERLRLHGTAPALSALEQTGWLKGLRDYTQITALRAVPDEVRFRTVRRVQVKSSAERLRRRSVSKGWLSEAEAAARIPDAVEKRSALPFIQLKSLSSGQMFRLFVEHGPIKDSPSVGKFSAYGLSMEATIPWF

SEQ ID NO: 11253 - protein, 186 aa, Pasteurella multocida subsp. multocida P1062; identical to SEQ ID NO: 11105

SEQ ID NO: 11254 - protein, 184 aa, Escherichia coli CE418; identical to SEQ ID NO: 11147

SEQ ID NO: 11255 - protein, 199 aa, Pseudoalteromonas agarivorans
MKRYYFTITYLPKNCDVSLLAGRCIGILHGFMSSREISNIGVCFPKWNEQTIGNEVAFVSTDKKQLMNLSQQSYFEMMAHDKLFYLSKILDVPTEQNEVMFIRNQSVAKAFAGEKQRRLKRAKKRAEARGEVYNPEYKFEAKDIGHFHSIPVSSKGNGENFILHIQKIEKAEPINNHFNNYGFTTNQTFQGTVPSLNIQ

SEQ ID NO: 11256 - protein, 187 aa, Pseudomonas aeruginosa VRFPA09
MDHYLDIRLRPDPEFPPAQLMSVLFGKLHQALVAQGGDRIGVSFPDLDESRSRLGERLRIHASADDLRALLARPWLEGLRDHLQFGEPAVVPHPTPYRQVSRVQAKSNPERLRRRLMRRHDLSEEEARKRIPDTVARTLDLPFVTLRSQSTGQHFRLFIRHGPLQATAEEGGFTCYGLSKGGSVPWF

SEQ ID NO: 11257 - protein, 200 aa, Pseudoalteromonas sp. BSi20480
MKRYYFTITYLPKNCDVSLLAGRCIGILHGFMSSREISNIGVCFPKWNEQTIGNQIAFVSTDKKQLTNLSQQSYFEMMAHDKLFDLSKILEVPTNQSDVMFVRNQSVAKAFVGEKQRRLKRAKKRAEARGEVYNPKYKFEAKDIGHFHSIPVSSKGNGQSYILHIQKIEKTEPINNQFNNYGFATNQTFQGTVPSLNTLF

SEQ ID NO: 11258 - protein, 200 aa, Pseudoalteromonas sp. BSi20495
MKRYYFTITYLPKNCDVSLLAGRCIGILHGFMSSREISNIGVCFPKWNEQTIGNQIAFVSTDKKQLINLSQQSYFEMMAHDKLFGLSKILEVPVNQSEVMFVRNQSVAKAFVGEKQRRLKRAKKRAEARGEVYNPEYKFEAKDIGHFHSIPVSSKGNGENFILHIQKIENTNAVRNQFNNYGFATNQTFQGTVPSLNTLF

SEQ ID NO: 11259 - protein, 203 aa, Acinetobacter radioresistens DSM 6976 = NBRC 102413 = CIP 103788
MMDANYYLDIRVLESSDDTDLKLGHIRNQIYTVIHGAFRKLPAHYALALEISDKLKAKQEQFEKKHGRSAKPNFDILRIFAEKQDDLDELIEAIKGHWKIRDYTVLGAAIAVPTAKISGWKSYRKFRIPTQKTERTKLSHQNEPLRDRRLKTAKGMPFFQVVSSTGHGFTVIIDVQDSENAGYGLPDSYGLARKESPFALPVF

SEQ ID NO: 11260 - protein, 199 aa, Paraglaciecola chathamensis S18K6
MKHYIDITLLPSDDIGVHFLWSKVMMQVHLALVEIQDSNKQVPVAVSFPHYRENANNATAFIGNKLRLFSENKTDLKRLNIQKWLNRLDDYVHIKNITEVPANIGSFESFSRRQKSGSPDKHIRRRMKRHNETLEQASKHFSDYKMADEDKALPFIKMKSLTSNDEFNMSIARKVTEQSSNPVMFNTYGFNRKAPLPKF

SEQ ID NO: 11261 - protein, 198 aa, Aliiglaciecola lipolytica E3
MKHYIDITILPSDDIGVHFLWSKLMMQVHLALVEIQDSNKQVPIAVSFPNYRMNTVKPGFLGNKLRLFSVNKADLERLNIHKWLSRLTDYLHIKNIADVPADVDSFENFNRRQKAGSPDRHIRRRMKRHNETFEQASQHFVDYEMSEEDKALPFIKMKSLGSDNDFNMSVIRKTVALNNAPVMFNTYGLSKQGCLPKF

SEQ ID NO: 11262 - protein, 200 aa, Paraglaciecola arctica BSs20135
MKHYLDITLLPDAEANLGFLWQKVFQQVHIALVDNKVGDNESAVALSVVGYRDKTFPLGNKLRLFAASEDVLQKLDMQRWLNRLSDYCHLSSVKPVPVSVKQYARFNRKNVKSIEKKAQRRAIHLAKPYEEVLAYLIEEDKSKACKLPFINVESQDTKKREGQGVSCQFLLFIEQTIFDAPVSGKFDCYGLSKTATVPWF

SEQ ID NO: 11263 - protein, 199 aa, Paraglaciecola polaris LMG 21857
MKYYLDITLLPSDDIGVHFLWSKVMIQVHLALVEIQDENKKVPVAVSFPQYKTKETHAQAFIGHKLRLFSAEQADLERLDIHKWLSRLTDYVHIKQIADVPDVVLGYENFNRRQKSGSPDKHIRRRMKRHNETVEQANLYFKDYAMKDEDKALPFIRMKSLESNKDFNMSILRKEVKQGAKQVMFNTYGFNGSALLPKF

SEQ ID NO: 11264 - protein, 185 aa, Coxiella burnetii RSA 493; identical to SEQ ID NO: 11137

SEQ ID NO: 11265 - protein, 187 aa, Pseudomonas aeruginosa UCBPP-PA14
MDHYLDIRLRPDPEFPPAQLMSVLFGKLHQALVAQGGDRIGVSFPDLDESRSRLGERLRIHASADDLRALLARPWLEGLRDHLQFGEPAVVPHPTPYRQVSRVQAKSNPERLRRRLMRRHDLSEEEARKRIPDTVARALDLPFVTLRSQSTGQHFRLFIRHGPLQVTAEEGGFTCYGLSKGGFVPWF

SEQ ID NO: 11266 - protein, 184 aa, Escherichia coli UTI89; identical to SEQ ID NO: 11092

SEQ ID NO: 11267 - protein, 212 aa, Vibrio mimicus
MSQRYYFLIRYTNANADYGLLAGRCISQMHLFMVNHHQAMNRVGVSFPDWNESSVGQTIAFVSEDKEMMIGLSFQPYFSLMVNEGLFEISSVYEVPDTSEEVRFVRNQTIGKNFLGSKKRRIKRSMARAELFGIQQSLPVTNEDRVIDSFHQIPISSGSSRQDYILFIQKELADERAESGFNSYGFATNQEKRATVPDLRFNPFDEDSFLVQ

SEQ ID NO: 11268 - protein, 212 aa, Vibrio
MSQRYYFLIRYTNANADYGLLAGRCISQMHLFMVNHHQAMNRVGVSFPDWNESSVGQTIAFVSEDKEMMMGLSFQPYFSLMVNEGLFEISSVYEVPDTSEEVRFVRNQTIGKNFLGSKKRRIKRSMARAELFGIQQSLPVTNEDRVIDSFHQIPISSSSSRQDYILFIQKEFADERAESGFNSYGFATNQEKRATVPDLRFNPFDEDSFLVH

SEQ ID NO: 11269 - protein, 202 aa, Acinetobacter; identical to SEQ ID NO: 11159

SEQ ID NO: 11270 - protein, 183 aa, Vibrio
MDAYIDIRLMPDAEMREAELSSKVFIKFHKALVKLQSNKIGISFPEANIKLGRLFRLHGEVSALHDLQGLNWLGPLAGYCKITTVTHVPDQVEYRIISVKRSNLSKAKLARLIARGSIDKDGEKRYKVKMLRQGFDNPYLDLSSSSTGQVYRKFFEFSDIQAEPVDGEFDSYGLSKTATVPWF

SEQ ID NO: 11271 - protein, 183 aa, Vibrio
MDAYIDIRLMPDAEMREAELSSKVFIKFHKALVKLRSNKIGISFPEANIKLGRLFRLHGEMSALHDLQGLNWLGPLAGYCKITTVTHVPDQVQYRIISVKRSNLSKAKLTRLIARGSIDKDGEKRYKVKMLSQGFDNPYLDLSSSSTGQVYRKFFEFSDIQADPVDGEFDSYGLSKTATVPWF

SEQ ID NO: 11272 - protein, 184 aa, Escherichia
MDHYLEIRVLPDPEFSSEMLMAALFAKLHRALGARGQGDIGVSFPDVNVTPGARLRLHGSAPALQALEASTWRKGLTDYCQCSPVTPIPEIKGWRVVSRVQVKSNPLRLLRRSVKKGWLTKEQAIERLATQTERRTDLPFLNMKSLSSQQQFKLFIRHGDLLTEPVKGEFSSYGLSATATIPWF

SEQ ID NO: 11273 - protein, 184 aa, Enterobacteriaceae; identical to SEQ ID NO: 11147

SEQ ID NO: 11274 - protein, 184 aa, Escherichia coli; identical to SEQ ID NO: 11092

SEQ ID NO: 11275 - protein, 184 aa, Escherichia coli
MDHYLEIRVLPDPEFSSEMLMAALFAKLHRVLGARGQGDIGVSFPDVNVMPGARLRLHGSAQALQALEASTWRKGLTDYCQCSPVTPVPEIKGWRVVSRVQVKSNSQRLLRRSVKKGWLTEEQAIERLATQAEQRTDLPFLNMKSLSSQQLFKLFIRHGDLLKEPVKGEFSSYGLSATATIPWF

SEQ ID NO: 11276 - protein, 184 aa, Escherichia coli; identical to SEQ ID NO: 11181

SEQ ID NO: 11277 - protein, 183 aa, Vibrio cholerae
MDSYIDIHLRPDAEMNEAELGSKVYTKFHKALVKLNTNQIAISFPDANLKLGQLFRVHGPVSLLNDLQGLCWLGPLSGYCQISEVLSVPEQVQYRVISAKRRNLSAAKLRRLIARGSINKEGEQRYKKKMLNQSIKGPYLDLLSSSTGQKYRKFFEFGEIQDVPVLGNFDTYGLSLKATVPWF

SEQ ID NO: 11278 - protein, 203 aa, Acinetobacter; identical to SEQ ID NO: 11081

SEQ ID NO: 11279 - protein, 203 aa, Acinetobacter
MNWYQEITLIDQDEISPYFIWSKVYTQLHIAFAEHSNEQGRIPFGVSFPQYRINEQKKIGFLGTKIRVFASSENDLQQLNLGKWLERFIDYVHITQPREVPRAKITGYAHYYRVNPRMSVEERIVHQAQRRNISLDQARQHFKQYVEQPVVEPYVSLKSLSAKREENVDRPYRLYIGKSLVDEARDGMFGTYGLSRMTTVPEF

SEQ ID NO: 11280 - protein, 212 aa, Vibrio cholerae; identical to SEQ ID NO: 11196

SEQ ID NO: 11281 - protein, 184 aa, Vibrio cholerae
MMDAYIDIRLMPDAEMREAELSSKVFIKFHKALVKLQSNKIGISFPEANIKLGRLFRLHGEVSALHDLQGLNWLGPLAGYCKITTVTHVPDQVEYRIISVKRSNLSKAKLARLIARGSIDKDGEKRYKVKMLRQGFDNPYLDLSSSSTGQVYRKFFEFSDIQAEPVDGEFDSYGLSKTATVPWF

SEQ ID NO: 11282 - protein, 215 aa, Vibrio cholerae; identical to SEQ ID NO: 11219

SEQ ID NO: 11283 - protein, 204 aa, Acinetobacter baumannii; identical to SEQ ID NO: 11193

SEQ ID NO: 11284 - protein, 184 aa, Yersinia pseudotuberculosis complex; identical to SEQ ID NO: 11060

SEQ ID NO: 11285 - protein, 188 aa, Xanthomonas fragariae; identical to SEQ ID NO: 11229

SEQ ID NO: 11286 - protein, 201 aa, Nitrosococcus oceani; identical to SEQ ID NO: 11059

SEQ ID NO: 11287 - protein, 187 aa, Thauera sp. 28; identical to SEQ ID NO: 11228

SEQ ID NO: 11288 - protein, 187 aa, Pseudomonas aeruginosa
MDHYLDIRLRPDPEFPPAQLMSVLFGKLHQALVAQGGDRIGVSFPDLDESRSRLGERLRIHASADDLRALLARPWLEGLRDHLQFGEPAVVPHPTPYRQVSRVQAKSNPERLRRRLMRRHDLSEEEARKRIPDTVARTLDLPFVTLRSQSTGQHFRLFIRHGPLQATAEEGGFTFYGLSKGGSVPWF

SEQ ID NO: 11289 - protein, 167 aa, Pseudomonas aeruginosa
MSVLFGKLHQALVAQGGDRIGVSFPDLDESRSRLGERLRIHASADDLRALLARPWLEGLRDHLQFGEPAVVPHPTPYRQVSRVQAKSNPERLRRRLMRRHDLSEEEARKRIPDTVARALDLPFVTLRSQSTGQHFRLFIRHGPLQVTAEEGGFTCYGLSKGGFVPWF

SEQ ID NO: 11290 - protein, 167 aa, Pseudomonas aeruginosa
MSVLFGKLHQALVAQGGDRIGVSFPDLDESRSRLGERLRIHASADDLRALLARPWLEGLRDHLQFGEPAVVPHPTPYRQVSRVQAKSNPERLRRRLMRRHDLSEEEARKRIPDTVARTLDLPFVTLRSQSTGQHFRLFIRHGPLQATAEEGGFTCYGLSKGGSVPWF

SEQ ID NO: 11291 - protein, 187 aa, Pseudomonas; identical to SEQ ID NO: 11256

SEQ ID NO: 11292 - protein, 187 aa, Pseudomonas oleovorans
MNHYLDLKLLPDPEFPATQLMSALLAKLHRGLHDLRRSDVGISFPDVETAGHGLGARLRLHGSAEALDKLLALNWLSGMRDHLNLGELAPIPAKVRWRCVSRVQVDSNPERARRRLIKRHGISEAEARQRIPDSAGKRCDLPYATLRSNGSGHSFRLFIRHGPLLDNPTPGTFGAYGLSTQASVPWF

SEQ ID NO: 11293 - protein, 196 aa, Moraxella catarrhalis; identical to SEQ ID NO: 11184

SEQ ID NO: 11294 - protein, 196 aa, Moraxella catarrhalis; identical to SEQ ID NO: 11182

SEQ ID NO: 11295 - protein, 196 aa, Moraxella; identical to SEQ ID NO: 11185

SEQ ID NO: 11296 - protein, 196 aa, Moraxella catarrhalis; identical to SEQ ID NO: 11183

SEQ ID NO: 11297 - protein, 196 aa, Moraxella catarrhalis; identical to SEQ ID NO: 11187

SEQ ID NO: 11298 - protein, 196 aa, Moraxella catarrhalis; identical to SEQ ID NO: 11188

SEQ ID NO: 11299 - protein, 196 aa, Moraxella catarrhalis; identical to SEQ ID NO: 11189

SEQ ID NO: 11300 - protein, 184 aa, Hafnia alvei; identical to SEQ ID NO: 11205

SEQ ID NO: 11301 - protein, 185 aa, Morganella morganii; identical to SEQ ID NO: 11136

SEQ ID NO: 11302 - protein, 204 aa, Acinetobacter lwoffii; identical to SEQ ID NO: 11162

SEQ ID NO: 11303 - protein, 187 aa, Pseudomonas aeruginosa
MDHYLDIRLRPDPEFPPAQLMSVLFGKLHQALVAQGGDRIGVSFPDLDESRSRLGERLRIHASADDLRALLARPWLEGLRDHLQFGEPAVVPHPTPYRQVSRVQAKSNPERLRRRLMRRHDLSEEEARKRIPDTVARTLDLPFVTLRSQSTGQHFRLFIRHGPLQATAEEGGFTCYGLSKGGFVPWF

SEQ ID NO: 11304 - protein, 187 aa, Pseudomonas; identical to SEQ ID NO: 11239

SEQ ID NO: 11305 - protein, 176 aa, Yersinia kristensenii; identical to SEQ ID NO: 11153

SEQ ID NO: 11306 - protein, 183 aa, Vibrio metschnikovii
MDSYIEIRLQPDAEMPEAELSSKVFTKFHKALVILHSNQIGISFPEVNVKLGRLFRLHGEASFLHDLQGLNWLGPLSGYCQVSEILAIPEQVQYRVISVKRSNLSQAKLRRLIARGSIDKEGEKRYKVKMLSQGFDNPYLDLFSSSTKQVHRKFFEFGEIQPLPVSGKFDSYGLSHTTTVPWF

SEQ ID NO: 11307 - protein, 197 aa, Acinetobacter
MLYYLEITLLEQEEIPLHLIWSKVYTQLHIAFAEQADEQGKIVYGISFPKYRLIQQKKLGYLGDKIRIFADSVETLEQLNLNHWLERLQDYVHVLSAREVPEDKINGYATYFKANPKLTIEQRILHQAKRRGISIEEAKEHFEALELTETFEPYINMKSQTNDMNFRLIIGKKRVDEACIGKFGSYGLSRTSTVPEF

SEQ ID NO: 11308 - protein, 185 aa, Yersinia; identical to SEQ ID NO: 11154

SEQ ID NO: 11309 - protein, 185 aa, Morganella morganii; identical to SEQ ID NO: 11119

SEQ ID NO: 11310 - protein, 211 aa, Providencia stuartii; identical to SEQ ID NO: 11109

SEQ ID NO: 11311 - protein, 203 aa, Acinetobacter baylyi
MDANYYLDIRVLESSDDTDLKLGHIRNQIYTVIHGAFRKLPAHYALALEMSDKLKAKQEQFEKKHGRSAKPNFDILRIFAEKQDELDELVEAIKGHWKIRDYTVLGVAIAVPTAKISGWKSYRKFRIPTQKAERTKLSHQNEPLRDRRLKTAKGMPFFQVISQSTGQGFTVIIDVQESENAGYGLPDSYGLARKESPFALPVF

SEQ ID NO: 11312 - protein, 203 aa, Acinetobacter radioresistens; identical to SEQ ID NO: 11259

SEQ ID NO: 11313 - protein, 47 aa, Yersinia intermedia; identical to SEQ ID NO: 11155

SEQ ID NO: 11314 - protein, 201 aa, Vibrio alginolyticus
MTKRYYFCIRYTPVQADYELLAGRCISQMHLFMVNNRQAMNKIGVSFPDWSDVTVGQTIAFVADDKEMMIGLSFQPYYSLMVNEGLFEVSSVCEVPDNALEVRFTRNQTIGKSFLGAKKRRIKRSMARAELLDAGTSLPVTNEERVVDSFHRIPISSGSSGEDYILFVQKEFVCERGAANFNSYGLATNQERKGTVPELHF

SEQ ID NO: 11315 - protein, 200 aa, Vibrio sp. 16; identical to SEQ ID NO: 11149

SEQ ID NO: 11316 - protein, 198 aa, Vibrio parahaemolyticus; identical to SEQ ID NO: 11176

SEQ ID NO: 11317 - protein, 192 aa, Shewanella benthica
MKYYLDITLLPDAEANLGFLWQKVYQQIHLALAEHKTADNTSAVAVSFPEWSQGNYPLGSKLRLFAVREQALQALDIPQWLQRFTDYTHCTSIKAVPSSVTQYAVFKRVQFDTNIERMARRRAKRKDETLEQALAYFKGFTEQASKLPFINMKSLSKEQNFRLFVQRDSVPAPVIGLFNTYGLSKAATVPCF

SEQ ID NO: 11318 - protein, 198 aa, Vibrio parahaemolyticus
MDWYYRTITFLPEYRNNEAIAAKCIKELHRFNYKYETRSIGVSFPLWGQETVGRKITFVSTNKMELDFLISRRYFVQMTKLGYFSISTTQTVPDECSYVLFKRAHSIDKETSAGRARELKRLERRALERGEIFDPIAYSKTTSHAFQSYHSLEEDSSGGNKFRLNIQMKERSGTVGTGTFSSYGLGNTDNSLQVVPLI

SEQ ID NO: 11319 - protein, 215 aa, Vibrio mimicus; identical to SEQ ID NO: 11157

SEQ ID NO: 11320 - protein, 187 aa, Aggregatibacter actinomycetemcomitans; identical to SEQ ID NO: 11111

SEQ ID NO: 11321 - protein, 187 aa, Aggregatibacter actinomycetemcomitans; identical to SEQ ID NO: 11199

SEQ ID NO: 11322 - protein, 187 aa, Aggregatibacter actinomycetemcomitans; identical to SEQ ID NO: 11200

SEQ ID NO: 11323 - protein, 189 aa, Actinobacillus pleuropneumoniae; identical to SEQ ID NO: 11167

SEQ ID NO: 11324 - protein, 189 aa, Actinobacillus; identical to SEQ ID NO: 11168

SEQ ID NO: 11325 - protein, 189 aa, Actinobacillus pleuropneumoniae; identical to SEQ ID NO: 11170

SEQ ID NO: 11326 - protein, 189 aa, Actinobacillus pleuropneumoniae; identical to SEQ ID NO: 11172

SEQ ID NO: 11327 - protein, 189 aa, Actinobacillus pleuropneumoniae; identical to SEQ ID NO: 11174

SEQ ID NO: 11328 - protein, 189 aa, Actinobacillus pleuropneumoniae; identical to SEQ ID NO: 11175

SEQ ID NO: 11329 - protein, 186 aa, Pasteurella multocida
MTSHYIELKAIPQMDMLQSEVIGHCMQILHQFLPHFEGRVGVAFPAYGLGRTLGGIVRLFANQTDCNQLQQQLLRSSLSDYALISEVSKTPSPTEHRSYSRVHRKGQSAIRRTEKRLKSQGRWDESIRADMQQRQQNVAFFPHCHLKSASTGQRFILAVKEKRMPQSCVGIFNAYGLSNSATVPHF

SEQ ID NO: 11330 - protein, 186 aa, Pasteurella multocida
MTTHYIELKAIPQMDMLQSEVIGHCMQILHQFLPHFEGRVGVAFPAYGLGRTLGGIVRLFANQEDCNQLHQQLLRSGLSDYALISEVSKTPLPTEYRSYSRVHRKGQSAIRRTEKRLKSQGRWDESIRADMQQRQQNVAFFPHCHLKSASTGQRFILAVKENRMSQSCVGVFNAYGLSNSATVPHF

SEQ ID NO: 11331 - protein, 186 aa, Pasteurella multocida
MTTHYIELKAIPQMDMLQSEVIGHCMQILHQFLPHFEGRVGVAFPAYGLGRTLGGIVRLFANQEDCNQLHQQLLRSGLSDYALISEVSKTPWPTEHRSYSRVHRKGQSAIRRTEKRLKSQGRWDESIRADMQQRQQNVAFFPHCHLKSASTGQRFILAVKENRMPQSCVGVFNAYGLSNSATVPHF

SEQ ID NO: 11332 - protein, 186 aa, Pasteurella dagmatis; identical to SEQ ID NO: 11160

SEQ ID NO: 11333 - protein, 185 aa, Coxiella burnetii; identical to SEQ ID NO: 11137

SEQ ID NO: 11334 - protein, 199 aa, Mitsuokella multacida; identical to SEQ ID NO: 11161

SEQ ID NO: 11335 - protein, 184 aa, Pectobacterium wasabiae; identical to SEQ ID NO: 11212

SEQ ID NO: 11336 - protein, 185 aa, Shewanella baltica; identical to SEQ ID NO: 11202

SEQ ID NO: 11337 - protein, 185 aa, Enterobacter cancerogenus; identical to SEQ ID NO: 11164

SEQ ID NO: 11338 - protein, 190 aa, Anaeroglobus geminatus; identical to SEQ ID NO: 11204

SEQ ID NO: 11339 - protein, 190 aa, Dialister invisus; identical to SEQ ID NO: 11158

SEQ ID NO: 11340 - protein, 199 aa, Paraglaciecola polaris; identical to SEQ ID NO: 11263

SEQ ID NO: 11341 - protein, 207 aa, Proteobacteria; identical to SEQ ID NO: 11156

SEQ ID NO: 11342 - protein, 184 aa, delta proteobacterium MLMS-1
MDHYIEIRLLPDPEFPDTVLMNALFAKFHRALVEVGQGEIGVSFPKAQKKMGDVLRIHGNQQALQRLMSLGWLKGLRDYAEVSALLPTPRQCRYKTVKRVQPKSSVGRLYRRSVRKGWVTTEEASQKVSTSRPEKVDLPFVQLKSHSTGENFRLFIQQGEPGDSPEKGQFSSYGLSSVATVPWF

SEQ ID NO: 11343 - protein, 200 aa, Paraglaciecola arctica; identical to SEQ ID NO: 11262

SEQ ID NO: 11344 - protein, 196 aa, Cellvibrio sp. BR; identical to SEQ ID NO: 11210

SEQ ID NO: 11345 - protein, 199 aa, Paraglaciecola chathamensis; identical to SEQ ID NO: 11260

SEQ ID NO: 11346 - protein, 200 aa, Pseudoalteromonas; identical to SEQ ID NO: 11257

SEQ ID NO: 11347 - protein, 200 aa, Pseudoalteromonas sp. BSi20495; identical to SEQ ID NO: 11258

SEQ ID NO: 11348 - protein, 212 aa, Pseudoalteromonas
MKYYLEITLLPDAEANLGFLWQKIYQQIHIALVDNKIGENESAVAVAFSRYGEKLFPLGDQLRLFAKTEIQLNELNIPTWLSRFKDYVHIKSIKPVPEKITHVCFIREHVKGEAGIEKKMQAKAKYWSEKSGQPLEECLLSLEKSKPKARSTRPFIWLESQKTKQRDPAQNIKFPLFIKRIELENPQKGHVNCYGLNANHKDISNWVSVPHF

SEQ ID NO: 11349 - protein, 217 aa, Pseudoalteromonas sp. BSi20652
MKHYLDITLLPEADITLGFIWQKVYQQVHIALVDSKVGKNESSIAVSFPRYNTKASGEQAFPLGNQLRLIANDETQLTKLNIAKWLNRLEDYVHIKSIKPVPESVTYAAFVRMQVKGEARIEKDMLNKAQRWAEKSGQPLNDCLAELEKSKPKANNKLPFIWLESQETRRRDLNASRKFPLFIKKVEVTVQQVGTFNCYGLSTNHNMKEKLVSIPQF

SEQ ID NO: 11350 - protein, 188 aa, Rhodanobacter sp. 115; identical to SEQ ID NO: 11211

SEQ ID NO: 11351 - protein, 188 aa, Zhongshania aliphaticivorans; identical to SEQ ID NO: 11209

SEQ ID NO: 11352 - protein, 189 aa, Alishewanella aestuarii
MDSYIEITVLPDLEADANFLMNNLCSKLHAVLGQVTMGKVGVSFPGYAQTGRHLGSQLRIHGTASMLEKLMAENWLKGLRDYCQCSAIQPVPANAKQRYFARRQVKSAHNKRQRSVSKGWLTQEEALDKISDESQKLLKLPFLQLISRGNKQQMKVFIEQGPVVEHAIVGSFNSYGLSRLSEKITVPWF

SEQ ID NO: 11353 - protein, 198 aa, Aliiglaciecola lipolytica; identical to SEQ ID NO: 11261

SEQ ID NO: 11354 - protein, 197 aa, Desulfonatronospira thiodismutans; identical to SEQ ID NO: 11166

SEQ ID NO: 11355 - protein, 189 aa, Rheinheimera sp. A13L; identical to SEQ ID NO: 11195

SEQ ID NO: 11356 - protein, 213 aa, Providencia burhodogranariea; identical to SEQ ID NO: 11222

SEQ ID NO: 11357 - protein, 143 aa, Halomonas sp. GFAJ-1; identical to SEQ ID NO: 11203

SEQ ID NO: 11358 - protein, 189 aa, Neisseria sp. oral taxon 014; identical to SEQ ID NO: 11165

SEQ ID NO: 11359 - protein, 202 aa, Halomonas; identical to SEQ ID NO: 11226

SEQ ID NO: 11360 - protein, 189 aa, Halomonas; identical to SEQ ID NO: 11225

SEQ ID NO: 11361 - protein, 169 aa, Vibrio metoecus
MNEAELGSKVYTKFHKALVKLNTNQIAISFPGANLKLGQLFRVHGPVSLLNDLQGLCWLGPLSGYCQISEVLSVPEQVQYRVISAKRRNLSAAKLRRLIARGSINKEGEQRYKKKMLNQSIKGPYLDLLSSSTGQKYRKFFEFGEIQDVPVLGNFDTYGLSLKATVPWF

SEQ ID NO: 11362 - protein, 212 aa, Marinomonas sp. MED121
MNYYQEITLLPDAEISLGFIWQNVFQQVHIALVENKVAANQSKIAVGFPEYKKVKFPLGNKLRLFAEDAEQLEQLNITNWLVRLEDYAHVKGVKPVPADVSYVTYTRKSVKSPARIDKEMQKKAELWSLKSGKPLAECFEELEKTKPQYESKLPFIYLHSQETKQRSPEKSSKFPLFIEMKLLDKKQSGFFDCYGLSSKSNTAENLGAVPLF

SEQ ID NO: 11363 - protein, 183 aa, Pseudoalteromonas tunicata
MDSYIEIQLKPDAEMREAELSSKVFTKFHKALVGLKTNQIGISFPQVNLKLGRVFRIHGDASLLNDLQGLNWLGPLNGYCKLSDILTVPENTQHRIVSEKRSNLSKAKLRRLIVRGSIDKEGEKRYKVKMLSQGFNNPYLDLFSSSTEQIHRKFFEFSELKSEPVNGTFDSYGLSKVATIPWF

SEQ ID NO: 11364 - protein, 189 aa, Actinobacillus pleuropneumoniae
MSELTHYIELKAIPQVDILQTDVIAHGLQILHKFLPLYQGQIGLSFPAYGLGRTLGGIIRVFGNEQHCTQIKTQLIGEGLQDYVLITSVTPVPEEIVEYHRYQRVHRKGQSAIRRTEKFLTQQGKWTEDVRKEMLIHQQNQKTFPHVKLKSSSTKQHFVLAIRQFRLAEPASGLFNAYGLSQVATVPHF

SEQ ID NO: 11365 - protein, 187 aa, Pseudomonas aeruginosa
MDHYLDIRLRPDPEFPPAQLMSVLFGKLHQALVAQGGDRIGVSFPDLDESRSRLGERLRIHASADDLRALLARPWLEGLRDHLQFGEPAVVPHPTPYRQVSRVQVKSNPERLRRRLMRRHDLSEEEARKRIPDTVARALDLPFVTLRSQSTGQHFRLFIRHGPLQVTAEEGGFTCYGLSKGGFVPWF

SEQ ID NO: 11366 - protein, 188 aa, Verminephrobacter aporrectodeae
MTTHYIDIALRPDPEFSPAHLLNALYAKLHRALVQLGTGDVGVSFPGLNPQGTHLGSTLRLHGTEPALQRLQALPWLQGMRDHVQASEAVSVPAHTQHRTVRRVQAKSNPELLRRRQMRRHGIDSAEALLRIPDQEGQRLALPYLSLHSASSGQAFHLFIDHGALMNTPSPGSFSTYGLSTQSTIPWF

SEQ ID NO: 11367 - protein, 184 aa, Pectobacterium brasiliense
MDHYIDIRVQPDPEFTASQLLNALFAKLHRALGQVADGKIGISFPQVGKTLGECLRLHGTREALSTLEQTAWLKGLRDYTQVSECKIVPDGVKFRTVRRVQLKSSAERLRRRSVNKGWLTEAEAAARIPDAVEKRSALPFVQIKSLSNGQMFFVFIEHGPLQDAPVAGRFSSYGLSAEATVPWF

SEQ ID NO: 11368 - protein, 184 aa, Pectobacterium carotovorum
MDHYIDIRVQPDPEFTASQLLNALFAKLHRALGQVADGKIGISFPQVGKTLGECLRLHGTKEALSTLEQTAWLKGLRDYTLVSACTAVPDGVKFRTVRRVQPKSSAERLRRRSVSKGWLTEAEAAARIPDAVEKRSALPFVQIKSLSNGQMFFVFVEHGPLQDTPVAGRFSSYGLSAEATVPWF

SEQ ID NO: 11369 - protein, 212 aa, Vibrio ordalii
MNYYQEITLLPDVDISLGFIWQNVFQQVHIAFVEHKIDENQSAIAIGFPEYGKVGFPLGNKLRLFAKEQAILEKLAIGKWLARLEDYAHVKAIKPVPTEVTYASFMRKHVKSPERIERNMQQKATLWAAKSGKPLEECLLELEKTKPTTLCSLPFIYLHSQQTKQRSPEKNSKFTLFIEMQRQSASQVGQFDCYGLSAKANRQSALATVPHF

SEQ ID NO: 11370 - protein, 226 aa, Pseudoalteromonas citrea; identical to SEQ ID NO: 11241

SEQ ID NO: 11371 - protein, 203 aa, Pseudoalteromonas; identical to SEQ ID NO: 11240

SEQ ID NO: 11372 - protein, 197 aa, Pseudoalteromonas spongiae; identical to SEQ ID NO: 11242

SEQ ID NO: 11373 - protein, 208 aa, Acinetobacter ursingii
MLKTYDFKGMIMTYYIELTLIDNPDFSSFELWSKVYTQLHIAFAEQADEQGKIAYGVSFPKYRLIQQKKLGYLGDKIRIFADSVEALEQLNLTHWLARLQDYVHILSARKVPEDKINGYATYFKVNPKLTVEQRVVHQAERRGISIEEAQEHFKALDLMETFEPYINMKSQTNDMNFRLIIGKKRVDEANIGKFGSYGLSRTSTVPEF

SEQ ID NO: 11374 - protein, 197 aa, Pseudoalteromonas flavipulchra
MSRAYFTITYLPTNCDVTLLAGRCIGILHGFMNKRSCNHIGVSFPKWTDKHLGNQIAFVSEDKAALKNLSKQNYFEMMAHDKLFEMSDIKPVPVDALEVQIIRDHSLDKLSMGEKRRRMARAKRRAEARGEEYIPQYVPDDKEISAFHKIPIASKSNQNDFVLHLRLEPTNSIQSTYNSYGFATNEEHKGSVPLLAF

SEQ ID NO: 11375 - protein, 186 aa, Pasteurella multocida
MTTHYIELKAIPQMDMLQSEVIGHCMQILHQFLPHFEGRVGVAFPAYGLGRTLGGIVRLFANQEDCNQLHQQLLRSGLSDYALISEVSKTPLPTEHRSYSRVHRKGQSAIRRTEKRLKSQGRWDESIRADMQQRQQNVAFFPHCHLKSASTGQRFILAVKENRMPQSCVGVFNAYGLSNSATVPHF

SEQ ID NO: 11376 - protein, 184 aa, Pectobacterium atrosepticum
MDHYIDIRVQPDPEFTASQLLNALFAKLHRVLGQLANGKIGISFPEVGKTLGECLRLHGTEDALSTLEKTSWLKGLRDYTQVSECKVVPNGVKFRTVRRVQLKSSAERLRRRSVSKGWLTAAEAAARIPDAVEKRSALPFVQIKSLSNGQMFFVFVEHGPLQNAPTAGRFSSYGLSTEATVPWF

SEQ ID NO: 11377 - protein, 184 aa, Photorhabdus
MDYYLEIRVLPDLEFSQQSLFEALFAKLHRALGQLSNGQVGVSFPCARKTLGDTLRIHGSSEALNDLQALPWLKGLRDYTEVIDIQPIPQETKYRCVSRVQVKSSAERLRRRAIKKGWLTGEQARQRIPISKEQRTHLPFLFLKSLSSGQSFLLFVKQGPIQDKPTSGIFSSYGLSSSATIPWF

SEQ ID NO: 11378 - protein, 184 aa, Legionella pneumophila
MDHYLDISILPDSEFTTPVLMNAIYTNLHKALHTLASTNIGVSFPKYSSTLGNLLRIHGKKEALQELQNLNWIGGMIGYCEASLIKTVPADTKFRTVSRKQPTMSQSKLRRLIKRNSLTEDEIRQYKAKMFSKGLDNPYIELVSVSNGQRHRRYIEFGELFNEPIPGLFDQFGLSNSATVPWFD

SEQ ID NO: 11379 - protein, 184 aa, Legionella pneumophila
MDHYLEISILPDSEFTTPVLMNAIYTNLHKALHTLASTSIGVSFPKYSSTLGNILRIHGKKEVLQDLQNLNWIGGMIGYCEASLIKTVPADTKFRTVSRKQPTMSQSKLRRLIKRNTLTEDEIRQYKAKMFSKGLDNPYIELVSVSNGQRHRRYIEFGELFNEPSPGLFDQFGLSNSATVPWFD

SEQ ID NO: 11380 - protein, 184 aa, Photobacterium profundum
MMDSYVDIQLKPDAEMREAELSSKVFTKFHKALATLNTNKIGISFPQMNLKLGRLFRIHGNASLLKDLQGIKWLGALAGYCQVGEITVVPDQVQYRVISVKRSNLSKAKLKRLIARGSIDKDGEKRYKVKMLSQGFDNPYLDLFSSSTGQVYRKFFEFGDIQATSVSDEFDSYGLSNTATIPWF

SEQ ID NO: 11381 - protein, 193 aa, Zymomonas mobilis; identical to SEQ ID NO: 11058

SEQ ID NO: 11382 - protein, 198 aa, Escherichia coli
MAVSLVRNRNKELPMDHYLEIRVLPDPEFSSEMLMAALFAKLHRVLGARGQGDIGVSFPDVNVMPGARLRLHGSAQALQALEASTWRKGLTDYCQCSPVTPVPEIKGWRVVSRVQVKSNPQRLLRRSVKKGWLTEEQAIERLATQAEQRTDLPFLNMKSLSSQQLFKLFIRHGDLLKEPVKGEFSSYGLSATATIPWF

SEQ ID NO: 11383 - protein, 203 aa, Shewanella sp. ANA-3; identical to SEQ ID NO: 11062

SEQ ID NO: 11384 - protein, 193 aa, Psychromonas ingrahamii; identical to SEQ ID NO: 11063

SEQ ID NO: 11385 - protein, 224 aa, Shewanella; identical to SEQ ID NO: 11064

SEQ ID NO: 11386 - protein, 191 aa, Comamonadaceae; identical to SEQ ID NO: 11065

SEQ ID NO: 11387 - protein, 190 aa, Verminephrobacter eiseniae; identical to SEQ ID NO: 11066

SEQ ID NO: 11388 - protein, 183 aa, Shewanella putrefaciens; identical to SEQ ID NO: 11069

SEQ ID NO: 11389 - protein, 185 aa, Coxiella burnetii
MNYYFDINLLSDAEIPSTVLINAVCKKLHKLLCDLDSTRIGISFPKYKITLGNVLRLHGTEFDLQKLHEVSWLGGMNGYCKISEVATVPVNTKHRTVYRKQPTMSQSKLKRLLKRGTITNDEVKSYKAKMVAEKGLNNPYLDLVSGTNCQRHRRYIVLGELLDEPVEGGFDQFGLSKTVTVPWFD

SEQ ID NO: 11390 - protein, 184 aa, Enterobacter sp. 638; identical to SEQ ID NO: 11068

SEQ ID NO: 11391 - protein, 199 aa, Marinomonas sp. MWYL1; identical to SEQ ID NO: 11071

SEQ ID NO: 11392 - protein, 194 aa, Shewanella baltica; identical to SEQ ID NO: 11072

SEQ ID NO: 11393 - protein, 194 aa, Shewanella baltica; identical to SEQ ID NO: 11075

SEQ ID NO: 11394 - protein, 190 aa, Delftia acidovorans; identical to SEQ ID NO: 11074

SEQ ID NO: 11395 - protein, 185 aa, Coxiella burnetii; identical to SEQ ID NO: 11076

SEQ ID NO: 11396 - protein, 189 aa, Actinobacillus pleuropneumoniae
MSELTHYIELKAIPQVDILQTDVIAHGLQILHKFLPLYQGEIGLSFPAYGLGRTLGGIIRVFGNEQHCTQIKTQLIGEGLQDYVLITSVTPVPEEIVEYHRYQRVHRKGQSAIRRTEQFLVQQGKWTEEIRQEMLIHQQNQKVFPYVKLKSGSTKQHFVLAIRQLRLAEPASGLFNAYGLSQAATVPHF

SEQ ID NO: 11397 - protein, 184 aa, Erwinia tasmaniensis
MDRYQDIRVRVDAEMTAPVLLAQVFMRLHQVLMRAANGRIGISFPDVKLTLGDRIRLHGTLDDLSSLQQSGWDKGLTDYIACSAIDPVPPGAAWRTVRRVQVKSSAERLRRRSVNKGWLNEAEAAERINVLSEQRSDLPYLQIKSGSNGHAWRLFIEHGPLVSVPVNGGFSSYGLSATATVPWF

SEQ ID NO: 11398 - protein, 213 aa, Aliivibrio fischeri; identical to SEQ ID NO: 11080

SEQ ID NO: 11399 - protein, 185 aa, Coxiella burnetii
MNYYFDINLLSDAEIPSTVLMNAVCKKLHKLLCDLDSTRIGISFPKYKITLGNVLRLHGTEFDLQKLHEVSWLGGMNGYCKISEVATVPVNTKHRTVYRKQPTMSQSKLKRLLKRGTITNDKVKSYKAKMVAEKGLNNPYLDLVSGTNCQRHRRYIVLGELLDEPVEGGFDQFSLSKTVTVPWFD

SEQ ID NO: 11400 - protein, 198 aa, Escherichia coli
MAVSLVRNRNKELPMDHYLEIRVLPDPEFSSEMLMAALFAKLHRVLGARGQGDIGVSFPDVNVMPGTHLRLHGSAQALQELEASTWRKGLTDYCQCSPVTPVPEIKGWRVVSRVQVKSNPQRLLRRSVKKGWLTEEQAIERLATQAEQRTDLPFLNMKSLSSQQQFKLFIRHGDLLKEPVKGEFSSYGLSATATIPWF

SEQ ID NO: 11401 - protein, 184 aa, Erwinia pyrifoliae; identical to SEQ ID NO: 11129

SEQ ID NO: 11402 - protein, 137 aa, Laribacter hongkongensis; identical to SEQ ID NO: 11083

SEQ ID NO: 11403 - protein, 184 aa, Tolumonas auensis; identical to SEQ ID NO: 11084

SEQ ID NO: 11404 - protein, 184 aa, Dickeya paradisiaca; identical to SEQ ID NO: 11085

SEQ ID NO: 11405 - protein, 184 aa, Dickeya chrysanthemi; identical to SEQ ID NO: 11086

SEQ ID NO: 11406 - protein, 193 aa, Zymomonas mobilis; identical to SEQ ID NO: 11087

SEQ ID NO: 11407 - protein, 184 aa, Dickeya zeae; identical to SEQ ID NO: 11089

SEQ ID NO: 11408 - protein, 188 aa, Xanthomonas albilineans; identical to SEQ ID NO: 11131

SEQ ID NO: 11409 - protein, 186 aa, Thioalkalivibrio sp. K90mix; identical to SEQ ID NO: 11090

SEQ ID NO: 11410 - protein, 199 aa, Nitrosococcus halophilus; identical to SEQ ID NO: 11091

SEQ ID NO: 11411 - protein, 184 aa, Legionella
MDYYVDILIKPDSEKSLNFLLSTLYTKLHKVLHDMASTNIGVSFPKYNITLGNILRIHSKKVVLDELLGMNFLSGINNYYEVSPIKSVPADSKFRIISRKQTTMSQSKMRRLFKRGSMTVGDIRQYKAKMFAKSIDNPYLELVSGSNGYRYRRYIEFGELLDQPVYGEFDRFGLSKTATVPWFD

SEQ ID NO: 11412 - protein, 196 aa, Moraxella catarrhalis; identical to SEQ ID NO: 11093

SEQ ID NO: 11413 - protein, 188 aa, Desulfurivibrio alkaliphilus; identical to SEQ ID NO: 11094

SEQ ID NO: 11414 - protein, 201 aa, Nitrosococcus watsonii; identical to SEQ ID NO: 11095

SEQ ID NO: 11415 - protein, 184 aa, Dickeya dadantii
MDHYIEIRVLPDPEFSGVQLLSALFAKLHRALGQRATGAIGVSFPDAGKTLGERLRLHGSVQELAALEQTGWLRGLRDYTAITEPLPVPAGVKHRTVRRVQVKSSAERLRRRAVNKGRMTVDEADARIPYTVEKRTSLPYLPLRSLSNGQTFLLFVEHGPLQDKPVAGAFSSYGLSAVATIPWF

SEQ ID NO: 11416 - protein, 182 aa, Desulfurispirillum indicum; identical to SEQ ID NO: 11097

SEQ ID NO: 11417 - protein, 201 aa, Marinomonas mediterranea; identical to SEQ ID NO: 11100

SEQ ID NO: 11418 - protein, 193 aa, Sphaerochaeta coccoides; identical to SEQ ID NO: 11101

SEQ ID NO: 11419 - protein, 188 aa, Delftia sp. Cs1-4; identical to SEQ ID NO: 11102

SEQ ID NO: 11420 - protein, 213 aa, Methylomonas methanica; identical to SEQ ID NO: 11103

SEQ ID NO: 11421 - protein, 184 aa, Klebsiella michiganensis
MDYFLDIRVLPDPEFGEEMLMAALFAKLHRALGARSKGDIGVSFPEFSIKPGPLLRLHGDESALCALEKTLWRKGLNDYCQSGTVMQVPEIKGWRCVSRVQVKSSPERLMRRSVKKGWITQDEADARLLTMRGESTTLPWLNMKSLSNGQIFPLFICHGELRAQRVAGTFSSYGLSHIATVPWF

SEQ ID NO: 11422 - protein, 186 aa, Pasteurella multocida; identical to SEQ ID NO: 11105

SEQ ID NO: 11423 - protein, 186 aa, Pasteurella multocida; identical to SEQ ID NO: 11107

SEQ ID NO: 11424 - protein, 192 aa, Selenomonas ruminantium; identical to SEQ ID NO: 11128

SEQ ID NO: 11425 - protein, 188 aa, Xanthomonas campestris; identical to SEQ ID NO: 11104

SEQ ID NO: 11426 - protein, 185 aa, Shewanella putrefaciens; identical to SEQ ID NO: 11098

SEQ ID NO: 11427 - protein, 184 aa, Pectobacterium parmentieri; identical to SEQ ID NO: 11088

SEQ ID NO: 11428 - protein, 183 aa, Methylophaga frappieri; identical to SEQ ID NO: 11113

SEQ ID NO: 11429 - protein, 183 aa, Methylophaga nitratireducenticrescens; identical to SEQ ID NO: 11110

SEQ ID NO: 11430 - protein, 193 aa, Zymomonas mobilis; identical to SEQ ID NO: 11114

SEQ ID NO: 11431 - protein, 184 aa, Pectobacterium carotovorum
MDHYIDIRVQPDPEFTASQLLNALFAKLHRALGQVADGKIGISFPQVGKTLGECLRLHGTKEALSTLEQTAWLKGLRDYTLVSECKAVPNGVKFRTVRRVQLKSSAERLRRRSVNKGWLTEAEAAARIPDAVEKRSALPFVQIKSLSNGQMFFVFVEHGPLQDAPVAGRFSSYGLSAEATVPWF

SEQ ID NO: 11432 - protein, 187 aa, Alcanivorax
MDQYIDIRILPDPEFTSTILMGALYGKLHRALVKLQSDDIGISFPEHQRRPKSLGGVLRLHGSAAALDHLMSQDCLAGMRDHIQMTGLAPVPGNAKHRVVRRRQFKTNAERLRRRRARRHEETLEQARERIPDTVERKVDLPYVTLRSQSTGQDFCLFIEHGDLQAHPVTGRFSRYGLSPTATIPWF

SEQ ID NO: 11433 - protein, 186 aa, Thioalkalivibrio nitratireducens; identical to SEQ ID NO: 11115

SEQ ID NO: 11434 - protein, 184 aa, Serratia sp. FGI94; identical to SEQ ID NO: 11116

SEQ ID NO: 11435 - protein, 184 aa, Rahnella aquatilis; identical to SEQ ID NO: 11106

SEQ ID NO: 11436 - protein, 184 aa, Photorhabdus asymbiotica
MDYYFEILVLPDPEFSKQSLMEALFAKLHRALGQVGNGRIGVSFPCARKTLGDKLRIHGASEALNDLQALPWLKGLRDYTEIMDIQPVPQDTQYRRVSRVQVKSSAERLRRRSIKKGWLTEEQARQRIPISKEQRTHLPFLLVKSLSSRQTFPLFIEQGPIEDKPTPGVFSSYGLSASATIPWF

SEQ ID NO: 11437 - protein, 187 aa, Pasteurella multocida; identical to SEQ ID NO: 11230

SEQ ID NO: 11438 - protein, 201 aa, Vibrio
MTKRYYFLIRYMPAQADHELLAGRCLSQMHLFMVNNRQAMNRIGVSFPDWNESTVGQTIAFVAEDKEMMVGLSFQPYFSVMVNEGLFEISSVCEVPDTAAEVRFTRNQTIGKSFLGSKKRRIKRSMARAELSGVEPSLPATNEERVIDSFHRIPISSGSSGEDYMLFVQKEFGGERGTANFNSYGLATNQERKGTVPELRV

SEQ ID NO: 11439 - protein, 201 aa, Vibrio
MTKRYYFCIRYTPVQADYELLAGRCISQMHLFMVNNRQAINKIGVSFPDWNESTVGQTIAFVAEDKEMMIGLSFQPYFSLMVNEGLFEISSVSEVPDNALEVRFTRNQTIGKNFLGSKKRRIKRSMVRAELLDAGTSLPVTNEERVVDSFHRIPISSGSSGEDYMLFVQKEFVGERGGANFNSYGLATNQERKGTVPELRF

SEQ ID NO: 11440 - protein, 212 aa, Vibrio crassostreae
MTKRYYFLIRYMPAQADHELLAGRCISQMHLFMVNNRQAMNKIGVSFPDWNESTVGQTIAFVAEDKEMMIGLAFQPYFSVMVNEGLFEISSVCEVPDIAVEVRFTRNQTIGKSFLGSKKRRIKRSMARADFSGDGQSLPATNEERIIDSFHRIPISSGSSGESYILFVQKEFVRERVAANFNSYGLATNQERKGTVPDLRFCPFYESSFSEK

SEQ ID NO: 11441 - protein, 201 aa, Vibrio tasmaniensis
MTTRYYFCIRYTPVQADYELLAGRCISQMHLFMVNNRQAMNKIGVSFPDWNESTVGQTIAFVAEDKEMMIGLSFQPYFSVMVNEGLFEISSVCEVPDIAVEVRFTRNQTIGKSFLGSKKRRIKRSMARAELSGVEPSLPATNEERIIDSFHRIPISSGSSGEDYMLFVQKEFVGERGAANFNSYGLATNQERKGTVPELRF

SEQ ID NO: 11442 - protein, 173 aa, Vibrio
MHLFMVNNRQAMNRIGVSFPDWNESTVGQTIAFVAEDKEMIIGLSFQPYFSLMVNEGLFEISSVCEVPDTAVEVRFTRNQTIGKSFLGSKKRRIKRSMARSELSGAEPSLPVTNEERVIDSFHRIPISSGSSGEDYILFVQKELVSERGAANFNSYGLATNQERKGTVPELRF

SEQ ID NO: 11443 - protein, 197 aa, Pseudoalteromonas sp. NJ631
MSRAYFTITYLPENCDVTLLAGRCIGILHGFMNRRSCNHIGVSFPKWTDKHLGNQIAFVSEDKTALKNLSQQNYFEMMAHDKLFEISAIKPVPVDAPEVQIIRDHSLDKLFMGEKRRRMERAKRRAEARGEEYIPQYVPIDTEISAFHKIPIASKSNQNDFVLHLRLEPTDSIQNTYNSYGFATNEEHKGSVPQLAF

SEQ ID NO: 11444 - protein, 203 aa, Acinetobacter haemolyticus
MDWYQEITLIDQDEISPYFIWSKVYTQLHIAFAEHSNEQGRISFGVSFPQYRMNEQKKIGFLGTKIRVFASSENQLQQLNLGKWLERLIDYVHIIQPREVPQAKVTGHAHYYRVNPKMSIEERIVHQAQRRNISLDEAKQHFKQYIEQPIIEPYVSLKSLSAKREQNIDRPYRLYIGKSLVDEAKDGEFGTYGLSRMATVPEF

SEQ ID NO: 11445 - protein, 212 aa, Vibrio parahaemolyticus
MDYYQEITLLPDADISLGFIWQNVFQQVHLALVDNKIAGNQSAIAVSFPEYGKSGFPLGNKLRLFAKEQAGLEKLSIEQWLSRLEGYVHIKGIKSVPNDVTYVSFTRKQVKSPERIERDMQKKAELWAAKSGRSLQECLVELEKTKPTSLCPLPFIYLHSQQTKQRSPDKSSKFPLFIEMKAIGVKQEGYFDCYGLNSKLNRQDCLGTVPQF

SEQ ID NO: 11446 - protein, 201 aa, Vibrio sp. 624788
MTKRYYFLIRYIPAQADYELLAGRCISQMHLFMVNNRQAMNKIGVSFPYWSDVTVGQTIAFVAEDKDMMVGLSFQPYFSVMVNEGLFEISSVCEVPDIAVEVRFTRNQTIGKSFLGSKKRRIKRSMARSELSGVEPSLPATNEERAIDSFHRIPISSGSSGESYILFVQKELVSERDAANFNSYGLATNQERKGTVPELRF

SEQ ID NO: 11447 - protein, 211 aa, Vibrio vulnificus
MIKRYYFLIRYIPAQADHELLAGRCISQMHLFMVNNRQAMNRVGVSFPDWNESTVGQTIAFVAEDKEMMIGLSFQPYFSLMVNEGLFEISSVSEVPDNAIEVRFVRNQTIGKSFLGSKKRRIKRSMARAELLDAGTSLPVTNEERVVDSFHRIPISSGSSGEDYMLFVQKEFVGERGAANFNSYGLATNQERKGTVPELRFCPFFEKPLFR

SEQ ID NO: 11448 - protein, 186 aa, Thioalkalivibrio sp. HL-Eb18
MDHYLDLRVMPDPEFKETTLIGALVSKLHRRLVSLSADDIGISLPDHEQEPPLGRRLRVHGTRGRLNELMQDEWLGGMQSLVDATPVQPVPDQVTYRPVRRRQYKTSAERLRRRRMRRHGESYEEARQHIPDAVERRVNTPFLSVQSSSTGQRFSLFIEHGPPQQHASPGRFNTYGLSQDATVPWF

SEQ ID NO: 11449 - protein, 201 aa, Vibrio
MTKRYYFLIRYIPAQADHELLAGRCISQMHLFMVNNRQAMNKIGVSFPDWSDATVGQTIAFVAEDKEMMVGLSFQPYFSVMVNEGLFEISSVCEVPDTAAEVRFVRNQTIGKSFLGSKKRRIKRSMARAELSGVEPSLPATNEERVIDSFHRIPISSGSSGEDYNLFVQKEFVGERVAANFNSYGLATNQERKGTVPEFRF

SEQ ID NO: 11450 - protein, 184 aa, Dickeya zeae
MDHYIEIRVLPDLEFSAVQLLSALFAKLHRALGQRATGDIGVSFPDVGKTLGERLRLHGSVQALTALEQTGWRTGLRDYSTITEALPVPTGAQYRTVRRVQVKSSAERLRRRAVSKGWLTADEAAARIPYAVEKRTSLPYLPLRSLSSGQTFLLFVEHGPLQDKPVTGVFSSYGLSATATIPWF

SEQ ID NO: 11451 - protein, 212 aa, Vibrio; identical to SEQ ID NO: 11235

SEQ ID NO: 11452 - protein, 198 aa, Vibrio parahaemolyticus; identical to SEQ ID NO: 11120

SEQ ID NO: 11453 - protein, 184 aa, Serratia sp. ATCC 39006; identical to SEQ ID NO: 11252

SEQ ID NO: 11454 - protein, 186 aa, Desulfovibrio gigas; identical to SEQ ID NO: 11121

SEQ ID NO: 11455 - protein, 190 aa, Dialister invisus CAG:218; identical to SEQ ID NO: 11133

SEQ ID NO: 11456 - protein, 192 aa, Dialister; identical to SEQ ID NO: 11134

SEQ ID NO: 11457 - protein, 193 aa, Megasphaera elsdenii CAG:570; identical to SEQ ID NO: 11135

SEQ ID NO: 11458 - protein, 182 aa, Aquaspirillum serpens
MNHYLDIRILPDPEFSQPILLKALFGKVHQGLVAHGDGKIGLSFPEHTSTRLGSRLRLHGSEEKLLALMASDWLAGMRDHCQLSQILAVPAGVQYRVVRRVQSKSNPERLRRRAIARGADPSEVANKITEGKKLTLPSVEARSRTSGKTFFLFIEHGPLQDQPIEGEFSCYGLSTTATIPWF

SEQ ID NO: 11459 - protein, 188 aa, Candidatus Symbiobacter mobilis; identical to SEQ ID NO: 11122

SEQ ID NO: 11460 - protein, 203 aa, Psychromonas hadalis
MKRYFFMVHFVPEEANCTLLMGRCISIMHGYISRHSIEGVGVTLPAWSDISIGNVIAFTHSDSYMLNELRQQSYFQDMQECGFFKLGQVDDVPNDCIEVKFRRNQQIAKMFVGGNRRRLKRLKKRALVRGEPFSPERKIKSREFEVFHRIAISSKSSQQDYLLHIQRDVVDKQEEPEFSCYGFASNSKLNGTVPELSLYIGRI

SEQ ID NO: 11461 - protein, 198 aa, Psychromonas hadalis
MKYYLDITLLPDNEITLGFIWYKVYQQVHIALADNKIAEKSSAIALAFPQYSFTSGKKGDFPLGNKLRIFSPTQEPLDKLDINRWLKRFTDHTHITSVKAVPDNVSEFVCVKRKQFKTNLSRLARRRAKRKGETFEQALQHYASFDDEQSKLPFININSLSKNEQFRLFINQVKVQEENVGEFNCYGLSKEQATVPWF

SEQ ID NO: 11462 - protein, 193 aa, Zymomonas mobilis; identical to SEQ ID NO: 11123

SEQ ID NO: 11463 - protein, 184 aa, Dickeya zeae
MDHYIEIRVLPDLEFSAVQLLSALFAKLHRALGQRATGDIGVSFPDVGKTLGERLRLHGSVQALTALEQTGWRTGLRDYSTITDVLTVPTGAQYRTVRRVQVKSSAERLRRRAVSKGRMTADEAAARIPYTVEKRTSLPYLPLRSLSSGQTFLLFVEHGPLQDKPVAGTFSSYGLSATATIPWF

SEQ ID NO: 11464 - protein, 184 aa, Erwinia piriflorinigrans; identical to SEQ ID NO: 11132

SEQ ID NO: 11465 - protein, 184 aa, Dickeya dianthicola
MDHYIEIRVLPDPEFNGVQLLSALFAKLHRALGQRATGAIGVSFPDAGKTLGERLRLHGSVEALTALEEAGWRKGLRDYTAITEPLPVPDGAKHRTVRRVQVKSSAERLRRRAVNKGRMTADEAATRIPYAVEKRTSLPYLPLRSLSSGQTFLLFVEHGPLQDKPVAGVFSSYGLSAVATIPWF

SEQ ID NO: 11466 - protein, 184 aa, Enterobacter sp. 638; identical to SEQ ID NO: 11068

SEQ ID NO: 11467 - protein, 183 aa, Shewanella putrefaciens CN-32; identical to SEQ ID NO: 11069

SEQ ID NO: 11468 - protein, 202 aa, Dichelobacter nodosus VCS1703A; identical to SEQ ID NO: 11070

SEQ ID NO: 11469 - protein, 199 aa, Marinomonas sp. MWYL1; identical to SEQ ID NO: 11071

SEQ ID NO: 11470 - protein, 194 aa, Shewanella baltica OS185; identical to SEQ ID NO: 11072

SEQ ID NO: 11471 - protein, 184 aa, Yersinia pseudotuberculosis IP 31758; identical to SEQ ID NO: 11060

SEQ ID NO: 11472 - protein, 194 aa, Shewanella baltica OS195; identical to SEQ ID NO: 11075

SEQ ID NO: 11473 - protein, 190 aa, Delftia acidovorans SPH-1; identical to SEQ ID NO: 11074

SEQ ID NO: 11474 - protein, 185 aa, Coxiella burnetii RSA 331; identical to SEQ ID NO: 11076

SEQ ID NO: 11475 - protein, 184 aa, Yersinia pseudotuberculosis YPIII; identical to SEQ ID NO: 11060

SEQ ID NO: 11476 - protein, 184 aa, Yersinia pseudotuberculosis PB1/+; identical to SEQ ID NO: 11060

SEQ ID NO: 11477 - protein, 213 aa, Vibrio fischeri MJ11; identical to SEQ ID NO: 11080

SEQ ID NO: 11478 - protein, 203 aa, Acinetobacter baumannii AB0057; identical to SEQ ID NO: 11081

SEQ ID NO: 11479 - protein, 203 aa, Acinetobacter baumannii AB307-0294; identical to SEQ ID NO: 11081

SEQ ID NO: 11480 - protein, 184 aa, Erwinia pyrifoliae Ep1/96; identical to SEQ ID NO: 11129

SEQ ID NO: 11481 - protein, 137 aa, Laribacter hongkongensis HLHK9; identical to SEQ ID NO: 11083

SEQ ID NO: 11482 - protein, 184 aa, Tolumonas auensis DSM 9187; identical to SEQ ID NO: 11084

SEQ ID NO: 11483 - protein, 184 aa, Dickeya dadantii Ech703; identical to SEQ ID NO: 11085

SEQ ID NO: 11484 - protein, 184 aa, Dickeya zeae Ech1591; identical to SEQ ID NO: 11086

SEQ ID NO: 11485 - protein, 193 aa, Zymomonas mobilis subsp. mobilis NCIMB 11163; identical to SEQ ID NO: 11087

SEQ ID NO: 11486 - protein, 184 aa, Pectobacterium wasabiae WPP163; identical to SEQ ID NO: 11088

SEQ ID NO: 11487 - protein, 184 aa, Dickeya dadantii Ech586; identical to SEQ ID NO: 11089

SEQ ID NO: 11488 - protein, 188 aa, Xanthomonas albilineans GPE PC73; identical to SEQ ID NO: 11131

SEQ ID NO: 11489 - protein, 186 aa, Thioalkalivibrio sp. K90mix; identical to SEQ ID NO: 11090

SEQ ID NO: 11490 - protein, 199 aa, Nitrosococcus halophilus Nc 4; identical to SEQ ID NO: 11091

SEQ ID NO: 11491 - protein, 196 aa, Moraxella catarrhalis RH4; identical to SEQ ID NO: 11093

SEQ ID NO: 11492 - protein, 188 aa, Desulfurivibrio alkaliphilus AHT2; identical to SEQ ID NO: 11094

SEQ ID NO: 11493 - protein, 201 aa, Nitrosococcus watsonii C-113; identical to SEQ ID NO: 11095

SEQ ID NO: 11494 - protein, 182 aa, Desulfurispirillum indicum S5; identical to SEQ ID NO: 11097

SEQ ID NO: 11495 - protein, 201 aa, Marinomonas mediterranea MMB-1; identical to SEQ ID NO: 11100

SEQ ID NO: 11496 - protein, 193 aa, Sphaerochaeta coccoides DSM 17374; identical to SEQ ID NO: 11101

SEQ ID NO: 11497 - protein, 188 aa, Delftia sp. Cs1-4; identical to SEQ ID NO: 11102

SEQ ID NO: 11498 - protein, 213 aa, Methylomonas methanica MC09; identical to SEQ ID NO: 11103

SEQ ID NO: 11499 - protein, 186 aa, Pasteurella multocida 36950; identical to SEQ ID NO: 11105

SEQ ID NO: 11500 - protein, 184 aa, Rahnella aquatilis CIP 78.65 = ATCC 33071; identical to SEQ ID NO: 11106

SEQ ID NO: 11501 - protein, 194 aa, Shewanella baltica OS678; identical to SEQ ID NO: 11075

SEQ ID NO: 11502 - protein, 186 aa, Pasteurella multocida subsp. multocida str. HN06; identical to SEQ ID NO: 11107

SEQ ID NO: 11503 - protein, 192 aa, Selenomonas ruminantium subsp. lactilytica TAM6421; identical to SEQ ID NO: 11128

SEQ ID NO: 11504 - protein, 193 aa, Spirochaeta africana DSM 8902; identical to SEQ ID NO: 11108

SEQ ID NO: 11505 - protein, 188 aa, Xanthomonas campestris pv. raphani 756C; identical to SEQ ID NO: 11104

SEQ ID NO: 11506 - protein, 184 aa, Erwinia pyrifoliae DSM 12163; identical to SEQ ID NO: 11129

SEQ ID NO: 11507 - protein, 185 aa, Shewanella putrefaciens 200; identical to SEQ ID NO: 11098

SEQ ID NO: 11508 - protein, 183 aa, Shewanella putrefaciens 200; identical to SEQ ID NO: 11069

SEQ ID NO: 11509 - protein, 184 aa, Escherichia coli IHE3034; identical to SEQ ID NO: 11092

SEQ ID NO: 11510 - protein, 211 aa, Providencia stuartii MRSN 2154; identical to SEQ ID NO: 11109

SEQ ID NO: 11511 - protein, 184 aa, Pectobacterium sp. SCC3193; identical to SEQ ID NO: 11088

SEQ ID NO: 11512 - protein, 187 aa, Aggregatibacter actinomycetemcomitans D7S-1; identical to SEQ ID NO: 11111

SEQ ID NO: 11513 - protein, 183 aa, Methylophaga frappieri; identical to SEQ ID NO: 11113

SEQ ID NO: 11514 - protein, 183 aa, Methylophaga nitratireducenticrescens; identical to SEQ ID NO: 11110

SEQ ID NO: 11515 - protein, 193 aa, Zymomonas mobilis subsp. mobilis ATCC 29191; identical to SEQ ID NO: 11114

SEQ ID NO: 11516 - protein, 186 aa, Thioalkalivibrio nitratireducens DSM 14787; identical to SEQ ID NO: 11115

SEQ ID NO: 11517 - protein, 184 aa, Serratia marcescens FGI94; identical to SEQ ID NO: 11116

SEQ ID NO: 11518 - protein, 185 aa, Morganella morganii subsp. morganii KT; identical to SEQ ID NO: 11119

SEQ ID NO: 11519 - protein, 198 aa, Vibrio parahaemolyticus O1:Kuk str. FDA_R31; identical to SEQ ID NO: 11120

SEQ ID NO: 11520 - protein, 186 aa, Desulfovibrio gigas DSM 1382 = ATCC 19364; identical to SEQ ID NO: 11121

SEQ ID NO: 11521 - protein, 188 aa, Candidatus Symbiobacter mobilis CR; identical to SEQ ID NO: 11122

SEQ ID NO: 11522 - protein, 187 aa, Pseudomonas aeruginosa SCV20265; identical to SEQ ID NO: 11124

SEQ ID NO: 11523 - protein, 193 aa, Zymomonas mobilis subsp. mobilis ZM4 = ATCC 31821; identical to SEQ ID NO: 11058

SEQ ID NO: 11524 - protein, 203 aa, Shewanella sp. ANA-3; identical to SEQ ID NO: 11062

SEQ ID NO: 11525 - protein, 193 aa, Psychromonas ingrahamii 37; identical to SEQ ID NO: 11063

SEQ ID NO: 11526 - protein, 224 aa, Shewanella sp. W3-18-1; identical to SEQ ID NO: 11064

SEQ ID NO: 11527 - protein, 191 aa, Acidovorax sp. JS42; identical to SEQ ID NO: 11065

SEQ ID NO: 11528 - protein, 190 aa, Verminephrobacter eiseniae EF01-2; identical to SEQ ID NO: 11066

SEQ ID NO: 11529 - protein, 443 aa, Ureaplasma urealyticum
MKFNSNYQKWILDSLINQKIFEPTPIQLKTMPLIAKRENIIGVAPTGTGKTLAFVLPILNNLDLSQKLQVIIITPTRELARQIFSKIIVFKKHQPLLQVKMLIGGESIDQQINSQLNKSQLLIATPTRLKQILTRQILDLHHVNALVFDEADMLMDLGFISDLEFINSQFTNKDVQKISFSATLHEMLSIQLKKYFKNTKIINISNSIYENKKITHYVIHNHDKWHSLSIIMKTIKPYLCIIFANTKKEVEAIYQYLIQQNKNVCILHGSLLQRERKNNYRDIKNNKFQYVVASDIASRGLDIDGVSHIINWNLPTENEWYIHRAGRSGRGKYSGESYVLYDQKEHDKLLNLSKKGIVFHHKFIKENELFDKEFLFKKKNQFKDLKTQNEIQKIISTTSTKIKPGYKKKIKEAIQKINQKNKRSHIEKKMNAHRIRGYKLKNS

SEQ ID NO: 11530 - protein, 546 aa, Archaeoglobus fulgidus DSM 4304
MVTLSEIYGEIVEKWFGGRDERPFIANAIREIEKNWDRNIFVIEAPTGYGKSTISATIAAYSLQEELKSIIAFPLRTLLEDQYNKFKGLFGNKLGKRYMHNPDSPYLIKPVTLTTIDTLALTLFGIPPEDLDKAVKYWDGTSSGSLGHYLFSQASVALSNIVLDEVHLLADSTKSLNFLFALMHAAIDNDQKLVLMSATIPEALKKRIKEFNPDVCMVEFNESFDRKFVEERRKKKYRINLIALASVEKFGSLERILLEGSKKFSKITVVFNTIGDAVYFYNNIKEKIPEFKKLLLHSRFSEMDREKKAELLAEMKKSEKFVIVTTQVIEAGVDISSNLFITEIAPASSLIQRLGRFLRYGEREGEVYIWYEVDDRGELARWKDDRYKVYDYSLTALTLEKLAEMKNFSVHVDYDRLLDVYGEFEVDERGVNDLRRILMNFENINSAVEKFFELEGSFVRDSFIIPVVPYSVIEEKRRSSKVPVSFETFKNFKVYGCIVSDEFVSAEKLKCNLSSPKALLRDMIRKSIAAFVVDGDYDSEMGLVKR

SEQ ID NO: 11531 - protein, 759 aa, Archaeoglobus fulgidus DSM 4304
MVIKAFRKLTGHSPYEYQKEAMDNLLEGKSLIIRAPTGAGKTEASLIPFIYGLNDYLPPQLIYSLPTRTLVESIGERAIKYASFKKLRVAIHHGKKATSSLFEEDIIVTTIDQTAGAYLSVPLSMPKRWGNIFVGGIASALTVFDEVHTLDPEKGLQTAAAIAMQSAKLGLPSIIMSATLPDVFIERVKERIEKNGGKVEIMDVKNESEIKSRRNRKVELINRPDEMLTADTVLKEAENCRKLVVVVNTVERAQNLYLDLRKKIDYPIFLLHSRYLEKDRAEKEKSFEKVFGKNGKGECIFISTQVIEVGMDISSPIILSEVAPIDALIQRAGRCARWGGNGEFHVFGLARDSSNPYAPYLKELIESTITEIRSKGDFPLDWQTELQLVNNVLSSHFEFFMDSKFFYQRLGELARAVYEGSKAKVEQNVREIFSCDITLHENPDTLEPEEILALPRIRVDARVLSGKVEKLAELGIKTYKLEENPVIGDYESKYTLVLVKSKEDVTPFQLYVLSGACYSPEVGLVLGKSAPNAIKSFEPDKLKLKGIKSQADYKLEKESWVEHAKNSLWVLDCYLIPRYYYVIKNFADYFGYEYNEFVNLIKCITALHDLGKLNINWQEKVGWNGKIPLAHSDESDVRKLPPHATVSAKALQPYLESLFDDAGVFKAFYLAIAHHHGPWAREYKEYRLIPEFNKFIEEVWSVPKELIKVHDSANRLDFTYLNVADENEAYRLYGLLSKLIRISDRLATGGASYESIFSA

SEQ ID NO: 11532 - protein, 728 aa, Methanocaldococcus jannaschii DSM 2661
MHDIGKITEGFQNNIKKGKRSNKHPHPLYALPIIKNIEFDYLFDIPIEVFAILSHHTQLYNNLYADYQQYKKGTFLIEEIKEFIKNSKEAYESLGFSKFFEFEDLKIEDIPKDAKPLELHRLRRKYWIEANNYIKSLSFDDKIKIKSIFSFMFSILQLCDDFASLNFSEYAKDREGIFDDVLENPEIYVPTLNIDNPISFILKDYEPYKFQKELYNSKNKFVMLFAPCGRGKTEGALLWALNALKNFKRNKIILAMPTQVTSNAMYDRLVKIFGEENVGLFHGKSFIKLRDSKEIEDEDDLEEIRDENFKGNVFFKPITITTIDHVIYSFVHGFSQADFALGNIQNSVIIFDEVHYYEKYTLEHLLTLFDILRRMDIPHLLMSGTLPNFLMNNLEGYELVVDEEGLNYKPFKLKCSENHLIWKEDDEWKVNENIINEIIENYKKGLSQAIILNTVERAREFYKAVRDKVPAILYHSQFAYKDRVKKEDEIFTLEEMRKSQNKPYVIVATQVIEISLDMSVDVMYSELSPPDALGQRAGRLHRKGKDWRENGKEYKLKIFLPYKHLPYSKELIEKTINHIKFYEKPLDYRDIKDFVDNVYKDYNLSIPSDLKLFFDEAILFGRHWTDISTIDEEGRFFKVRDDKFMKIEVVPQVYFDELGENSLRAEYMAKIPAYLILNEMKNEEGLIHFYPYEKRVGRKTRRYLICSFKYTYEIGFDYKEEEEFEDIL

SEQ ID NO: 11533 - protein, 614 aa, Methanocaldococcus jannaschii DSM 2661
MDIINFFKQITDHEPYDYQIRAWEKINKIMELGGRVVIEIPTAGGKTEAAIIPYLYQFISNDWKVPRLIYVLPTRSLVEKQVERIRNYIKKILEIKGYSKDKVEELAKKIVQVEYGLEETHAFLGFVVLTTWDTFLYGLAAHRTVGDRFTFPCGAIAQSLVVFDEIQMYQDESLYMPRLIGLVVKRLVEANVPLVFMTATLPTELKKILGIHDEEPITVNPEDTKKPERGEVVVEFKEKLSDEELSNEIKKAINEGKKVLIIKNTVNSAIEVYEKVKQLGNSLLLHSRFTVEDRAEKEKDIDKAEIIVATQVVEAGLDLTNVGLVITDLAPLDALIQRIGRCARRKGERGKVIVVLPNFNEKINEDHREKVILGFKNIPFENAYVTLVNNKDYGRVIELTIETIEEKKGKSKIVPKKFYIGDLGNKTIRKLIENNKILKKKDLYFIPYSTQPYDPLIMIKSFDEVESVSEYLYDIIKAREALDRVYKEYYENNIVPKDYYSAYIYFRELKLFSTPPEYELKARPEMFAILYPLENAEEKVKNKEIIEFNPKYVIRVSYNWLKNKWEKFDKKFELIKEYDEKGWICSLKKAGKLQPYKIYIIDDKYYSKETGIII

SEQ ID NO: 11534 - protein, 443 aa, Ureaplasma parvum serovar 3 str. ATCC 700970; identical to SEQ ID NO: 11529

SEQ ID NO: 11535 - protein, 572 aa, Saccharolobus solfataricus P2
MGCEENKRGIRKDESRDGGGILIHMRKGIQKVLDILNCRDNSIYYECEDVNFILTFPTGYGKTTLSLEIVRMIDLKPTQNFSRLIHVVPTRSLAKDIQNSACERGLGFAVQYSFTPSHIKSPLFLAKFIITTYDSFLLNLYKASIGEPFSYHGHYDLPRFGIYTSLVHFDEFHLMNEGNSWTSLLGAVRHLSKVGVNMILSSATPSKSVEEELIRMMENRKVVRLAVVNEYGESVKNRNCVKVSEGYYECEVGSVKYTSVEVEDKINAPDININFLDKEDDVLGVVRRNKDKKIMVIVNTVDKAITLYEKLRDLSPCLIHSRFKIGDRDEKLRKECNIIIATQVIEVGVNISSEVMITEQAPITSIVQRVGRLLRDNKKDKGELYIWKSGNYYPYDKDEVENTIKELESKKNDISLKVPSSYGEIVDRVIKPPRGDPDLLRELDNIAENLFATREDLEKLLDKYCTLTNSYVINVAYDTPASERDLIPLDGDLALKIAIKGNDCVYAYVEEYKPERKVAVDKVNVRETCVEIAKPCRDYRKVFYDGDKRYIIYALKIDKELYDEETGLRLRK

SEQ ID NO: 11536 - protein, 515 aa, Saccharolobus solfataricus P2
MKLRLRKPMRSAGNMSSLVDFYNDFITRHGFEERKGIEETLRYLENGHNVILKAPTGYGKTTLTMILANAVSSNIDIGSRVIHVLPYRAIVQDLYLKLKKYADKGIIYTKSIGAQDMDYHDSPFFMKKVNVTTLDTFILNLFKLPTIDFKLIFKNYGSHYEFPRALIYSSIVIFDEFHLLGEDGKSLGAGLSAIEVLSDAGVPIVVTSATIDKGLERVLMDKLGKSGKVVYASDFKIDRKIYVNELEKDEISIADEKVKEGKRVLLVYNTRMGAIEAYWKLKERGLSPILIHSKFSKKDRIDKVNKINDAKLVVSTQVIEAGIDTSFDVLITEACPSHNLIQRAGRVARYGKGGKGKLEGEVYIFPFSGKVYNEGEVKETMKRVRKLKTIDESLLIERDYTKEIDSILARDLSVIDNSVFVDYKKVKSLYENICSITRETSIILGFPPNSDNVDDAIPLTEEEAIKIIKSKGSSAFVGNSNIKLYAGKCLQLEMIKNDILGVRIQDYNSEIGGVY

SEQ ID NO: 11537 - protein, 515 aa, Saccharolobus solfataricus P2; identical to SEQ ID NO: 330

SEQ ID NO: 11538 - protein, 609 aa, Pyrobaculum aerophilum str. IM2
MIVDAYRKYAKALDLEERPALETALEELEKRGVVVLRAPTGYGKSLFSVAMGLAAYEELWQRGIAKVIHVIPMSSIVEDLYSRALERLTRKGEDADLKQLENALLEKYPRRWVGYQSWAIDADFKDPLYIWSSLVYTTFDSFVLNLYKITPLRAKRAPYESARSAIIRSLVILDEAHLMADPRGGKSLAVFIATIKSLRKLGVPVLIATATISDTVARLIKNAVDDVKIVASTVKECGKGGDVLVHDYGPKGHVDAYLKAIPLEELKNELKSQSFKKALLIFNTVDRAVRAYRMLRGEYNAVLLHGRLTLGDRSEAVMRAKSAEIVVATQVVEAGVDIDSDLLITDIAPFPNLIQRFGRVARREIKRGTAIINIDKNAYEASKAVYGENETEVTSKLLREYTKADKRLEVEWRNPCPEKNTYALLLEEFDRRAYPDIGRRYDVELSLALQTLNDLPTLSREDARNIMEKYCGFVRDAAAVPLIDPECYNNIKKPDEIRRCILLVSSDFLNNKKEYIITNGTIRVVVEALKRVDKMRDQVSNTLCKDRGVNEVSTEEYELPASMLFNAKGEVDCRKALALDYYVAKHIGTRAVVLGVIINKGYVRGEGLI

SEQ ID NO: 11539 - protein, 554 aa, Pyrobaculum aerophilum str. IM2
MTGDVQVEKVAEIVKDLIKAWQRANKREVKVDEEALRRQAEIAAEILRGFYRNGGGRLVLLKAPTGAGKTEIFASLYFYQVASGVWHTGRMYVVEPVHALLEQMAKRFGTYGKAFRVKVEEDHGEVKRPTYLYTAPITLTTVDSYAYAYLAQRVDKWIERGNLTGRFTMPVGLMMHAITVFDEAHLVQDEVYLGPRALARIICYLVNAGAYVVFSSATLPTAFIKEFKSRCATVEERILSSRPRKVNIEFRKAELTPNDVDCSKGALIIVNTVPRARRFYKDLKEKCKGKKIYVLHSLLTRGDRERTLRELEELEEKKRINEAIVVGTQTLEVGIDYSFTRLYTDLSPLDSLIQRIGRVGRRGDPAEILVFQPERPEPYRKDLLEKTAPKLDSLEKMLGDAAKLGELLDEVYDEKIVEDMSKKGDSLYVQFLDYLENLHLYSLPPETHPQIKPSLYVDLYLLTTKDVDKETKELLISREELLRRRMRISFSYRRLDRLENILGLFDSCEKGGLERDDEKLKFNNWNRVSTREWIREGSLVILCDDVDRATTKLD

SEQ ID NO: 11540 - protein, 658 aa, Pyrococcus furiosus DSM 3638
MDTEKLFRELTGFEPYDYQLRAWEKIREIMNNGGKVIIEVPTAGGKTETAVMPFFAGIYNNNWPVARLVYVLPTRSLVEKQAERLRNLVYKLLQLKGKSKEEAEKLARELVVVEYGLEKTHAFLGWVVVTTWDAFLYGLAAHRTVGNRFTFPAGAIAQSLVIFDEVQMYQDESMYMPRLLSLVVGILEEANVPLVIMSATIPSKLREMIAGDTEVITVDKNDKNKPSRGNVKVRLVEGDITDVLNDIKKILKNGKKVLVVRNTVRKAVETYQVLKKKLNDTLANPSDALLIHSRFTIGDRREKERALDSARLIVATQVVEAGLDLPNVGLVVTDIAPLDALIQRIGRCARRPGEEGEGIILIPVENCIEHEKIVRGLSELMEKIGEDTVVFATVTSTNEYDRVVEIHYGEGKKNFVYVGDIDTARRVLEKKRSKKLPKDLYIIPYSVSPYDPLVLLTTYDELSKIGEYLADTTKARKALDRVYKFHYENNIVPKEFASAYIYFKELKLFSAPPEYELRSRPELYVLLYPMNIEKNERVEDKVIDNLETARIIRISYSVKEWKKSDVVIGRLMKEWDKNAEKWVWKVRKSFKIDPYEIYVIDAKYYNSELGFITNLSDTNSHTDSDSKVRTRNSEHSSKKNRSKGKKGQTSLENWGVRV

SEQ ID NO: 11541 - protein, 732 aa, Caldanaerobacter subterraneus subsp. tengcongensis MB4
MDARGLLAKPDETLLEHLKKVVEEGRKIAHFLGLSPEMREKALLACLFHDLGKATESFQAKMRGERGRAYPHPLASLPFIIVTGNLSDPLSLAAAAAVLTHHSPLNKDLYREFKDKSADYVSEETLKDLLQGLSDLLDKYELGDHFPLYESLKLIRLYNKRSALLLEQNLRFGGETKTLRLIFKELPSQEYAAIKTVLMLADWLISSRKFSAEDLFLFEGGNKLKAYLSQKNWVLREFQRKISQLPEKRVWLRAPTGTGKTEALLLWANDAERIIYLLPTQATANAMWKRLRAIYGEDKVGLAHGRAGYILRKEIEEEPLDFKLWASVFAKPVVVATVDQYLLAHLQGRHWEIRRTLAKNSALIMDEIHSYDPYTLGLLKAALEKEPPYKLALASATLPEFLISLLGEGPLVEAEKNLWKRKRHKIILHSDYLDHYISQIIEEARKGHKVLVIVNTVAKAQEIYQLLYGLLKNKISYLDESLLQLLHARFAFKDRWEKEEKLQNPPPATILISTQIVEVSLDISFDVLFTEIAPIDALVQRLGRVNRRGDNPPAPVHVFLEWYPGSEKIYGKNILEISTEILRDIQSEPSDGEWVQATNELYRKLVFSPAYQKDLQEGEKTLKEIQHILGCYTIDLSDEELQKKFTTRKGQLSVEVLPYIFKDQVYTLKEQGELWRLVEFLVPVPLWWLGTYPQWFSKDEDLAVYWTDLPYDEKVGLRLPGEEESPSGAEIC

SEQ ID NO: 11542 - protein, 764 aa, Xanthomonas citri pv. citri str. 306
MDFFAHSTKRQDRSDWQRLADHLLAVGERAARNAAPFGGQLLASLAGQLHDLGKYTQKFQGRLDGDPARVDHATWGARIACERYGTAGTLLAYGIAGHHAGLADGRPGHAAQSRPSLHERLSEDYRERELPPLLSDWERELSLPAKLALPDGFIGHPRQERRPFQLTVLTRMIFSCLVDSDFTETDDFYRRLEGRQSRAEDTGTRPALPELRQCLDAHLSTLPTEGGINPLRAQILSEVRAKAGMRPGLFSLTVPTGGGKTLASLAFALDHAIAHGLRRVIYVIPFTSIVEQTVQVFRHALGVQERDDIVLEHHSAFFDDPTKAPQSIDKRKLAMENWDAPIVVTTAVQFFESLFADRPSRCRKLHNIAGSVVVLDEAQTLPHALLRPCVALLDELARNYRVSPVLCTATQPTLRLDQGFVGGLDQVRELVDDPPALYARLRRVQVRHVGTLDDAALTDHLRQREQVLCIVNNRRHARHLFDAIADRPGARHLTTLMHARHRSAVLAELREDLKAGRPCRLVATSLIEAGVDVDFPTVLRAEAGLDSIAQAAGRCNREGLRPVEVSQVQVFAPANPDWAPPKELDLFAEVFRGIERTHRNDLLAMAAVADYFAALYRRLGDGRLDREDVLGLLRDADIKGLPLDTLARKFKMIQTTLRPLIVPYAPYAEGCDKEVPEVADILRQLEHAEHVGVAGAARRLQPWLVQVPEQAYRALWQANAIAPVAQARYGEQFVRLVNPRLYDPRFGLRWDDSPQFLAAEALVQ

SEQ ID NO: 11543 - protein, 668 aa, Chlorobaculum tepidum TLS
MGKIDHSAAGAILASNKSKDIGRILGYLIAGHHTGLPDWDKDAGTKGDPLSERLSNSEHLQHALKGNPPENILDTPLPSSLPCQTQNGGAELVHLWIRMLYSCLVDADFLDTERFMNPETSELRPNGVDLAMLKERFDQHMSLKESGASDTPVNRARKEILRECRQKGVSLEPGLFSLTVPTGGGKTLASMAFALEHALKHDKKRIIVVIPYTSIIEQTAAVYREVFGDDAVLEHHSNLDPSRETPASRLATENWDAPIIVTTNVQFFESLFAARSSACRKLHNIVNSVVVLDEAQMLPTDFLQPIVSVIKMLSAHFRTSVVLCTATQPVLSGKVGTGKDILKGFDDGRVRELMADPEKLFGIFQRVRVRMLGQADQRHEWAEIARRLCEPEQVLCIVNTRKDCRELHDLMPDGTVHLSALMCPEHRSTVIAELKSKLVAGEPVRVVSTQLLEAGVDIDFPTVYRSFSGLDSIAQAAGRCNREGKLEHGDVVVFNPPNPSPSGRLRKAEQAAQELFRTVPELAASLMPEAFRRYFMHYFSGLNGFDTKGIMDLLASNDAARYFQIQFRTAARKFKLIDDTLQHGIIVRYRNGKANIDALIDQLRFGGPNRKLMRQLQRYSVNVYDPDLKKLIENGLIEEVHGVWVQTSESAYDPVFGLNIDANLNFYW

SEQ ID NO: 11544 - protein, 861 aa, Chlorobaculum tepidum TLS
MRHYPKSLKNADAPVEHPPLPLERCLAKSRKIDASRSVAGRTVLDHCRIAGEVARELIARSPAFLRESFFPDGSALVAASHDIGKVSPTFQKKIYTAIGNADPTILDVLNDVDSEIEKNWGGHAGVSQCALEALEAGKDIAAIAGCHHGYAPKLAGKTADAEAFGGAAWQRQRARLLERLAEATGERFPKIRNLLHARVLAGLTSVADWIGSGATFDDPGEAWQSCIADAVDAAGFTPPRLRPGLSFREIFGFEARPIQRSLIEKACRPGAYILEAPMGIGKTEAALYAAYALVSAGKARGIYFALPTQLTSNRIHERVERFLDKVLEADSPHRNALLVHSNAGLQKFEFGADAAPGCSWFSASKRGLLAPFAVGTIDQALMASMNVKHGFVRAFGLAGKVVILDEVHSYDAYTGTILDRLVRELRQLHCTVIILSATLTGERRSALLGAARSAEAAYPLISALPAEAREPVEIAPETMPGNRVAIHQTLDIDEAMDEALNRADSGQQVLWIENTVTEAQEAFKLLAARSSGMAIECGLLHSRFIHCDREALEEKWVTRYGADGAAARRERGRILVGTQVLEQSLDIDADFLVTRLCPTDMLLQRIGRLWRHSFHQRPAGARCEAWIVSAQFEAAEQNPGEAFGKSAKVYSPYVLLRTLQAWSGVEALSLPGDIRDLLERTYEARPESEAMAKHKADLQRRREILESFALQGVSFGLDARPDTNVATRYSDIDTVELLLLQSVSHNHAAHETTVTLLDGQQLTLPHDFAAGRKREQRQLAARLATQTLKVAEYAAPADPGRNTLTWLKPYFYLGDPSKSESLLRVAIVGEGGLLRLPGGGAAAEKYELSYNPRLGYQYKKR

SEQ ID NO: 11545 - protein, 752 aa, Leptospira interrogans serovar Lai str. 56601
MILLAKSYPGIEKQLKSGDPESWALLEHHSSATYQVAEVLLKILEPILRKWTRLSESEYNKFVLVVCLSAGLHDLGKANEDFQKMLQRRKYLQRFRHEIWSVLALTGSGPFSDWFRKTIGDETWVRIGQMGILSHHLKATRETLYADHETAEIKVFWKDQGVIKTFQSICRLAGISSPDFSSSSISSYTCLGEDADKSIRIWTREILNARIDPRYQHSIGAVRAMIIAADRLASAYKGADALKLWAEEALNRVLSEQECSKIVKQGLGEKNLRPFQKQVGDSTSRVTLVRAGCGNGKTIAAFQWAKTHSAGRKLFFCYPTMGTATEGFRDYVSDIPGLDALLSHSRASLDLGELASTGEEDEGDSLNMHSRMLQEWTAQVTFCTVDQILGLLQNYRSSLTLSPAIFLGAFVFDEIHMYDSILFGNLLTFLKEFSHTSILLMTASLPETMLSAIQETVGADLGPVISGEAQIEERLRYRILHSSREDALQKAIQEFKNGGRVLWVCNKVEHCLKLYDELSEKYDIEALVYHSRFKYEDRKERHRAVIDSFQEGYKKSLPVFAITTQVCEVSLDISATLLISELCPFAALIQRLGRVNRPGQEMEGIAQVLIIPFQGKPYEKENEDDGESELERCKEILKPLLDRELSQKDLALALENAKGTEHQKIPSQWLSLGWEAKPDSIRESGYTLDVILESDAYKVLKNERPWEKSKLYTIPMPIQKQFSYGEPPLRIPVVPDSQIQYSSVRGGEWNLN

SEQ ID NO: 11546 - protein, 776 aa, Clostridium tetani E88
MKGSRNFSCCFIVRRRIMENKLNILDDDILKLIEEKKAKPDKTIKEHTLELIEVLNLLRELGYIKNDKIYNLVEKACIYHDLGKLNKEFQKRVNGKNVKFNETKEVVHNILSLYFINSKNFESKENYLKVAHSVLNHHNYCNNFDEISEKEELIKSLIEGFKTYKVKRSTISKLKSIVSDIDSIKVKGYLHKCDYSASSGNKAEYPNNFLENGLNNLLIKWKKGTKEATWNELQNFCIENKDENIIAIAQTGMGKTEAGLLWIGNTKGFFVLPIRTAINAIYDRVRKDILNNKGIDEKIAILHSSSLEYYIRNITGDTNEKEEIDLMNYHKIGKQLSIPINISTMDQIFDFVYKYPGYELKLTTLSYSKIVIDEIQAYGPDLLAYLICGLEKIAELGGRIAILTATLPPFIKDLLQKNIKFIENSTAFTNDMKRHNLKIIDERINSEDIYNKYVENKKLNKNNKILVVCNTIKEAQKLYEELKILINNEELHILHSKFIRKDRLKKESEIIEFGKTYDENKNIDKKNGIWISTSIVEASLDIDFDCLFTELQDLNSLFQRLGRCNRKGKKDSSNYNCYIYTEIDTANLINGDKGFIDKRLFDLSKKAIISCDGQISERDKINLIDSYLTTENLKGSDYMRKYKEIYNFIKDIPSYEFDLNQIDLRNILSEEIIPSPVYEEFLEEIKEIECKLANENISYYEKIILKDEIRKYTVSVHPNDIRNYDRAKQKGAAINYNKILLSKYKNEYIKVIECKYDEAGYKRIKYGETTRSSNIW

SEQ ID NO: 11547 - protein, 866 aa, Clostridium tetani E88
MYFNNIEKVNLENIIENNDKIYAHIHNGRKETLKEHSDLALKYLYKISERKSLDNVFLKIENNFLEKCSNEEKMVYRKMLLNTIYMHDLGKINCNFQRKKMANKIFKEEKMSSTNHSMLSSIIYINHFLKEIASIENGEHIKLLIAFLLLNSYVISKHHGAFNSVNKFKEKLVYDGEEGKDLYTKYMYIFDKVYKEEIIINESLIKEDLFDMYKSTIQEKTEENKDFPVELYIYERFLASLLLSCDYYSTSEFKNQKEVEEFGEIKNIEKFYKSFKSTEVYNWIRKYEKNDYGKTDDFSNIDDINVLRNELFLDAEKTMVSNIDKDIFYLEAPTGSGKSNVSFNLSFKMVERFKEINKIFYVYPFNTLVEQNIKTLEKIFKNNEIMKDIAIINSVVPIKIKSSKDNKIKEIDTNEESDILNEDYERALLDRQFLHYPIVLTTHVSIFNYLFGTSKDNLFPLCQIANSIIVLDEIQSYKNRIWKEIITFLACYSRLLNIKIIIMSATLPNLNKLVDGEIKTVNLIENRKKYFENPIFKNRVMVDFSLLEEKENIKEVLFNNVIKNTKAPNKNILVEFITKESAMDFYEKLKDYNKYLQESEKREIELITGDDNRVERNRIIDKIKSQKNIILVATQVIEAGVDIDMDIGYKDISMLDSEEQFLGRINRSCKNDEQGIVYFFDLDLASHVYKRDIRKQKNINLTCPKIREILINKNFQEFYDYVIKELNKKAGEYNNSSFQTFFLDKVKMLNFKEIEERMKLIDELYENNVFLNRNITLENEEELCGEDVWNEYIAILKNNKLDYAEKKIKLSQVTAKLNYFIYQISSDDFIYEDRVGDIYYIGDGEKYFEDGKFDRKKFKSIVADII

SEQ ID NO: 11548 - protein, 693 aa, Chromobacterium violaceum ATCC 12472
MGQVGGLLHDLGKYTEEFQQRLCGGPPVDHASWGAVVACSKYQSLGHLLAYGIAGHHAGLANGEERGERSSLRERMVSERPALDSRWQQEIALPEALPPPQGFKMDKARSGFQQSFLARMLFSCVVDGDFLDTEAYYRGFDLNPRPLRGASLSLSRLKVQLDSHLASLPVDGEVNRLRGEILHAARGKAGRPQGLFSLTVPTGGGKTLASLAFALDHALMHGLRRVIFVIPFTSVVEQTAAVFRQAFGDLGEQAVLEHHSAFVDDPGKAPEARDKLTQAMENWDWPVVVTTSVQFFESLFASRPSRCRKLHNIAGSVVILDEAQALPLAQLRPCVAALDELARNYRTSIVLCTATQPALSERDFVGGFAQVEELAQDPARLFRALERVTVRHIGEADDAALVARFAASPQALCIVNSRRHARELYQAIRHLPGVRHLTTLMCARHRTQALAEIKMDLREGRPVRLVATSLIEAGVDIDFPTVWRAEAGLDAVAQAAGRCNREGRRAAKESEVLIFRNPAWPPPPELRQAAQAAAETLRHHQGSPLDQDAIRGYFTQLYWDKGERALDKNGLLALLSACRVYNLPMERLDRDFRMIESALQPVIVPFDDASREALAKLAYTEGCGQLARALQPYLVQIPCRAFDALRAAGAIQPVNPSRFGDQFMQLLNPALYDAEHGLSWDDPTFVEAEKNIW

SEQ ID NO: 11549 - protein, 778 aa, Porphyromonas gingivalis W83
MQNNKMINKESPILAKPSGITLDVHAENVIQEGALLLKGLGCTKEKYFQTTAKQIVQRVELACKYHDIGKRNKIWQDACKKDYKAYLIWKKIHPNKSFEDYTIECREEAGKFLRQTHVRHEFYSIKGLLNNNPPPNNNPPYWLKIAIAAHHRKLSMKHEERWLSSDEDICSVWKDIRRLSNYFFDDRNSVLSDIAIKQYEFAGPRSLLQLADHRASAKEESKCIPDPIAFSYTFPEKWEKRPVQKLVEKHWRDELLLVRAPTGAGKTDAALLWASHQIKHRKADRLIIAMPTRFTTNALALSVSSTLSSTGLYHSSAWTQNFSSKIDNGEIALEQARYYHNQARLLQTPITVCTIDHLLSSLTLCDEEHQTITFALANACLVIDEADFYDQFTQANILVLLEVLKYWKVPILLMSASLPDNIVQEYRKIGYDIKHILEDTSDIERARFSLIEKRDVSEISQMQDLLQLCLDRGSAIIFANTVDRAQAYYQWFLENGHEEEVILYHSRYTETDKIEKEAQLLLRLGRSAWDNDRANGVAILTQIGEMSVNISADIMISDLCPIDRLTQRCGRLCRFSRKIGDLYIIRPMREGNLFPAPYYQNVGPSQKLEPNDALIQTDELLEKGMYSAANLVQLLNKVYANQTVFSTEASRNADRLREMFKANWLINPIEYLDEEIGSTNFWRARNIMPRCRIYIKRPLQSFRNYSDFRRWETDVAIDIPIYVIKKAMRMSDTVCSQVKVCIGKNDYTLIVINAKCYNNVRGLFFSESVLEEPNFEFL

SEQ ID NO: 11550 - protein, 755 aa, Nanoarchaeum equitans Kin4-M
MKCKSHPNKLLDQHIKEIKNIFNNLVNFYDIELNETEKKLFDYLIELHDIGKCRKEFQEYIKKLEKGEKPKSPGSHSLWSLEELERILSKIDLDKEYLPLLFYFIAKHHSNLSLSNTDEKLKRQIAKLILKLNNLLNNQPEIDLLLNQGFFEIYYKGLLKKFEKEELIKLADLFGVFKISDILSAKNILDKVNEIVYKEEITERKVEQLIGRSIDEERWGFQKCLSKFDYLSLRAPTGWGKTTTALLFALNKDYNKIFITLPTITAIEDFRQKLKNAGFKAEEYFYFYDARAILDEEDERLNSLYFVQNLYSPINITTIDQILLSFLQAGKYFMKRLNLRKSILIIDEIHLLTPQMLFLLKKLLEHLVPLYKIRLLLMSATLPKGIIDYLSENINIKFEFVDIYELEPKYRNRERVEIELIKKDISENIERIVEENKKGKSVLVIANTVEKAVCIYKRLKEEYNINNISLLHGRFMFKHRKEREREIRDLLENKGILVSTQVTEVSLDVDFDVLFTEAAPISAIVQRLGRVNRYGKKSKSKVYIYYPKEIDKIEEDRRKKYPYNIEEIKKSWKFLEELDNFKEGIFIKKIDEVFTKEFYEGLIKGEEIFFKFREVFEDRKSQNNIHWFLQSTSEEVGKKLLDFRDNVTTLIIPYGDLVEAEIYDEITKILEEYKKLKEKPYSYDEWKKFFAKAKAHAVSVPLYLVLGLDPDKVGLPVINKLKEDYEFKYFKECGFVNLKKLKEMGCEFDSDYTYQ

SEQ ID NO: 11551 - protein, 750 aa, Leptospira interrogans serovar Copenhageni str. Fiocruz L1-130
MILLAKSYPGIEKQLKSGDPESWALLEHHSSATYQVAEVLLKILEPILRKWTRLSESEYNKFVLVVCLSAGLHDLGKANEDFQKMLRRRKYLQRFRHEIWSVLALTGSGPFSDWFRKTIGDETWVRIGQMGILSHHLKATRETLYADHETAEIKVFWKDQGVIKMFQSICRLAGISSPDFSSPSISSYTCLGEDADKSIRIWTREILNARIDPRYQHSIGAVRAMIIAADRLASAYKGADALKLWATEALNRVLSEQECSKIVKQGLGEKNLRPFQKQVGDSTSRVTLVRAGCGNGKTIAAFQWAKTHSAGRKLFFCYPTMGTATEGFRDYVSDIPGLDALLSHSRASLDLGELASTGEEDEGDSLNMHSRMLQEWTAQVTFCTVDQILGLLQNYRSSLTLSPAIFLGAFVFDEIHMYDSILFGNLLTFLKEFSHTSILLMTASLPETMLSAIQETVGADLGPVISGEAQIEERLRYRILHSSREDALQKAIQEFKNGGRVLWVCNKVEHCLKLYDELSEKYDIEALVYHSRFKYEDRKERHRAVIDSFQEGYKKSLPVFAITTQVCEVSLDISATLLISELCPFAALIQRLGRVNRPGQEMEGIAQALIIPFQGKPYEKENEDDGESELERCKEILKPLLDRELSQKDLALALENAKGTEHQKIPSQWLSLGWEAEPDSIRESGYTLDVILESDAYKVLKNERPWEKSKLYTIPMPIQKQFSYGEPPLRIPVVPDSQIQYSSVRGGEWN

SEQ ID NO: 11552 - protein, 786 aa, Thermus thermophilus HB27
MGRKEVLRGDPPLGTLAQGLGTECPNRFSSSTTAFAALREPPGVSARTWGSRIALIIGCMDPKAHTPNPQGAWHALKDHLEAVSRLAGGFAQHFGTPSLGQALALLHDLGKATRDFQAYLKVAAEGKRTNSVPHAVWGAALAYVALGSGQHEGWEAFGLPVMGHHAGLPKRGEAASKLAQALKEEPFKEVAAFLRSSELRTRLEGLLNEALKEVRSKTAGDPLRLDFLVRMAFSALVDADYLDTEAHFDPSVARLRQEGYSLEKLWARFHRDQEALLQRVRPSLVNSVRREVYEACLQAAELSPGLFRLTVPTGGGKTRSGLAFALRHALKHGLRRVVVAIPYTSIIDQTAQVYREILGEEAVLEHHSAYEPPLGEEQEENVLRQRLATENWDAPLVVTTTVQLFESLFSNRPSKMRKVHRLARSVILLDEVQTLPPELLKPTLEALRLLATPVEEGGYGATVVLSTATQPTFEVVPTFQGLPVREIVPDYPRHFARLQRVVYERRPKPLSWEELARELQARPQVMVVLNTRKDALALLEALGEDPHAYHLSTLLCPAHRREVLEEVRRRLREGAPVRLISTQVVEAGVDLDFPEVWRAIGPLDRVVQAAGRCNREGRLDKGKVVLFWPEEGTTPRGPYRVGVEKARLLLEEHPPERLHDPGLYQAYFKELFTTVKTDKGIQEHRKDLDYPEVARRYRLIQEDTVSVVVPYGEGLARLEAFQKAPSLQNWRRLQAYVVGLFRNQVRERRGFLEAVPGFQDLYVWRGSYDPRRGLVEEYADPSDLIV

SEQ ID NO: 11553 - protein, 702 aa, Desulfovibrio vulgaris str. Hildenborough
MANLAATFAEAFGAREWGKAAGLLHDAGKATAQFTQRLEGRPVRVNHSICGARLAQEQGSTCGLLLSYAIAGHHGGLPDGGLQDGQLHHRLKHERLPADVSPPSVDIRPDVLKPPFTCRPEHPGFSLSFFTRMLFSCLTDADFLDTEAFCTPEKASARNGRSALGLVALRDALNTHLDTVERKALPSRVNDIRKTVLHDCRARASETPGLFSLTVPTGGGKTLSSMAFALDHAVTHGLRRVIYAIPFTSIIEQNAKVFSDVFGQDNVLEHHCNYRSKDEPEEQGYDKWRGLAAENWDAPVVVTTNVQFFESLFSNRPSRCRKLHNIARSVIVLDEAQAIPTEYLEPCLYALKELVGQYGCTVVLCTATQPAVDDASLPERVRLHHVREIIADPQRLYTDLKRTEVTLAGRLTDAALAARLDGHGQVLCIVGTKPQAQAVFSLLQEREGAFHLSTNMYPEHRRRVLGTIRQRLADRLPCRVVSTSLIEAGVDVDFPVVYRAMAGLDSIAQAAGRCNREGRLPEPGQVVVYEPEKPARMPWMQRCASRAQETLRTLPEADPLGLEAIRRYFGLIYDVQELDRKDIFKRLRGQVDRDMVFKFREIANDFRFIDDEGTALVIPTGPEVEDLVRRLRGCEFPRPVLRKLQQYSVTVRHRELEKLRSAGAVEMIGDAYPVLRNLAAYSEDMGLCVDSVEVWQPEGLVS

SEQ ID NO: 11554 - protein, 760 aa, Mannheimia  succiniciproducens MBEL55E
MTNTKKVYYAHSEKDLPHEQWQTFSSHAENVAKLAAQFAEIFDAYQLAYNTGLLHDLGKYTPAFDKRLHGGPSVDHATAGAKIAIERWGFPLGKILAFCIASHHTGLVNGDGEGDNRSTLKQRLSVPFGKGNLPELDPIWQSELPLPEKLTFPALKPDPYYQPFALAFFIRMLYSCLVDADFLDTEAFYANLKQQDIDRGNAPSLDQLHQQFNRFISDFRERKKALQPQTEEEQRNAKLNRLRSQILDHAIAQAQQEPGLFSLTVPTGGGKTFTSMAFALEHAKKYGMLRIIYVIPFTSIIEQNAQEFRKAFGEFGEAAVLEHHSTFDDEKLLDKDTKDKLKLASENWDMPIVVTTAVQFFESLFADKSSRCRKLHNIANSVIILDEAQMLPLNLLLPIMQSIKELARNYHSSIVMCTATQPAIQTQHGFYRGFENVREIAPNPTALFADLRRTSVQHIGMQSDKDLIDKLTENQQILIIVNNRRHARSLYEQAKQLDGTFHLTTLMCAKHRSQMLEQIRQHLQAGRSCRVIATSLIEAGVDVDFPLVMRAEAGLDSVAQAAGRCNREGKKLAEQSFVWVFQPEQQWKAPTELGLLSAAMRSTVRCYGDNLLSVEAISHYFSAVYEQKGKDLDNKQILAKCHAAGKTLDFPFQTIAKEFCMIESHMLPLIIPFDKEAEKRIEELRHAEKVGGLLRKLQPYTVQIPQKSLEALFKAGRIEAINEQQFGNQFYSLIGLDLYDEVAGLDWGDLGFITIENSVF

SEQ ID NO: 11555 - protein, 881 aa, Methylococcus capsulatus str. Bath
MLSHEHVGFWGKIRLGQNGQTDQWLSLSQHSLDVASVFAALAELPAFHHKLKVSSGIELDGIQLQRLAVIALLHDVGKANLGFQDKVFDAKAPRAGHVRELAPLFDAPELCEAFATALDLDEIADWFDPPDSIEQFLLAAWSHHGAPVRFQTGDQTGNYYLARTRWWRADATRDPMQAVAELMRIAKQAFPDAFKRGVARIPGRARLQHRFAGLVMLADWLGSHQAFFPLGRLLDIGFARNAARRALLTVGLDTASLQSDLAQRPTTFKHWFGFEPRPLQSAVDQQAPDDAESRLLIAEAETGSGKTEAALARFFRLFAAGKVDGLYFALPTRVAARELYLRVVNYLEQIFPKPECRPAAVLAVPRYARIDNVPIDKLDRLLPDDRILCHDDPDRLRQERQWAAEHPKRFLAATVAVGTVDQALLSAVQTRHAHLRSVCLDRSLLVVDEVHASDVYMRRLLRGLLSHHVGLGGHAMLLSATLGAWACAEFLQACGCTTLAAENYAGACAAPYPALTLLSGIRRSVGFARGGSVKRVRIDPRSWLKQPERLISELVSALEAGARVLIVLNTVGRANALQRALEQHPAIQKVWLFRCQDSICPHHGRFAPSDRELLDQAVSRRWGKGTPPGPLVLIGTQTLEQSLDIDADWLITDLCPADVLLQRVGRLHRHACTRPPGFEAPRCTVLMPDCASLAEWLDARGEASREAKRAGFGSVYADLRTLELTRLMLLEQTEVEIPRDNRRLVEGATHPERLATLSGPAWGKHGQNVEGLTLAHNIAAFHVAAQYDRPFGELSFNELNEKARTRLGLDTLRIPLRQPSPGPFGAEIAEITIPGHLAPRERDDETAELIRRGADGMILRYGERHYRYSRFGLEPFDESID

SEQ ID NO: 11556 - protein, 893 aa, Haloarcula marismortui ATCC 43049
MQNPSGCEICNRPESTDGLWCSSEMTTIYSHPPENGSEGVVLDDHLNDVAARVEYVVPPGARTPAGEPLRPVVKTLGYVHDLGKATTFFQDYLLDDRQPDNELLRHHAPLGAFAAYFALDARGFDTETCLAGFVAVAKHHGSLPDITDYIHTRAHRREGVEPRERNSAERRQNAVAKQIKNIDDNARELVSTVFEAATAGAEEWASFRDGFGELLDDIADTVAATGTTTGINRDALSSSCYGLVIQCWGSLVLADKTSAAGARNVAETYTEDQPSLDRLNDHIADIEASVSADPDGSQSERLNHLRSMAREDVLDNAADLAKAGGGVATLTLPTGMGKTLTGLSAALDIRDNLGGKRVIYALPFTSVIDQVVDDVSGIYDTDDHPHLLTAHHHLADASIEDNADADEADRSDDVAGMLGESWRAGLTVTTFVQLFESLAGPGNRQSMKLPALRNSVVVLDEPQSLPLDWWKIVPRLVKMLTEQFGATVIAMTATQPKLFPESPELVEGPEQYFEEVSRVSYHLDASTDRYIEARNEGDPKSYQDAATNLSEQLTAGTSALAVCNTIDSARHLTERLVENAPDAVDVAEQYDDVLRKKELTTGEDVAKRVQSVGDRAILHLSTRLRPADRLTLVDAAKELTEAGHPVAVVSTQLIEAGVDISFDRVYRDLAPIDSVVQAAGRCNRSFERDRGHVTVWWLAAPPDVEKTPAEAVYNRGTSLLPVAADTLASVRSDDGELTERAVARDAVERYYDRLHDDKCVGKQAYADYVDNARADKLSDLSLIDQRPSVDVVICRTDADHEIVESVRNAANAYDFDAFSDAIDETKSLRISVPVYPGDDETKEALNSLVPLVKNERFNRATGVRVLDVRRFENHFDQRTGFIVPDSTVAHQFI

SEQ ID NO: 11557 - protein, 763 aa, Xanthomonas oryzae pv. oryzae KACC 10331
MAFYAHSTQRRDHSDWQGLAEHLNGVGERASVHAEAFGGQVMARVAGQLHDLGKYTEKFQARLAGDPTRVDHATWGARKACELYRSGGTLLAYGIAGHHAGLADGRRDDLTSRPSLHERLSDEYCAHALPPLLPDWEREVMLPAKLELPTGFRGHPRTERRAFQMTVLARMLFSCLVDADFVDTDDFYRRVEGRKTRAEQAGTRLTLEELRERLDSHLAGLSSEHGINPIRATILRQARSKAHARIGLFSLTVPTGGGKTLASLAFALDHAIAHGLRRVIYVIPFTSIVDQTAQVFRKALGVQDRDDVVLEHHSAFFDDPAKALQAIDKRKLAMENWDAPIVVTTSVQFFESLFADRPSRCRKLHNIAGSVVILDEAQTLPQTLLRPCVALLDELARNYRVSPVLCTATQPALRQDQGFPGGLEQVEELVAEPKVLYAQLRRVRVRHVGALEDDALAEELRQRTQVLCIVNNRRHARALFDAIAEQPGAHHLTTLMHARHRIAALTRVREELKAGRPCRLVATSLIEAGVDVDFPTVLRAEAGLDSVAQAAGRCNREGRRPTDASEVLVFSPVNWQPPQELKVFTEVFREIERTHSGDLLAMEAIHAYFQRLYRRLGDNLLDDEAILTQLRTADLGDLPFDTLAQKFRMIQTTMRPLIVPYAPYVTDRNAAEREVAEVNEVLRQLEHADRIGVAGAARRLQPWLVQVPEQAYRALWQASAIAPIAPERYGEQFVCLRNSRLYDARFGLHWEDPQFLDAQALCP

SEQ ID NO: 11558 - protein, 944 aa, Thermobifida fusca YX
MPEHDSTDDKHGIPPLDLRFWAKERGLRGKTYPLVCHSLDAAAAALVLWNEYLSPGLRDTIASSMETDEEHAGHCIAFWAGLHDIGKLTREFQQQIAIDLSAYPGEELSGEQRSHAAATGKWLPFALPSLGYPNGGLVTGLVAQMLGGHHGTFHPHPSFQSRNPLAEFGFSSPHWEKQRHALLHAVFDATGRPTPPDMLDGPTASVVCGLVILADWLVSQEDFLLERLTSLPADGSASALRAHFETSLRRIPSLLDAAGLRPITVPPATFTESFPHLSKPNGLQASLAKHLPCLCTGPGLVLITAPMGEGKTEAAYHVADLLGKATGRPGRFLALPTMATADQMHTRLKEYARYRVENTDLPRSSTLALLHSMAWLNPDYAPADLPGVSKVLSNLGHRDPFAATDWLMGRKRGLLAPWAVGTIDQALMAVLRAKHNALRLFGLAGKVVVVDEAHAVDPYMQVLLEQLLRWLGTLDVPVVLLSATLHHSIANSLVKAYLEGARGRRWNRSEPQPVSEVSYPGWLHVDARIGKVTRSSDVDPLPIATTPRKPLEVRLVDVPVKEGALNRSTVLAKELTPLVKQGGCAAIICTTVAEAQGVYDLLSQWFATLGEDAPDLYLLHSRFPNRQRTEITATIVDLFGKEGAQSGRRPTRGAVLVATQVVEQSLDLDVDLMISDLAPVSLLLQRAGRCWRHEHLGIINRPQWAKQPELVVLTPEQNGDADRAPWFPRSWTSVYPLALLQRTYTLLRRRNGAPVQIPEDVQQLVDDVYDDDSLAEDLEADMERMGEELAQRGLARNAVIPDPDDAEDNLNGLTEFSFDVDEHVLATRFGAGSVRVLCYYVDTAGNRWLDPECTVEFPEQGTGREGRFTMADCRDLVARTIPVRMGPWASQLTEDNHPPEAWRESFYLRDLVLIPQRVTDEGAVLPTETGGREWLLDPCKGLIF

SEQ ID NO: 11559 - protein, 843 aa, Methanosarcina barkeri str. Fusaro
MNLEYKQLFQEATGFEPFPYQELLATRENLPELLKVPTGAGKTSGVVIPWVWRRRFAEESIRIRTPRRLIYCLPMRVLVEQTYENVISWLDRLGLLAGSASWKKPEEKTGLIEYLPEHRQPDNEKISVHLLMGGEDAGKWAEYPERDAILIGTQDMLISRELNRGYASSRFRWPLEFGLLNNDCLWVMDEVQLMGAGLPTSAQMEAFRQGFGTFGNYHIIWMSATCEEEWIKTVDFKKPKLDQLKISPEDAKVEMLHKRLTAFKKLEKASITLKNTKKEDSSKEYIDKLSRLIQTQYQQAESAPSIVVIVNTVNRAQDLYKKLIKEYQSKSGTDTLEIFLLHGRFRPPEKTEIFNNFKSATNKNKGKILISTQVIEAGVDISAHILITELAPWSSLVQRFGRLNRYGEYDDSIVLWIDIDTKKDSQVALPYSVQELNIARSKLKGLKEVSPQTLDEITQPPMDAQRHVIRRKDLVDLFDTTQDLTGNDIDISRFIRDSEDRDVFVYWREWEENKPPEDYKGPLKEELCQVPIADFRNFLKNKKEQIWLWDYLEGKWINPKPNNIHPGQTFLINSQAGGYDLKIGWSKDCKDRVPQRFSGSGNNDSTSSDPGVNSGKWETIAKHADNTLKQMEKLLSDLEPIAWEHENTLKNAAYYHDIGKAHEVFQKAVLSDIDEDTDNMKEKLWAKSDRNSGIKYERKHFRHELASALLLLQNEDFIEDLGSNNVNLIAYLVAAHHGKVRLSIRSVPGETAPDNLEITRFARGIWEGDIIPEIDLGNNVKIPSTTLDLSLMEIGIDKYGNPSWLERMCELRDNLGPFRLAYLEGLVRIADWRASSLQEGSDE

SEQ ID NO: 11560 - protein, 814 aa, Carboxydothermus hydrogenoformans Z-2901
MVYYSHFDTGAEKLLKDHLQEVTASMVKKFQGLPGLDREAFLKSLKAAGLGHDFGKYTSYFQDHLVNKKAVGPLSHHAFLSAVWASAQFLNENIEGSHQYLALLIFLAVLRHHGDLDHPLNNLASKRALRENAVYNESLKNKLEILKMQLEDLLLNPEIDRENQELWQKHGFKYLPLGEFTRNYQDYLGRLYTLYQDLTEEEEEIRFLFYFATLYLYSLLIDSDKKSAAQALKEFARKELPFSVMAEYQKELSQKAEKSYVNTLRQNLFAKVISNVEKHFEGEIFSLTAPTGSGKTLAGLGAAFKLRELIAREKGYTPRIIYALPFTSIIDQNYEVIKRILETKVTDFPENESLYLIKHHHLADLSFRVEKEEIEVEKALLFTESWESEIIVTTFVQLFHTFFGFKNRLLKKFHKLSGSIILLDEVQNIPFEYWGAVREIFLQAVKLLDCKVILMTATKPLIFSPEECIELAGTEEEIAEMFGALNRVKLSYLPEKMTIAEFVRSFKEKYSKDKSYLIVVNTIKSSIELYRKIKELDLGIPLFYLSTNITPKERSQRLLAIKQLNQQNKPFVLVSTQVVEAGVDLDASCVIRDAGPLDSVIQVAGRCNRSGQKELGEVILMNLITDEGKDFATRIYGPVLLKQTRELLEEAREIEEKAFGNLIGGYFLKITAEKLLSDSQGKKTLEAILNLSFADAPDGSPVISDFKLITEIPFYVDVFVELDEEAKLIWEEYKKGVIQESDDQKRRTNYLKLKSKLAQYIISVPGLEKNQSNIRGLEQAGSFFRLPLEYLEDYYSLETGFKRVTLGREEFEIL

SEQ ID NO: 11561 - protein, 692 aa, Pelodictyon luteolum DSM 273
MILANSTRPGRNISAGTMGIIPRRMMGKIDHSAAGAIHAVQKHALIGKALAYLIAGHHTGLPDWYREPGTGGQTLPERIENKDHHHLQHALQGKPPADILEVSLPTTHPCGSPTPAPELMHLWIRMLYSCLVDADFLDTEAFMNPDKAQARLHAYNLSELKDTFNHFMARKQAGAKDSPVNRARNLILEECRTNAALEPGLFSLTVPTGGGKTLCSMAFALEHAIRFQKKRIIVAIPYTSIIEQTADQYRQIFGNDAVLEHHSNLDPEKGSGKYRLASENWDAPIIVTTNVQLFESLFAAKSSACRKLHNIVNSVIVLDEAQMLPTGYLQPVVSVLELLAEHFRTSIVLCTATQPVLSGRVGTGQNVLKGFKNDGVRELMSDPDNLFKVFQRVTVNMLGDADERHEWDKIAEAITTQRQALCIVNTRKDCRELHGLMPEDTIHLSALMCPEHRSQVIADIKSKLIDGESVRVVSTQLLEAGVDIDFPRVYRAFSGLDSIAQAAGRCNREGKHERGDVLVFNPPKPPPPGIMLKAEQAGKEMFRAFPELATTLMPRAFRQYFSLYYGRLNSFDVQKIMELLVADAPQLNIQFRTAAMRFKLIDDKSQHGVIVRYRSERIDSNPLIDQLRYGGPNRKLMRQLQRFSVNVYDKDLMQLRNNGLIENINGVWVQLSESAYHPVFGLNVDATLDYYW

SEQ ID NO: 11562 - protein, 722 aa, Geobacter metallireducens GS-15
MRERPVAHLAEDGRVHGLEEHLCGTAYFAAAFAGEFGCAGWGRLAGIWHDLGKYSHEFQRYILDDGPRTDHSSAGALYAVQRLGKLGRVIAYLVAGHHAGLLDWADNTGSNLERRLTSTDLLARVVLSELPPNLLEQQIPAERPKPPATDLTASLWLRMLFSCLVDADFLDTEAFFNPAPVGQRSRFPTIEELLPLFDAYMADKQATAFDTPVNRLRAEILRQSVGKAFHSPGFFSLTVPTGGGKTLSSMAFALNHARAHGKRRIIYVIPYTSIIEQTADQFREVFGDSVVEHHSNVARQDSDEEGQRLRLASENWDAPVIVTTSVQFFESLFASRTSRCRKLHNIVNSVVVLDEAQLLPPDFLNPILEALKELQKNYGTTVVICTATQPALGPHQSANFDFKGIPEITEIMDDPAKLHVKLKRTRIHKLRDLAPVSWDELAEELEWQDSALCIVNRRDDARTLWEKMPKGTIHLSALMCGAHRARKIAEIKERLRNREPTRVISTQLVEAGVDVDFPIVYRAAAGLDSIAQAAGRCNREGLLEWGEVFVFTPPSKIPAGHLQQAAGIGMRLLAEAESDPLSMERFEAFFREFYWMRGDRLDRENIIGLLRNDVGLRFSFRTAARKFQLIDESAQAPVIVQFENDELLSLLERQGPERWLLRKLQRSVVNLPRYLHNRLLSEGAIRERCPGIFVQAHGALYHPDLGFCPDKSIVYEPDELIG

SEQ ID NO: 11563 - protein, 724 aa, Moorella thermoacetica ATCC 39073
MEQFLAHTANSQGKEQSLLDHLEAVANLTQKFNEPLGVPHIGYRTGLWHDLGKFHPEFQAYLQGEGGRRGPNHSSAGAMLASKYFEPLAFVIAGHHGGLPARAELKTRLKDKVQLKRYNTALQNARRVIPSLEPKQPLDMELPPFLQEGAGVDVASRVELFLRLLFSSLVDADFLDTERHFDPSLTKLRQKEASIANLWSLLAANQQRLMDKSGGHVNQIRREIYEHCCRAAELTPGFFSLTVPTGGGKTRSGMAFALLHALRYQKERIIVAIPYTSIIEQTADVYRDIFGNANVLEHHSAVAPPLDPENPTPEELWARLASENWDATLIVTTTVQLFESLFSDRSSSCRKLHNIANSVIILDEVQTLPVHLLEPILDVLQQLVHFYGVTVILCSATQPALETSPFFRGLQGVREIIPDPQKYFALLKRVGYQVPAGNEKWSWEQVAGVIRQSRQAMAVVNTKQDALALLEALDDPEALHLSTLLCGAHRRKVLQEVRRRLGNGRPCRLVATQVVEAGVDLDFPLVLRAVGPLDRIVQAAGRCNREGKLQEGRVIIFNPEEGCLPPGSYKTGTEIAATLLASVTGVDLHDPGLYRIYFQRLYQSCTLDAKGIQASRRSLNYPEVAQKFQMIEQRVVPVIVNYHEGPDDRRVDELISALRHRGVSRLIMRQLQPYLVNINAYTVNSLQREGVVQEIFPGLYEWLGGYDEIRGLVTTARDPEELVF

SEQ ID NO: 11564 - protein, 885 aa, Rhodospirillum rubrum ATCC 11170
MRGIGGWALNDVTGSAAEQNQESRKGLYGAPWGKSRDGESHHLAHHCADVAACFEAMAALPGVRSRLERAAGGPLSEVDIARLAVLVFLHDIGKLHPGFQAKAWPEGLWTGPRHGHMREGVEIFQHQAPPDIVRSLHLEKLIEWGVDWNLLFSVLAHHGRPVSMEGGRPPCWRAVAKAGYDPGAASAEVGGLIPRWFAGAFVQDGRPLPSMVGFAHLFCGFVSLADWLGSTRAVFPFKAELDVDYMEKARKKAGAAVAAIGLDPRALQRKAAGRADFATLTGIDTPRPQQQLVGAFPLAEPLVILEAETGSGKTEAALWRFVLLFAAGKVDSLYFALPTRAAAIQLHARVNKAMARVFGADAPEAVLAVPGYLKSGVVGGHALPDWGVRWDDDGGLDESRLLARWAAESAKRHLAATIAVGTVDQAMLAALQVKHAHLRGAALSRSLLVIDEVHASDRYMVEVQTHLLAMHLGHGGQAMLMSATLGSLARTKWLGRKTSPSFEEAVATPYPAVWGKGEVAPRGGIGKGGEKSVAIGLVPSWTAETAAALAIDAARSGARVLVVRNTVRAAISTFDRVRQAGGEDLLLTVAKGPALHHGRFAPEDRALLDGAVEAALSVDQATRTPGGRIVIGTQTLEQSLDIDADFLITDLCPVDVLLQRIGRLHRHALSRPSGFEVPHCRVLMPEQGLEIFLPPFFENGLGGWDERGVLNGIYRDLSVLELTRRLIAAYPEWRIPAMNRFLVESATHPERIEALHRELGRPWETYWANVCGKDIADAGAARNIALPIGTPFADMRYPDPDKEERIRTRLGAEGARILFSGPVCGPFGVEISGVTLPPPWSHGIDGGTVVAPIALDGVLHFQAGGTKFEYGRRGTVRSYRLLEIS

SEQ ID NO: 11565 - protein, 752 aa, Rhodospirillum rubrum ATCC 11170
MYYAHSLETGGDKTRWQPAADHAFATGHLAAGFAQSFGAEKAARLAGLLHDLGKYCRAFQARLEGAPERVDHATAGAITVRALLAGSSDRWDRTLGEILSYVIAGHHGGLPDWQGLADRLKADLSGLDPVWRDEIAVAPQGLAPSLTPHPSKERLPFQLAFLGRMIFSCLVDADFKDTEAFYEREAGTRSDRLWPLLPAIIDRLIARFNDHMATKAPLAGEPVSAVTLLRQDVLAQARARAAMSEGLFTLTVPTGGGKTLASLGFALDHAKRHGLERIIFAIPFTSILDQTAAVFRDVLGEGVILEHHSAIEAEEKARREPPQQRDKLRLAMEDWAAPLILTTTVQLFESLFANRPARCRKLHSIARSVIVLDEAQTLPLPLLKPCVAAIDELTRNYKASVVLCTATQPALDRRRFAAGDDMGLDLAGRELAPDPGALAARLVRVTLRQAGVLSDEDVVTDLADPPQALVIVNTRKHALALYRRAVEAGLEGVVHLSTRHYGAHRRAILDDVRQRLDRGLPCRLIATSLVEAGVDVDFPRVWRAEGGLDQIAQAAGRCNREGRRPVEDSIVTVFRAADHKPPAAVAQLAAAYGRIAQNHANPFSPAALEDYFREVYWSKGPGLDEHKILKAFAWDRSGGTLNYKRVAEDFRMIDSGMAPVIIGRDAQARAALALLGRPDARAGQVARLLQPYLVQVPPPARMALITNGHVRFAEERSFGDQFAVLTADSLYRDDTGLLWEDAGYLDLEQSIF

SEQ ID NO: 11566 - protein, 743 aa, Hahella chejuensis KCTC 2396
MKMFYAHSTPDTSKQDWQLLSEHLSEVGRLAKKFAAVFGCGVENLADISGLLHDLGKYTDEFQRRLTGETLRVDHATAGAKLVVEKYQSLGYLLAYAIAGHHAGLANGVNGVNRTSLEDRLKSETYKLSEVWRSELNIPEQLPLPTRFHARQNRNFFQLAFLTRMLFSCLVDADFLDTEAFYLQAEGESNSRGEYPSLADLKPELDSFLSGFKDEGKPVNRRRREILQTVRCNAELDPGLFSLTVPTGGGKTLASLAFALDHALMHKLERVIYVIPFTSIVEQNAAVFRQALGKRGEGAVLEHHSAFIEDRSKDPEAREKLKLAMENWDAPIVVTTAVQFFESLFADRPSRCRKLHNIANSAVILDEAQTLPLKLLKPCVAALDELALNYRTSIVLCTATQPALHECDNVEDSFVGGFRNVRELAPNPEQLYRDFKRVSVRHIGVLDDEALTSMLLERKQALCIVNNRRHAKAVFESIRSEPGARHLSTLMCAKHRSQVLAQIRKDLKQGKPCRLVSTSLIEAGVDIDFPTVLRAEAGLDSIAQAAGRCNREGMLPADECEVLVFNPANEDWAPPVELEQFASVSRGVMRHHADPLSLAAIEDYFQHLYWRKEKELDAHDLLGLIASAGIKGLPFETLSSKFRLIESQQMPVIIPFDDIARKGLDALDYAEGCVGISRCLQPYIVQIPQVAYQALFDAGAIVAKAEERFEQQFVYLANMDLYDKECGLSWDNPTFIRAEKQVW

SEQ ID NO: 11567 - protein, 795 aa, Methanosphaera stadtmanae DSM 3091
MLSYTDKINELYSHPQKPLTEHLLNVAENSRSIFENLNIENNSFYASLSFLIGLCHDFAKCTSFFQKHLFGIENSEKAYHSFLSAIFGYYVIKKYIKENEIKEELNYPIIGYICIINHHGNLKDVYNTEKSEFNKINQIPQYLDEQIKDIKSRNISSLKEFYLKYNISIDDFLEEYEEIKSVIKKDLKIIYREKRIDNYFNVLILFSVLLDSDKLDASYTETYPRQELNANLVDLYKQEKFGQYEGINEIREEAYQELTSSLENIDLNNKIYSITLPTGSGKTMSAFSFALKLRRKIKNEKNIIPRIIYTMPFLSIVDQNEEVLRKILNYSNYDTSDILIKHNSTSELSYVVNKNGTTKIQDDPTEKAELDVDKAEMLLEGWYSEIVITTFYQLAYTLISNKNKALRKFHNISNSIIIVDEAQSIPAKYNQIFKTALDYLSKKFNVWIIFMTATQPEIFKESDGILPLITNEQKYFDCFDRVNYVFHHTPMTIDDFKEKIVDIIQENNKDIMIVLNTISSSTEIFEYIQGYFDEEGIELYYLSGNIIPKEKLERIKKIKESNNRKVIVTTQLIEAGVNIDVDIIYRDFAVMDSIIQTAGRCNRNDKKEKGTVNIIHLINENKREYSSFIYDSTLLRLTEELTKDYTEISEKDFNLKISKKYYTEVNNRISHDASHNLEKIISTLKISNITHEFKLIEDDIEKIDVFIEINDEATEIWDKYNEIYSDKNLKNYEKKLKLKKINRQFNNYVLSIPTNLIGTVNYDKFIFHVGKNDIERKYNLNTGFIAQENENAYMI

SEQ ID NO: 11568 - protein, 917 aa, Methanosphaera stadtmanae DSM 3091
MDSNDMIYSTRYDFNKSCIILNNNEFEIYAHPNELLHEHSYKTWIIFKELLDESVLTSFYSFFNKKNYLDMNKDEFLDILKVFVYYHDIGKVSFSFQIKKLTKKDTEDRTRRYSQLKSIYGDLTNNLLNMDSKHSFYGYYLFMNYVLHHYNIENNPILLLLSYCILGHHTKIKEINLENLEKKVPTMVCLNNFIFNQEHYLKNNEIKENISNIDNHINQLNKLLNENKTNNSMFSCFYQYIYSLLISADALATSQYDKNEIDTSSINNRIDSKLRKRMLDKYYSCEINENINEGIYNKIDNKINRLRHNMLIEASTNLIKCIENNPSQHTFYLNMPTGGGKTNTSMKLALDILEHTTADRIIYAMPYINIIDQNYEIIKDNWDLVNNEEIRNICSTNSFIFDNKNEDDMGDILINDDFFNYPVMCTTFVRLFDVLLNTKKKSKYALSSLANSIIILDEVQSLPIKNWTSLTYILDSITKNYNIYFILMSATLPKFDKLLLENNDSNNYKINCEYLIKNPSIYFNHDIFLKRNEIKDKIREFSLTDTENKKELVKYLSKVIEENFNQEYTHGLIVLNTVKSSKIIYEIIENLREYFKLEVDILNSTTLKYKKRELIEKIDNLKPKERYILVSTQSIEAGIDVSFDFVIRDFATIDSIEQVRGRCNRGNTDKKGNIYLIKLKMNNKTTYEIIYNEDELKTRIITSEELFKDKTNLNYDFNDLKKYYDNISCKINEKEISKDNTDEKSDFKNIERWNTIKYSEFKEKSGIKIIDDRNEIAFYIEENISEENLEKYFDKNEIKFLKEKNLIKNNAINSIDILECYLDEIKEIEKNQYIKYKIITKQYGSIMSNFIINTYRNEALLEEYKNSESYHTYKDKFYFYIILNELIGDDESKMYSLNSGLNKSFKYREDILTNRFM

SEQ ID NO: 11569 - protein, 962 aa, Frankia casuarinae
MGLSIISGMGVFMDDEFFGMIWGKSAEKAGGSMHLLLGHLLDTAAVGELVWDRFLASTIRDRLDDCSDGRGRSLFALLCGLHDVGKATPAFQMKDEGLAQRVRAAGLGWRGVTPQQGRQWHHARAGAVIVRKYLPQVGWSRPGCDWVWPLVAGHHGLIPDRGRLVHKPAVHGAGPWLDVQRAFVDRVAGDLNVDLASFSELRTPSRGGQLALSGMIIMADWVASDKEHFGGLSDLAEISMKGSRERAQRAWAQLGLRGGWRSDRPAPGNQSDLVHHRFGKPARPAQRAAVQAVREMPGPGLLILEAPMGEGKTEAALAAAEVLAGKVGADGVFVGMPTQATSDPMFSRVRGWLTAVDPEVPIGLLHGRARFNKEWAALRSQVRFVDVHDDLDEYGMADDFGTGTSGPGRRDAPLAGAAAAAEWFFGSKRGLLAAVTVGTVDHLLQAATRTKHVMLRHAGLAGRVVILDEVHAYDVYMAQFLFEALRWLADTGVPVIVLSATLPPVLRAQLAGAYLQGALQRPDVDLADLPRPTGYPSTTAVYMADGKPRFSVTSQSPWRESVPVAVEILAEPTDFAPVSIAAAVSAEVSEGGCALVVCNTVQRAQVVYAELRTTFGDDVVLLHSRFTAAERASRTEDVVDKLGPPGRENAQDRPARLVVVATQVAEQSFDVDVDILVTDLAPIDLLLQRVGRLHRHDRPTGQRPARLRDPKVIVSGLRLPDGAVPLWPAGSRAVYGDHLLLRSAALVAEAATGGGWSIPADVPGLVALGYGDEPLGPARWADAAAEARQEWEAKERRRRVNATGFLLSGEDGLGLTTLEGLHDKATAPLETEERLTAVVRDSDESVEVVLVRRGPAGYLTLAGRSLGHIGEVAVSDDAVLEEVVGATIRLPANKEITAAAHAELTPLAGWDGDSWLRRTRALILDDRMSAILGGRHLTYDNKLGLSLAPRPAADTRPAAGKG

SEQ ID NO: 11570 - protein, 751 aa, Frankia casuarinae
MWAHSMNTSGMRHRLVDHLEGTALLAERFAAVFGAGEVGRFAGLAHDVGKASCAWQDGLLRAEATGVRVGEDHKTLGVLLAERRGAFPVLGLPLHGHHGGLTNPSEVRSMIKDRSKPRDVQDRAEAEAALRPLLPGLFDGPPVRLPVGFDEPGTSEMLMRFLFSALVDADGLDTAAHRSGGQPQVAAPADMAMLWDRFVGRRKEMLAGRPPAPAADRLRGEVYEACLAAAAGPTGIYRLPAPTGSGKTIAAAGFGLRHALEQGKSRVIVAVPFITITEQNHAVYRRLLDPVGAGKGAPVVLEHHSNVTVDDDGPAQRWRRLAAENWDAPFVVTTTVQLFDSLFGRKPAAMRKVHRLANSVIVLDEVQALPAPLLLPIVDGLRTLTARFGTTVLLASATQPELWALDPLESITPIEVISNPESLYKTSCRVRYEWWPDPKPTLEQVADRVADPAAAGADQSLTIVNTVANARQMRDLVAARVPATTPVLHLSTAMCPAHRREVLAEVKERLTARLPVRLVSTQLIEAGVDLDFPVVFRAMAPADSLQQAAGRANREGHLGPKGGLVVVFDPADGGRPRSYDLPVGITARYIGLGRADPDDLKALRLYYHSYLQNPRVSGRDSRGAAVQISRAALDFRAVAEGPKRTGEDPRPDRSKAFRMIDEDTVPVAVPYQGEEERVRQLVERIRMVPLPEPRLFRDLQPYLVMIQRRTRDRADVATLCQPVFGDLVEWAGSYDKNTGIVLEPSGEEFIA

SEQ ID NO: 11571 - protein, 745 aa, Methylobacillus flagellatus KT
MAYFAHSGIAEDLSDGQRLADHLHAVAKLARESATWFGWQDWAYIAGLLHDLGKYCPEFQARLHGSLKRVDHATAGAKQSVERWGKSGKLLAYCIAGHHTGLANGREGGQDRYALDKRLSTEYGKQLPVLDPVWQEELSLPEHLPMAEFIWHQSPAQAGLQLALLTRMIFSCLIDADRTDTRRHYDKLDGKQVTTHSLPTLEQLREALDATLDCFKAVPAPEGSVNQLRQEILGHARSQALQKPGLFSLTVPTGGGKTYTSMAFALDHAIAHGMRRVIYVIPFTSIIEQNAKVLREAFGPLGDDAVLEHHSAFDASKLPTQTARDHLKQAMESWNKPVVVTTAVQFFESLFSDRPSQCRKLHNIAGSVVILDEAQVLPLKLLRPIMAVIDELARNYKCSVVLCTATQPALKKDQGFINGFDGVREIVPVPEALFKKFKRTEVKSIGLQQDEDLVRHLTEREQVLMIVNNRRHARALYDAVAHLPEAMHLTTLMCARHRSQVLARVRLNLRDGKPCRLISTSLIEAGVDVDFPCVMRAEAGLDSIAQAAGRCNREGRRSPEQSEVLVFQSPEWKAPPELDQLAGNMREVMRNHAGDLLAPEALTMYFKGVYWAQGAELDSKRLLEIHREHARDFSFPFQDIARDFCMIEAHMKPVIVPFDDEARELIDALPHAEHIGGIARKLQQYLVQVPEKSFAELVKSGSVQAIAPEVLGDQFWRLVNESLYDAEAGLSFDNPFYIKAENLAI

SEQ ID NO: 11572 - protein, 812 aa, Bifidobacterium breve UCC2003
MGHALMPKDLLLARKDDDGNTQTLYDHLHNTAKLAAGFEKRSSVTAFAAGLLHDSGKATDDFKRYLLTGNRKRGEVVHAKQGAFIVDDCAADFPSSAASMITAEVLELAIANHHGHLPDCLDACGGTAYFRKLTGENKKAEQYHYQEVLSHVSSLNLDINTNFANSVAETNRLLETVDSCGISPRNTRNSRSFFLGLYAKYIYSRLVDADRVDAANFTAHQPYTSQTPNWEELTRRLENAISSFDTSSKISKIRMRISEDCLAASTRDTGIYRLGVPTGGGKTLASLRFALHHAQETGKHHIIYITPYLSITEQTVQVFRNVLDLDKDDEILLEHYSSVVPDKDDEKEQQRRLAAERWDKPIIVTTMVQFLETVMSAKATKLRKFHNLADSVIVFDEVQALPTNTINVFNEVVSFLSKILGSTILLCSATQPLLEQTDRRNLLLSDKPDLIDPDNDYAEQLRRTNIVASSQGLTLDDFAAEIYSKALDNGNCLAVVNLKGEAKQLYQLVKELDVDHRFTLVHLSTAMCGAHRKNQLAVLKKCLPKKTGDSGQPVICISTQLIEAGVDISFSCVIRAMAGLDSILQAAGRCNRNGESQMPRNVYVYPIKDESGLRYLPEIQLGKEITDQLIHDYPEQDLLSAFMIEEYYRAYLIRYPKLVDSKSRNIGTMDYSILGGEETVYDLLSFNRRRRGLYCNRVGEQYPYAFAQAFQTVGDSFHVIPGGTTDVVVHYGQAMELIDQLSGEGDFASKIKILRSLQEYTISLFDYEFKALDKSKSIGEANGDFGILVLNEENYSQDFGFLLKAEMPLLMK

SEQ ID NO: 11573 - protein, 971 aa, Deinococcus geothermalis DSM 11300
MNDARNEYLSHMPPLSPITAAARTLWAKSAKKNADGTQGAWLPVLNHLLDVAACAAEILALEPPQTRMLFEADLGLEGEQALAWTLALVALHDLGKASPAFQVLWAEGKDGVDPALRFPPDLRKPYAPHGVVTQAVLPDFLTGLGWPRPLARAVADAVGCHHGLRAEDRDLNLPRAQTGDARWGQVRRELCRLVALGTGARHDAVPTLSSFSPAAFMRLAGLTSFADWLGSSFPLPTQTDFSAYEDPAAYFGRTRERARQTLAEIRWPAFAPLREELPALPEVFRYVVKDGAFQPRPLQTKLAQALEGVSGPALVLVEAPMGEGKTEAAFYAHLQLQRAAGHRGMYVALPTQATGNAMYERFAQFLAAQGRPTPPDLQLAHGGTLLNEKFQATIERTRNAPGDPAEAGGYSVRAEEWFTNRKRALLSEYGVGTVDQALLGVLGVPHQFVRLWGLGNRVVVLDEVHAYDTYTSELIAALVAWLRALGSSVVLMSATLPEASRRALLRAWGMEDAPTADYPRLTVAPVGGKVQTLTIPDQDEVGNTSRPRQHVTLRPLGSEVGEVARHAVDLAADGGCVAVIVNTVARAQAVQTEVLAELERRGITARTCTRGGGGDPRAVGVLLYHARYPADERGEREKRVLRYLGKEGQRPTRFILIATQVAEQSLDFDADVMLTDLAPVDLVLQRAGRLHRHAENAGKRRGHEEAVLFVSGLDEWPDESLKREFWGRVYAPALLYRSWLTLRRRLAGGLTLPDDLDELVQEVYAPEFAAPELTPEQREQLAAAEAVLDNQRGNEATTGSFAHIGCPADFWSTRLHHHPDADPDSESVSDDPTAVGAEEDDFPRTRLGEESVRIVPVERREDGVWRVCRSPFWARDAEDVLPRFGTLDKRDTEHARKIYRRSLGVSRPELVRAAEQGTLWEGSLGTEHRGWRAHPLLRDAVPLVFTSGLAEVEGLRVRLDPEQGLVYLGTA

SEQ ID NO: 11574 - protein, 772 aa, Deinococcus geothermalis DSM 11300
MPFLLGRTRFWQRPRGVTTYYAHTFPGDATRQRWQRLKDHAAQVAEQARQYAAPFGEGDRAALAGLLHDLGKYGVLFQRRLCGLERGLDHWSAGACLAKQAYRDAGLALAIAGHHTGLPCGDAETLRDLTLERLSTQHPLGLRLTEPDPDQTNLKKLVQRLLEDGLTLPRPGVLPLRPGQTAADMLDTRMLFSALVDADYLDTEAAMRADDEPPRPAGLPLDAPRLLAALEERLAELACEESLPPTTRALRADLMQACRAAGEATGPLWTLTAPTGSGKTLALLLFALTRAVCQPPARPIRRIVVVLPFLSLLDQTAEEYRRIVAAAGLDPACLLEHHSLAGTHAAHSDSAARQLTENWDAPLILTTSVQLLESLHAHTPGACRKLHRLAQSIILLDEVQTLPAPLAVLTLKTLARLTQEKYGATVVMATATQPAFDLLSEQVREAGNAGWQPQEMAPPPLRLFERSKRVTPHWHLETPTPWATVQDWLRQEPHSLCIVNLRQDALTLAQALSDAPGLRHLSTFLCPAHRRAVLEEIRADLQAGRPVRLVSTQCVEAGVDLDFPVVFRALAPLDAIAQAAGRCNRHGRRPYGKLHVFLPEEDRYPTSAYQRAALLTLSLARENGGHLNLADPATFRRFYERLWPYTTTNRAELREAVARQDYPTVARLYRLIPQDSVNVVVPYGEGPALIEEARQQGITRAWMRRAQPYTVTVFRRPDGTLPPHCEPVNLRTRHGAPAQSADTWFVCPHPEAYDAQLLGWQPDGGGAEPFVL

SEQ ID NO: 11575 - protein, 767 aa, Myxococcus xanthus DK 1622
MHAHVLACAARHVGGGGSAMKKDLGLPEQPAVPRVVTAEPLAHVAEDGRAHLLREHLEAVGQWAAMLAPREDLRAPALVTGRWHDLGKYTRDFQIRIRKENGFEAHLEKEGALERDHSTAGALWSLSRDRHLMPLAFAIAGHHSGLPDASNLRNRVGRTEKQALLSDARARCDAPALLDGPLGFSPEALDKLEPRQVELWTRMLFSVLCDADFLDTEAFFDANRSAAREVPVSLSQLAERLRGFLREKQRRAPDTEVNRVRREVLTAAVEAAVQRPGVFSLTVPTGGGKTLTSMAFALEHARTQGLQRVIVAIPYTSIIEQSAEAYRQAFQGLEHAVIEHHSAVDPDRETPLNRVASENWDAPIIVTTTVQLLESLFARRPSACRKLHRVARSVIVLDEAQTLPASLLEPILDGLGALVRDYGCSVVICTATQPALGRRPDFQEGLPEVREIVPASVRAFERLRRVRVRWPSSGRKLPYAELADAVAAERDVLAVVHLRADARRLCELVDERLGHEETLHLSALMCPEHRSQVLADIKARKRRREPVRLVATQLVEAGVDLDFGVVYRGLGGLDALAQAAGRCNREGLMEGLGELRVYEPETQPPRGVPRAAQDVTRGLLEQSPDLDLFAPESFQRYFARLYATRHRDEKGIQALRAKFQFEEVSKAFKLVEDDWSASVVVPYVGHAPLVNALRERGPSRERLRALQRFTVTVPRKLRDDWLARELARLAAETVAYLGPEHTSAYHKRFGLLPDHVGIFDPSFLIPA

SEQ ID NO: 11576 - protein, 746 aa, Myxococcus xanthus DK 1622
MKRLLAKSTATPDRPEGEATLLGHTALVLSAARRLLEHRGRASLLAAGLDPALEPRLRRIVLLAAALHDLGKCSEHFQSMLRRQREAPQLVRHEALSLWLCWPGQPLSAWLQRDVSELDLCLALVCVAAHHRKFQTEAFAPDGTGAGLSLELRVQHEDFARTLGRIAEELALSAPPLFTAPIVLRATRKEHPRDQLQSWQDDFERTVPAGSVDARLLAVCKALVLAADVAGSALPRSGEKQDWVDRQLTAPHPAEALRAVVERRLAGHTPRPFQEEVARSAAPLTLVRAGCGSGKTAAAYLWAARQHPGRPLWLTYPTMGTATEGFRDYLHGADVEARLQHSRAEVDFDIFGLRDGAAPGTSSRDQDRLDALRSWGADAMSCTADTVLGLVQSQRQGLYAWPGLCAACVVFDEVHAYDDRLFGCLLRFLEALPGIPALLMTASLPATRLDVLRGMCERVHGRSLAEVEGPEDLETLPRYQRLDVAEPWALVAECLRDHGKVLWVSNTVDRCMRTAEAGTSHGARALLYHSRFRYEDRVRRHGDVIEAFATEGRAAFASTTQVAEMSLDLSADLLVTDLAPIPALIQRLGRLNRRSTLERPAPVRPFVVLPFDGPPYAAPDLRDARAWMERLGTGPLSQRDLVDAWGPPGMMDAPRRQSSTWLDGRFDTWPAPCRDGSPSLTVLLEEDARAVLDGAVSAHRVTLPMNLPPESFKWRAWPRAGRLPYPIPPANALDYDGLRGARWRKP

SEQ ID NO: 11577 - protein, 717 aa, Syntrophomonas wolfei subsp. wolfei str. Goettingen G311
MIKYYAHSTEGEEENWQLLKKHLENVSHRAGIYASCFGAEEWGELAGLLHDGGKYSDDFQDKLKGMNLNVDHSTAGAQIASELYGNRGCLLAYVSAGHHGGLPNGGSDADEASLMGRLARNLPNYDAFYKEILLQPQLPRLNLGRSDKPGFSLSFFVRMLFSCLVDADFLDTEKFYTKEKNEIRKKFPDIKTLNYKLEQYIYKISKKAKSPIIKRERAHVRACCRQAAKKEKGLFSLSVPTGGGKTLSSLEFALRHACKHGMERVIYAVPFTSIIEQNAAVFREALGDDAVLEHHRNYDFEEDENNPNYKHRLAAENWDAPVIVTTNVQFFESLLAYKPSRCRKLHNIANSIVILDEAQTLPDRLLLPCLAILEELLLRYGATIVLCTATQPHLEKLWSKELQATEIIPDSERLYEVLSKRVTVRTAGILKDEELAKKLAAQKQVLCIVNTRKHARTLYKLLPEAEGNYHLSAYMYPKHRSDKIAEIRQRLAEGRTCRVISTQLIEAGVDVDFPVVYRAIAGIDAIAQAAGRCNREGIGGQGEVWVFIPEQGVPEGWFQRMAALGEKVLHKYDDPLSPQAIKSFFELRFDLAGEQLDELGILKDFEECASKLLFPFRDVAEKFRFIDDISVPIVIAIDNECKDIIKKAAYSDNPGGLARSLQRYTVGITPWEAIAYEKAGGIRKVAGLFNVMEEVNNYDDNMGLLPLSNVETDIYVV

SEQ ID NO: 11578 - protein, 781 aa, Syntrophomonas wolfei subsp. wolfei str. Goettingen G311
MRGKPCSHPGKQLEKHLINTGNIALLMAEHYSLTLDETERSALLMHDIGKAHSAFQKRLCRACPAANTCAELCRQSPPEQVYTGHAAPSAALVLAKTGNIILAEAVRRHHGALQNLDEIKSYWINGEYADRIKELTALYTWPGMSTLGLWDEIPADFIKSFPDEISWENLCFDQLEILLPVDNPEAMSHLWLELRKIYSLLVTADRWDAAVGTEWQAKYWHPQAQKFTQFIQQKRLESQHSGRSELALWRTALYEKAVNNATQIMDKPGLYTLTLPTGAGKTLIGLSLASMAAERFKATGIIYILPFISLVDQNAGVAGQLFDQVQEDHHLAYRDDGDDKKPDYGSDNQAGEFLSFFRYWDMPVVVTTLSKLWDVMYSPRANDNMNFHRLSQAVVLLDEPQSIPVKYWDGIGRTLELISQQWGSTFILMTATQPVIIQGKELTPETVAFPKERHKIIWQNHALDIDKLPDFLDDRGWAQKDCLVILNTRESALRTYLAALKRGLPTLLLSRWLTPHDRQRILDQLIKMEHNELQRTLISTQVVEAGVDLDFAMVIRDLAPFDSIVQAAGRCNRHAQREGLAELWVIEVKDDRNRSLSSYIYDKTLLNQTRNLLNEQGILRESAIAARVTEYYRRLSSAVIPDEIWPDIIKGHWGAYHPLYDEQIPEAALLIDEDGSIEELLNELPALPPGLKSLSRRRSINRELGQHTINVGLKYLQEWDDSLSGFIIAKDKPVLEKTPFSWWILHAEGIGQVYSKDSGFIPLKYSQQYQDIVLPVDGGDF

SEQ ID NO: 11579 - protein, 931 aa, Leptospira borgpetersenii serovar Hardjo-bovis str. JB197
MKTEVKSYYKYWGKADKEGNYYLLAYHCFDVAAVGEVYLSQNETLCTHFSRKLGIDPITFKNLFVFFLVLHDLGKFSDCFQSLIPNVKSALDNSNPPIGSYSIRHDSLGYIFWGKWILKDERFGNYDGLLTEQNWLSWNGLRSSKDKSYFTEFLDVLIRCVTGHHGRPPSKNGYSGQTAVSLDSHFTEADRSAALDFSKEVNRILSPNLNFDGDFKTLYNSALRISFWLAGLSVLCDWIGSNAEIFKYHQTPIDLEEYYTKISLKRALDAINRSGLLPSKITFNKDHFRIFEYLREPTPLQKFCSEVAIPDSPSLFILEDVTGSGKTEAALILTHRLMQKSAYSGFYVGLPTMATANGMYQRMSGVYRNLYTKESIPSLVLAHGARNLSDSFQSSVISDNAILTDRNYSLQLDKDPEESASAICNVWLSDNQKKSLLADAGVGTIDQALLSILSTKFQSLRMFGLSRKVLILDEVHSYDPYMVELICCLLKAQAKIGASVILLSATLPKILRKTFSESFALGLDTELQDLKSVEYPLVSLISDRSEVEEIPISTRKEVSRKLNVKFLFNQEQVLQKILEMSNQGRCVCWIRNTVSDASQAFSFLHSKLGDQVILFHARFVMGDRLSIESQILENFGVRSDQNSRKGKVVVATQVVEQSLDLDFDCIITDLAPIDLILQRAGRLHRHCRDIFGNAKQGLDERGEPILWIFSPEPIEDPTSNWFSQFSRGGSMVYSDHGRLWLTAKLLQERKGWRMPEDARNLIESVYGIDVEIPQSFRENQFKVKNDKKKLESAAALSTIHLELGYDSTLNETSWDDSKFSTRYGIDNSSKAVLAKFVSDRLVPWISGTTRDWQNSELPVPNYLVEKEVIFENLNFSEVIFNCKKNLPDKGKHCVLLPLFYTNNSWRGKALNKKNEVVSFTYDERFGFRKEK

SEQ ID NO: 11580 - protein, 931 aa, Leptospira borgpetersenii serovar Hardjo-bovis str. L550
MKTEVKSYYKYWGKADKEGNYHLLAYHCFDVAAVGEVYLSQNETLCTHFSRKLGIDPITFKNLFVFFLVLHDLGKFSDCFQSLIPNVKSALDNSNPPIGSYSIRHDSLGYIFWGKWILKDERFGNYDGLLTEQNWLSWNGLRSSKDKSYFTEFLDVLIRCVTGHHGRPPSKNGYSGQTAVSLDSHFTEADRSAALDFSKEVNRILSPNLNFDGDFKTLYNSALRISFWLAGLSVLYDWIGSNAEIFKYHQTPIDLEEYYTKISLKRALDAINRSGLLPSKITFNKDHFRIFEYLREPTPLQKFCSEVAIPDSPSLFILEDVTGSGKTEAALILTHRLMQKSAYSGFYVGLPTMATANGMYQRMSGVYRNLYTKESIPSLVLAHGARNLSDSFQSSVISDNAILTDRNYSLQLDKDPEESASAICNVWLSDNQKKSLLADAGVGTIDQALLSILSTKFQSLRMFGLSRKVLILDEVHSYDPYMVELICCLLKAQAKIGASVILLSATLPKILRKTFSESFALGLDTELQDLKSVEYPLVSLISDRSEVEEIPISTRKEVSRKLNVKFLFNQEQVLQKILEMSNQGRCVCWIRNTVSDASQAFSFLHSKLGDQVILFHARFVMGDRLSIESQILENFGVRSDQNSRKGKVVVATQVVEQSLDLDFDCIITDLAPIDLILQRAGRLHRHCRDIFGNAKQGLDERGEPILWIFSPEPIEDPTSNWFSQFSRGGSMVYSDHGRLWLTAKLLQERKGWRMPEDARNLIESVYGIDVEIPQSFRENQFKVKNDKKKLESAAALSTIHLELGYDSTLNETSWDDSKFSTRYGIDNSSKAVLAKFVSDRLVPWISGTTRDWQNSELPVPNYLVEKEVIFENLNFSEVIFNCKKNLPDKGKHCVLLPLFYTNNSWRGKALNKKNEVVSFTYDERFGFRKEK

SEQ ID NO: 11581 - protein, 804 aa, Methanothrix thermoacetophila PT
MGRGSFSFKLRSHPDKLLVDHLRNVGEMCRRTVAESARNLDDAEILKNVAYIIGATHDLGKATGFFQEYLRETDEKRRRALRSRDVTKHGLLSSLFTYAIVREHLRKRGCEMPGALPLVSFIAVRRHHGDLTNALDEISAIYAERERVLSVIEEQVSSLDRNECAQIFNALLGGVVEIDLDSLLDHILRDALKDLRGEKPLVRNLGRRNDVLPYFVAQLLYSALLDADKTDAGLEGVDLGRVNIPPDLVDRYREARGFSERRDGINGMRNEIYHDAVSRISGWDLNERIISLNVPTGTGKTLTSLAMALRLRRRLMNERGVMPRIVYALPFLSIIDQTCDVFEDVLESAGIRADSSVLLKHHHLSDITYTKGDEEFESDVSLLLMEGWNSEIVVTTFWQLFHTIFSNRNRRLRKFNRIANSIIIMDEVQAVPHRYWHLLHDSLKMLCEKFNSYLILVTATQPLIFSEESGEIREAVSDKERYFRALNRVELRPMIDAPMSLEEFEALLEGEIHNNPEKDFLIVLNTIRSARNVYSAIKALDLRDTELFYLSTHVVPRDRRDRIRRIRDERGGRRKITVSTQLIEAGVDIDADIVFRDLAPLDSINQVAGRCNRNLSKGRGRVSVVILRDERRELCRYIYDGFLISKTLDILRSCGECIEEREILELNSRYFRVVRSGMSDETSRRCMSMLSGLEFGDLGESFRLIEEDEPRVDVFVETDERASDVWQAYRDLRSERDLWERRRRYLRLRNALSDYMISLPRRLAADLVVENQGTGYISMDELPHYYDPETGFRVEDAGEGSMII

SEQ ID NO: 11582 - protein, 873 aa, Clostridium novyi NT
MYFDKSKKFNIEMYINNSDKIYAHTMDDNKKVETLKEHLERSIKYFYKLVENKNLDNIFLKFEAKLCKEFSDKEKSLFREMIVNTIYMHDLGKININFQTIKMKNKYFKDKKDIECSNSNHSCLSSLIYMDYYHKKIKSDSELINKENKKKLRLFMVLNAYVISKHHTGLDKLDDFRAKLTQDDGEGQRLCSSELCIFEDMYNKVIEFTTKDNILGKLFKLAEKTLKVYEEEEKNISVLFYIYVRLMLSTLLMCDYYSTSEFENCSEVKGFNDIEDIHDFYDTFNSTNINKDTREYEKSKYGLKEDFSNVDDINILRKELFLDAEKELLRNLDKNIFYLEAPTGSGKSNVAFNLTFKLIEKQKDLKKLIYVYPFNTLVEQNTRTIEKIFNNQEYILDSMAVINSITPIKVKNKDSDENTKDYNKSLLDRQFLNYPMILTTHVSLFNYFFGISKEDLFPLVKLCNSVIVLDEIQSYKNYIWKEIITFLNYYSELLNIKFIIMSATLPKLDVLIDGESNSVNLILNREKYFKNRLFKDRVKLDYSLIDLELDDKDEKLEEILNQVIEQANSSNKNILIEFINKSTAVDFYEMLKDYKYEYGLGNDDKRDIELITGDDNSIDRNIIINKINKEKNIILVATQVIEAGVDIDMDIGYKDISMIDCDEQFLGRINRSCLKESGIVYFFNIDSAGGIYKNDYRKQKQLTLISEKFDTKKWLENKEFDKFYEYVLEIINKNGNDEYKEGSMVNFIENIVSKLNFMDVSERMKLIDDDKMESSVFLSREIQLEGGEVLKGKEVWNSYKELLKDNEMDYAERKVKLSKVVSYMNYFIYKVKKCNFNYTEYIGEIFYIEDGEEFFTNGKFDRKKFEGINLDIC

SEQ ID NO: 11583 - protein, 667 aa, Chlorobium phaeobacteroides DSM 266
MGRIDHSAAGAILATDKNKWIGRILGYLIAGHHTGLPDWHKEPGTKGDPLSERLSNPEHLMNALKGNPPENILNTALPSSLPCKSQDGGSELVHLWIRMLYSCLVDADFLDTERFMNPEKSELRPNEVDLVMLRERLDVYMAAKENGALDTPVNRARKEILRECRDKGRSLEPGLFSLTVPTGGGKTLASMAFALEHAIRHGKKRIIVAIPYTSIIEQTAAVYREVFGDDTVLEHHSNLDPARETAESRLATENWDAPIIVTTNVQLFESLFAARSSACRKLHNIVNSVVVLDETQMLPTDFLQPIVSVIKSLSTYFRASVVLCTATQPVLSGKVGTGKDILNGFEGGSVRELMSDPEKLFSVFQRVRVRMLGQAGERYEWTEIARQLQEHEQVLCIVNTRKDCRELHAQMPAGTVHLSALMCPEHRSKVISEVKSKLMTGELVRVVSTQLLEAGVDIDFPTVYRSFSGLDSIAQAAGRCNREGRLECGDVVVFNPPKPSPSGRLMKAENAAQELFRTDPELASSLMPEAFSRYFIRYFSGLNGFDTEQIMDLLAGNDALKYQIQFRTAAKRFKLIDDTLQHGIIVRYRDGKANIVALIDQLRFGGSNRKLMRQLQRYAVNVYDPDLKQLRGNGLIEEVNGVWVQTADSLYDPVFGLNIDATLNFVY

SEQ ID NO: 11584 - protein, 566 aa, Thermofilum pendens Hrk 5
MSLQEYWGVVERVVSSRNRRPVRYSYFEDVWRAVDEGHRLVVVRAPTGCGKTEAATAPFISDAAKGSRRWVSLVYALPTRSLASAMLRRLSRSLAAAGAEWTTATLSYGGLWEARPYLEGDVAVTTYDTLLHQFYGVVSPGYHLLLPAAKVSGSLVVLDETHLLQDAHWYAPSLLPAHVASLVSLGAQVLVVGATVPEVLLEELRREYRLVSRGEEPAVVDAADEPARGRLDVELRGGGMPVEGLCSLLEGAPRPALVVVNKVEKAVEAYRALRSCLGGSVALLHSRLRGGVRARVEGLFEGDGAPGDLVLVATQVVEAGLDLDVRFLVTEVSPVDSLIQRLGRCARRSDGHAVVFLDEEAARNVYPRELVERTLGVVDAQSLAESVRRLSVARELVDGVYAAEVVERLRKGWERALSEVKGWALRFPRSLLHKEAHREPGPLLRLGYEVACYLPGSAGEYEALLGGGETAVSLERLRDYTVRLSVEGRGEAPAAVVHEVGGREVVVALEYKRVDGGLALRGRRMEPRAFPRAVESGELFLLNPAFYLSEGGDELGVVRPWRSRSA

SEQ ID NO: 11585 - protein, 745 aa, Desulfovibrio vulgaris DP4
MADGGDEHASGHDNTLKNARYYAHSTPNPDKSDWQGLDAHLENVANLAATFAEAFGAHEWGKAAGLLHDAGKATAQFTQRLEGRPVRVNHSLCGARHAQKQGGKCGLLLSYAIAGHHGGLPDGGLQEGQLHHRLKHERLPADVSPPSVDIRPDVLKPPFTKLPENQVFSLSFFTRMLFSCLTDADFLDTEAFCTPERASARNGRPATGLVALRDALNTHLDTVERDAAPSRVNDIRKTVLHDCRARASETPGLFSLTVPTGGGKTLSSMAFALDHAVTHGLRRVIYAIPFTSIIEQNAKVFSDVFGQDNVLEHHCNYRSKDEPEEQGYDKWRGLAAENWDAPVVVTTNVQFFESLFSNRPSRCRKLHNIARSVIVLDEAQAIPTEYLEPCLYALKELVGQYGCTVVLCTATQPAVDDASLPERVRLHHVREIIADPQRLYTDLKRTEVTLAGRLTDAALAARLDGHGQVLCIVGTKPQAQAVFSLLQEREGAFHLSTNMYPEHRRRVLGTIRQRLADRLPCRVVSTSLIEAGVDVDFPVVYRAMAGLDSIAQAAGRCNREGRLPEPGQVVVYEPEKPPRMPWMQRCASRAQETLRTLPEADPLGLEAIRRYFGLIYDVQELDRKDIFKRLRGQVDKDMVFKFREIANDFRFIDDEGTALVIPTGPEVEDLVRRLRGCEFPRPVLRKLQQYSVTVRHRELEKLRSAGAVEMIGDAYPVLRNLAAYSEDMGLCVDSVEVWQPEGLVS

SEQ ID NO: 11586 - protein, 792 aa, Acidovorax citrulli AAC00-1
MEREFLLKNDTQGSSHAPAPADAAAPHAPPGAPSTTPAFHAHSVEGQPESRWQTLPEHLHAVGRMAGEFAAVFNAQELAQVMGWLHDLGKYTLPFQARLRGSPLRVDHSTWGARIAQQRLGVMGQLMAYGIAGHHAGLANGQGEGERTALADRLTAADLPALHPAWEKDIPLPARLALPAGLKLYGQDRQQALARQPFQMAFLARMLFSCLVDADFIDTERFYLQARGGPDHRSAGPAWPALPALRAQLDTHLRTLTAQCDPAREVNRLRADILRQVRERAECTPGLFSLTVPTGGGKTLASLAFALDHAVRHGLRRVIFVIPFTSIVEQNAAVFRKALGPLGDTAVLEHHSAFTERQPPHDDPEKYQSAEKLRLAMENWDAPIVVTTAVQFFESLFAARPSQCRKLHHIAGSVVVLDEAQTMPLKLLKPCVAAIDELARNYRTSIVLCTATQPVLEAPAFDGGLTGVRELAPEPTRLFQQLERVRVRHVGTLDDAALAGHLRAREQVLCIVNNRRHARAVYEAMADLPGARHLTTLMCARHRSEVLDEVRQMLEAGEPCRVVSTSLIEADVDVDFPTVLRAEAGLDSIAQAAGRCNREGGRPIDASEVLVFSPANEDWAPPPELKQYAQAAREVLRQCADDPLSPGAIARYFALLYWQKGGDQLDVPDLMGLLKTRRPDSLPMETLATRFRMIDSVQMPVIVPYDDTARETLEQLRFAEGSVGLARKLQPYVVQLPRQGFDALYQAGAIAPVRPDRWGEQFMQLVHPDIYSQRSGLHWDDPTFIRSERLHW

SEQ ID NO: 11587 - protein, 939 aa, Hyperthermus butylicus DSM 5456
MARHGRIASLLRSLGYEVLVWEEPPEEPEQSDKTFSDIVPRLSGHEKARLKLYRHQLEAIEALEQGRNVILTARTGSGKTEAWALAALRHGWRVLAVYPTLALAADQIRRLEEYYRAAGYRDAVVRIDRPSIEKRGRRGDELLRQLSKAMVVVTNPAFLLAEMKRLAMHPNRALLEDFLTSVDLMVFDELDFYGPRGAHLLLAIVELVSKHLASKSPRVVVLSATLGNPGELAKLLTDITGRDTSIIEGKPFKTRNRTIIVLGKGFEALRDYVRAYASVIASRAPWILDIVGDDEEFREHMYEIYEALEAIGLRPPRPGMDPVEILQAVLDASEPGRVTLVFTRSIRMAERLYRSLLERLPPGKRGLVGIHHHLVSKEKREQLEAAAREGRVALIITVRTLAQGIDIGTVYRVVHVGLPADLREYMQREGRKGRRKELGVTESIVIPSGLWDRKLLETGSSALREWLGLPLEKLYINPSNAYATIFKAMWRLLRGLELSSDEEKLLRKFGFVEEYTTALGERRLTLSKRGKAFWNDIGFYEHGPPYGYRKVLVRGDREIVLRGEEASLRDVVEKYQPGAFDPMTEALVVRVEPREYRVYEEPVEDAVAGHEWLARAAARYEDIKKAWGEAPRLADDIRYGRVTAAIVLNVSAPTSGFGELVEEPIEVEWLVESARPRLSRTPNGVRVYHEVASIELNAPVAGRYRDYTYGYVFEAPGTLRAEDLRLGLALLIVYLRLDERYSIPLGLLRYRVVSAGPIKLVHLWEREAAGLLDKLDWLEVAENVERYELPGIALPLIAAVDPVSALRIMRGEVSLESAKRLAAQVARVIAGSEVLRAGEVVVEYPRPSRSHGITSIAAVYETIDSSAGSAVVAAVASFDGEEPRIDVIKGRVSLDSASEIAHRVLAHIDRALSQGMTIYYYGREQRDLLIECLREATWV

SEQ ID NO: 11588 - protein, 834 aa, Methanocorpusculum labreanum Z
MQDKVILLGKIMYLAHINHETKLEQTLAEHSTTVSDLCKGYGEGIGCPNLAALCGLLHDTGKAKQEFQEYLKINDPEIRKRYRGKINHSTAGAKYIFEKYDKSTDNFERFTAQLIALGICSHHGGLIDCIDLEGQDLFFKRINPEKEIYFEESIHNFENDCVSQDELETLFLKAVDEVKTFNEKNRSRLGISGDEITFTRGMLARYLLSCVIDADRFDSFCFEDNIVTKDTPKIAVEKWEKLAENLDEFLDQKPIIYDIDELRKEISLSCKAFGKKTSGIYRLNVPTGGGKTLSSLRYALAHAAEWNKERIFYVIPFTTIIDQNAKVIREALREDDLILEHHSNLVYEDPLDENDESITGADEGRNYRLLTERWDSPIILTTTVQMLNTLFLGKAGSIRRMHNLANSIIIFDEVQMIPVKCLRMFNTALNFLSEICGTTIILCTATQPKLDKVNPPIRLSAPADMVSVDFGKFRRTNVCDERLQNGYSAPELAEFVEDKLENNEKILVILNTKTAVKNLYAHLSAKKLTDFTTYKDLSLYYLSTNLCPAHRRNRLERIKDDLKIKNHRMICVSTQLIEAGVDISFDCVIRSAAGIDSIAQAAGRCNRNGDVQCRDVFIVNSSDEKLSGLKDIDLGKKSAEHVLSDFAKNPAGFDNDILSQKMIDTYYQKYFTSRDGEMGYPITKEMISKKQMDLPLGRSIFELLSVNEKSIQAYNTDQHLQTRQSPYYLCQAFSTAGKFFEVIDQNTTTVIVPYDEGSDIIRELGSKASYTEKLRLLKKAQQYSVNLYGDLEQLLTKEDISPIGDTGSYTLNTSSISYDEEYGVISSSDAELIF

SEQ ID NO: 11589 - protein, 750 aa, Hungateiclostridium thermocellum ATCC 27405
MYFAKPVDNYEGTYEYHVKRCAEILEFEIRSKYPAFKRILSSYGFDVEDFIEKMKTAVVFHDFGKLNPYFQEYMKRKIEKKKLSGIKHFRHEVLSCLFLMSNEKSKEAYFPYHILAVLGHHKMLSSDLKSFERERVWQDRWPEISEDAVKHAMEIASEFGIKVDGRSGPQGKSANNYLNALLKLALMLYEKDREKLKVVYSVSKGLLHNCDWIASSNLDYNRVCLIGVSANDIEKKLKEKLEKENKKYVRREFHSICANAVGDVVAIAPTGSGKTEAALMWALNSETTKIIFLMPTMVTSNSLYERLSTHYFPKESCGLSHSGAETYFYKKSKEDDTENDYDWSQILHQKAFIPAVMVSTVDQVLSTEFHTGLWNQKEYALVGSSVIFDEIHAYDGYTIGLITGVIKKIKKYGGRVMLMSATMPKFLRNHFLDLLDSKCLVVAEELMERASNEWAYLDTDLEGIREKVLKEVSEGKKVALIVNDVETAKKEYKYYSKKGFDVLCLHSEFTMKDRQEKEGRLTSKEGNPYRLVISTQVIEVSLDVSFDVMFSECAPIDSLVQRAGRCNRHGLINFGRFYVFNPSDTAVKYVYRKQKDILDKTVEVIRKNSGRLTEKQIMAMVEEVYEGFNLYDEDYKLGIDIVRDIEQRYNFFDVNIFQEDENLSTRKFDVVKVPVIPADEYMEIVEKLFESKDYKMISLYEIPVSISKFKKYIRRLEISNKYNLPIFKIKYSSEYGIDYEEDDSNTCYLY

SEQ ID NO: 11590 - protein, 800 aa, Hungateiclostridium thermocellum ATCC 27405
MLLSHPGKLLLDHLKNVFLIGDCILMQKKTEFESFSEHDIRQLNKLNLLTHDLGKATSYFQDYIRNLDDNTQKNDERKRHGLLSGVLSFKIVNAVMKNEILAFLSYMVVSKHHGELDDFTNFISVISGDEKNKTLLKLQFESIDKGKLQEVITRLGIDFDILSYTVDEFENDIDYITSRKVRKKVKELMGLEIFLLIDYLFSLLIFSDKLEAIYNSENMNIEEFIEKNTNRPRISSDCVDKFKKSLEIKNIRMAEWRNRAYQDVLGSVENLSLEEKILSINLPTGSGKTLTALKAALRLKERLIEEKGYNPRIIYVLPFTSIIEQNFDVFQKVLGTTESNVLLKHHYLSQRVYQWEKEGEIESLSDTVSEHLVESWDSEIVVSTFVQLLHSIFTNRNRKLKKFHNIVNSIIILDEVQSIPHRYWNLVRETFSAMAKYLNCHFIFMTATMPLIFSEENKEIYELVKDKRKYFEEFSRITIDAKRLTDKTTLDEYKTLLLDDILRYKKDDFLIVMNTIRTSIEIYSFIKEELKDEAEIYYLSTNIIPKERLDRIKKIKESKNRKIIVSTQMIEAGVDIDIDRVYRDFGPMDSINQTAGRCNREWGDKKGLVTLVNLVNENHHSRPYATYIYDNVLIEETKKALSGLEMIEEKEIFHLAEKYYVGLKSHGSDESQKLLDCIKELRYREAFECGKDDKNSGVFELIRQDFNTVDVFIEIDDDATEVWQEYQSIKKIKDRFERKRKFNQFKKDLYMYVLSLPEFAVRKQVDIDEKDITFINREMVFNTYDKDTGFMRDLEKDYFF

SEQ ID NO: 11591 - protein, 577 aa, Staphylothermus marinus F1
MSNPETIIDNVYKVFNYSGRDFLKHAWREVVGSNISIVEAPTGYGKTTLSQAFTLYNLIFGFKSVISYPLRTLLEDQLNKFRMLGEKLGLKDFVGSRYMGHHESYYYVKPVTLTTIDTLSMCIFGLEPSELDRYLKALYIGESITSTLGHYLFSKATVLLSNIVLDETHLLADSIKSLNFLAALVIIAHNNDLKLLLESATLPDAFIHELKRVYSGINVVKFSEDMDPEFVEEREKKEIDYMKPVEVGEDKYEKIMEWLMEAEKNLSDQGLRALVVFNTVREAVEFYNYLKKYSGKIGVSNDNVILIHSRYKEKDRGDRVDKIRELSNMLKEAIKNKQDTKNIQYIIVATQVIEAGVDVSSNVFITDIAPANSLIQRMGRFLRYPGEKYGYLRIWYEDLKQFKNKYKVYDHSLVQRTLDQLIVFKTFNPHLPSKYRELINNVYRIEDFAINTSEVNDLATLYLGLAHVKRAIEKFLDMGGSFIRDSIQIPVIAESDLSSKNIYESLIPMSIEALKPQIVVGVLVKRGNELEQEELNAEGLSIKGLRTILRRRSMMPDFIGVVVRGKYDYEKGLVLEV

SEQ ID NO: 11592 - protein, 820 aa, Methanococcus maripaludis C5
MQNLIMSHEKKLLKDHLFNVGKNIENILVKKDLDLKLIDKELLPKLGYLIGIAHDFGKSTSFFQSKLNENKNSEYSHHGLISSIFGYHLLKEYVHNEDFSIISYIAIKNHHGNIKCPLESISSRLEKDLKVQYKDILSRKEEVFKIYETLLLEYQIDLEKVFLNMEITIEDFESFIDDMEDMLDEELESSDAIERFLTCNLLYSVLVDSDKKEAANLSNEYFTDNVESYYDIKEYINNLKQEMAEKFVKNNMNLLRDQFYQDVVENPMISNKCYMYSVNAPTGIGKTLTVLGLANKIKSLNPKSNRIIYCLPYSSIIDQTHGEMENIFKYFIGEEYSKKPTKYLLKHHYLTPLLIKGLDNEEDCNLTQDSDINITYMDQKLLLESWESANIITTFVQFFESIFSNKNSRLKKFHNIINSIVILDEIQTMPAEYYKLIKMVFEILSKRFKTTIIFLTATQPNLACEDSVNLVNTRYFTNNEFDRVELYKINGLTPIDEKQFLDSFEKLFFGNSAIVVCNKINVAIKLYELIRKNEKFSEYSVLSLTTNITPKDRKNRIKKINKMLKGNEKIILVSTQLIEAGVDLSFQYGFRDVAPLDSIIQTSGRVNRSNEYDIGKMYLFNYVGENGRIGSSIYDPKSIQITRELLENDKYMSKDYWGLSNQYYGKYMLSGKSNLLLNSIYNLIYEMKEYNKNKILPVNMFKVITDHKKFDVIISPDETSDLKIKELIKTHEAMIQITEIYGENKMEFGKLSEKYEILKKELNENRVSIYENILNKYSDFTHEFNGLNYILSEDYNKIYDENIGVIALDNCEIKHKTLFS

SEQ ID NO: 11593 - protein, 783 aa, Desulfotomaculum reducens MI-1
MTEQLKSHPHLFLHQHIEQVNQATKAIRDWHTTDTITNDIKLLLGHLAKYHDLGKGTPAFQEYIENPEGYQGDPQEKAHSTLSLLLTLAIARQQSWEELHTLVIAAAVAGHHSRLPTIPEKKIGGVCCPQWDIDGFAGGEKASLLKRQLASIDFPALEQETKVEFGSYGLAQALQSDPAKSLREMKRFLITRIYGIFASLSLEEALRLRMKAQLLYSVLLEADKALLAVSSPEVYLNREVRHWQSRWVEDKIGKPPETSINQLRQRARQGVIAALEAKNTNLYSLTAPTGCGKTMLAATWALKLRERVTEGQAPPKIIIVLPFLSVIDQTAREYARLLSHSGQETDGRWLIQSHSLADRHYARGLEDEDGRFFIDTWRSEIIITTYDQFLMSLLDPRAKYQMRFHNLCDAMIIMDEVQALPCKLWQTLEKVFQALASEGNSRLLLMSATLPPFMKEALPLLPDYQGYFTLFNRYTLQLRLQESQTLDNFCEEMSDRLIGWLECSNRILITLNTRHSARRVRDFLSQSWPAEYGDVPLFFISADVTPKDRLEIVKQIKQGKPCVVVSTQCIEAGVDIDMDRVIRDFGPLDSIIQIAGRCNREGLRAQGVVEVVDLINEQDKRYSEMIYDTTHLQITRKILADKQEIQEKEIITLSTQYFKDLTEQKDTGYNHLIRFAKWQEDTPVKELLRGKERLQIDFLVLEQDAELRDEMQIVGRIKDRWERREAWRKLSGRIALVSVSIFAQPGFHPEQIADEFMGSWWVVREGYYNSKQGLLIEGETMIL

SEQ ID NO: 11594 - protein, 731 aa, Desulfotomaculum reducens MI-1
MNYYAHSDKEKDKNQWHLLRDHLQGTGVTASTFAKSFGGETIAHVAGLLHDLGKYSPEFQKRLEGHSIKVDHSTAGAIEGGKRYGLIGKILAYIIAGHHSGLPDWGSVADETSLEARLKKKLYDYMSFSKEINLPVEKDITMPAIRPIVGAGFSVQFLTRLLYACLVDADFLDTERALNPEKAAARVKKYSLKKLSNNLEQYLNNLCTKASDTAINRKRYKILANCREKAECEPGLFTLTVPTGGGKTLSSLSFALRHAIRYEKERIFYVIPFTSIIEQNAMVFKRVIGEENVLEHHSNFAYPQEDQWEMENDLADKLAQQKLATENWDMPVIATTNVQFFESLFAAKSSRCRKIHNLANSVIIIDEAQMIPTGFLKPCLNAVVELVANYHATIVLCTATQPAINKFLPKEIVPVEIIDNPEELYKAFKRVQVHNIGTVSDVELVEKLVSQDQVLCIVNSKKHARILYEGIRGDGTFHLSTRMCPVHRTKVLEMVKERLKEGQVCRVISTQLIEAGVDIDFPVVYRSMAGIDSIAQSAGRCNREGLREMGQVYVFWPEKHGMPRGWLNRTASLGSMVFKRYEDPLGLEGVKAYFTSLYDVDAAELDKKCIMEDIREQERQLRFPFRTIAEKFKLMNDNTSTIVIPWDKYCQKTLAEAESNLFSGSYARKLQRYGVAVYEKEFRELLEFGALEVVGGRFYVLKEDMFDAYYSQETGLKPFTESMFLNDTLII

SEQ ID NO: 11595 - protein, 484 aa, Pyrobaculum arsenaticum DSM 13514
MRRAIRKALELAERGVDKIVSELPTGYGKTVAAPLLYKRFRAAGLCWKAIHVFPLRAVLHTTLKRYVTEHPDIQFAYQDGDVTLRADGYVKDPWFTSEYVLTTYDSFIHNLLKAPVAEFHKLLSHGRGVHYHWPMAEVYPSCVFLDEVHLAVEGAKQVAAVSVVVNMLREMEVPTVVLSATMGRWKHDIFKDFVFVQLGEKDEEGDRLVVVRDEEFEKSMGEVEYSVDVIDENSVAALARRKVKEGRRVLVVLNSLKKVVALKNELGDLNPVLIHSMLTRRDRQAAEEEVKKAQLVIGTSAIEAGVDTSFDVLISDTPSAESVVQRVGRVCRYGGRCKGELYFFGEGAEELREVKHWRLPYKKGSYAGLLREQIEKDRRLTWLYEMLARALWIEDINELFKKLGASFFREGLLVEAVAGSGFEMAFSASLGKLVELGYTETVDGEQVKGDVYIFLLDYVKRRGELPAIRIPDYVEGVGPAALYE

SEQ ID NO: 11596 - protein, 908 aa, Caldicellulosiruptor saccharolyticus DSM 8903
MSEIWAKSVNEKNNNKRVTLSNHVSDVLKVFEFFKKKFSDNQFILNAAEIAIFFHDLGKVLPSFQIKALGNIGYYPRDVVYEIPHSLFSVFWINIDKLKEKLNSEEYLNYIISAIAYHHWKDNFDEIISLENKQLKQVCEKVIYEWKDELKENLDKEFGKISSYDEYKELIDVNITWLKAILSHRLFVNLAVPPYKFDYHPLRGEVKKEWIFISGVLQRCDHFASWCEEEGIEEELGNVEIDAPEKENVTKIISRSIGDKAWQFKELEKCSEKNTILIAPTGYGKTEFAFLWSSGEKLFYTLPLRASVNNTFERAKNAFGCNKTGLLHSDADVYLLDKSSDETGSIKLCELAKQLSYPVIVSTGDQFFPYALRPPGFERIFVSLSYSRIAIDEIQAYSPKACAIIVKFLEWVYKMGGKFLLMTATMPKFVIDYLKDVIPDFCKKVNFVNIYEKEKDAFSKLYKHKIRLNLIETKDKQFDIPDEIIREVLQKAKDNKRVLVILNTVGFAQSVYDKLKNSADEQLKERIFLIHSRYTLKDRENKEFDYINNKFKNPKTEDVGKILVATQVVEASLDIDADILYTEMCPLDCLVQRMGRVLRRYFYKDGEVINKGNNNKFNLDKPFKAFEKEHSEVNVNVFIFNNNNLQSGGHRVYSRELIILSLAWLWKLKNTQNSLEELFNKITKQKFNNNEIEKLFTDEFTDLISNRQSSGKKSKKSKDENKESVYKYLLSNSDWLKTLDKMEIELSEYDKYILVTLFYSSLKEDGDYLKDFYNTLYILNSGLMSERKVEAERIFRDISDVQIITKNKFEDFKKDTEEFIKSVEHDDKNKRLLFTQFKKSVLSKYVVMYFYSANFELAYKKLIAEVEMDNKWKQRFKRWLSGIYLSDKHDYNYDKGLIKINDEDKEGR

SEQ ID NO: 11597 - protein, 777 aa, Caldicellulosiruptor saccharolyticus DSM 8903
MSMKAYEDIELYAKRFKTEKGYEYQTIYEHTMTLLQNMEKLFKEYREEIKEGFQKLQIDLERFKYLLKLAIIYHDLGKANSNFQRKIRDKTKSNEVPQVRGLSVEVPHNFISIAFVDLEDEIDKGNISPEDFENLLFAIAFSHDRGFDFNYQYFEKYICEDVSKYLNNKTLLPLFKELPSFPTKDEIEKSSNYVYRTIDWLKEVMLKSYTDLYNKNTIMRILLKGFLHRLDHSSSAEVSTEEGKITDFSNKVESYLKEKGNFAGFKEFQLKALDFSTQNVILFAPTGSGKTEFGLNWAGRSKLIYTLPIRVSINAMYERLVRIFGSDKVGILHSDSMIYLLEKYSQSAEDVQELESLFDNVNLARNLSFPIIVTTGDQIFTSALKWPGFEKIYSLFLYSKIIIDEPQSYSPESLAIIIKTLEEIVNLNGRFCLMSATVNPLVLKYLGDISEYLQAYSDEELKKCWSHVVSVKPLSILDCVDEIVNCGKQQNVLVICNTVRRSQEVYKAIKESIKNFDDVPVELLHSRFLEGQRRQKEHFILSNQRKNSIVISTQLVEASLDIDYDVLFTELASADSLLQRMGRVYRKRPYEGQKPNVIILTKEPSGIGRVYQKEIVTRTEEFLKKFDGRRITEYDKKELNEYAYDVEALSNTNFMKSFKKAYELLKLGFKADRKIEAQKIFRDVVTVEGIPRKVFEVNEETIRECLKRIGSKSLSPVEKLQLISAVRKYTVTVPVYFFAKGGASEYSKKLGIFILNCDYDDELGLLPPKESEKDDIW

SEQ ID NO: 11598 - protein, 745 aa, Pseudomonas stutzeri A1501
MDDHTRAFYAHSTPNPDKSDWQPLREHLEAVAEIAARNASAFSGDTLAHLAGLLHDLGKYTDEFQRRVTGDAIRVDHATRGAIIAVERYGTLGHLVAYAIAGHHAGLANGSEGIERTALKERLLGTGLPALLAQWQTEIQLPALNELKPPALIQREGRNFFQLAFLGRMIFSCLVDADYLDTEAFYDRTQGRSSLRDHAYPNLANLRQQLDKHLNGFEANTPVNQLRGEILAGVRSKAGLPPGLFSLTVPTGGGKTLASLAFALDHALAHGLRRVIYVIPFTSIVEQNAAVFRRALGELGEKAVVEHHSAFADDLGKSLEARKKLSLAMENWDAPIIVTTAVQFFESLFADRPARCRKLHNIARSVVILDEAQTLPLHLLRPTVAAIDELALNYNSSLVLCTATQPALTDGPRFPGGLPNVRELAPEPEHLFQQLQRVQIRSIGPISDEALSGQLREREQVLCIVNNRRHARALYEAIADCPGACHLTTLMYAKHRSQVLSEARQRLRDGLSCRLVSTSLIEAGVDVDFPTVLRAEAGLDSIAQAAGRCNREGRRALVDSQVLVFAPENEQWSPPHELKQFAQAAREVMRQHPDDCLSMAAIERYFHLLYWQKGSRALDERNLLGLIEKGRLDCLPFETLAREFRMIDSIQMPVIIARDDEAQAALDDLEFADGCAGIARRLQPYLVQVPRKAYDALLQVGAIQPAMAERYGEQFMVLVNPDLYHDQFGLRWDNPAFVSSERLLW

SEQ ID NO: 11599 - protein, 885 aa, Pseudomonas mendocina ymp
MKGFVDLSDRARRLWAKSGDGFGHGVLAHLLDVAAVAERMLAHEPASTLDWAAQALGLEREHVARWVACLVGLHDFGKAIPGFQDKWLEGRQTDETLGLAFPARSLGVTDHACASAALLWEHLPRRGVRHMLWIRHALQAISAHHGYNFNQTELNRGKPSFEPPAWNEARGELFEAYWGVLAPPGAPQLEELAQPAVQWLAGLTSVADWIGSNPEWFPLGERHALLAEHHADACSRADQALQQIGWRPFQSLLTAPSTTDRLIGQIVQRPELTARPLQSEADRLLEGVRGPALLLVEAPMGEGKTELAFLAHLRLQAANQHRGLYVALPTQATGNALFSRALTFLHGFAADTALDVQLVHGGAALNEQVLKLRGIYGASGDSVASSAWFSQRRRPLLSPYGVGTVDQALFATLNVKHHFVRLWGLSNRVVVLDEVHAYDTYTSGLIEALLRWLKALGSSVVLMSATLPVPRRDALLRAWGVEVDEVPELAYPRLLLADERGLQGATCDSRPLSPIQLQAVAEDLDSLTAKAQLLVQQGGCGALIVNTVDRAQNVYLKLKAELGDAMPLLLFHARFPADQRSEQERAVLARFGQGGERPAKALLIATQVAEQSLDIDFDFMLTDLAPVDLILQRAGRLHRHQRERPEAHRQAILYVAGLDPAALPDLKSTAWEYVYEPYILGRTWALLSREQELHLPHDIDRLVQAVYDGENLPADLAETDRAFIEDHAYGAYLGKRQTERMMALNVAVDPQAEPQNAYTQKNRGYEEGEEGLGLPNYTRLGDDSVTLIPVHQVPGGWSLTPGGDAFDPDQLLSNALAKQLHVRQLKTSRPALVKHALGEDSPRAFSEHPLLRHLKPLLLTDGYLQIGRLTVRLDDELGLVYQRDA

SEQ ID NO: 11600 - protein, 492 aa, Metallosphaera sedula DSM 5348
MSSLVDYYGEACKLQGFEPRKGIEETLSKIEEGKAVILTAPTGYGKTSLTYALGLASLRGNGHFDRVIHVLPLRSIVQDLTSKLENFMRLAGYSNTVVGAYDMDFHDTPYFLRKVNVTTLDSFVLNMFKLPVSEITRGMKGMGTHYEVPRGAIYSSVVVFDEFHLFSDDGGKDKSLTSVIASLRGLGAMQVPFVIMTATLPGSLRDLIKEELEDVVEVVEVKDNFKIERDVSVDFVDELDFNKLDRRTLVVMNTRKGAITAYQEAKKAGLSPVLIHSKFSAMDRRRKVDEIKNAKLVISTQVIEAGIDVSFDVLYTEAAPLPNLVQRAGRVARYGGQGEVHILPFSGHVYDRNDVETSLEIVRREGKLDSSLMSSFNTSYILNSDLLFSLNILDEGPFFSSEATAKLLKKECSITRETSLIMGFPQGCRSSACGIPLTEDEAKDLLERGAKPLRDGELVDWKPGNLCLSIDFMLKGIDGISVDYNQEVGAIL

SEQ ID NO: 11601 - protein, 701 aa, Acidiphilium cryptum JF-5
MQWQIAGFLTLADWIGSNEIWFPRDGTHSDLDPHDYFREVALPRAAQAGADAGLTPSKARTFTGFSALFPKVDTPSPAQSWAETVPLPEGAVLAIIEDLTGSGKTEAALTLASRIMASGEARGVFFALPSMATANSMFQRLTDTYLRLFEEGSRPSIALTHGKAGLDPRFRALISASPSSASEPREGEAIPSEAECKAWLAEDRRRSLFADVGIGTIDQALLAVLPVRHAPLRLHGLQGKVLVVDEVHAFDSYMERELQALLEFHAALGGSAILLSATLPLRMRQSLTDAFRRGAGQEAPRQVTSTHYPLATIEGSEAQTEYPLGVRTGLPRSVTITRVDTEVDALSRVVDAARLGAAVVWIRNSVDDALEAAAAVRMENIDPIVFHARFAHIDRQSVEQEVLRRFGKDSIGHARAGVLIATQVVEQSLDLDFDLLVTDLAPVDSLIQRAGRLWRHSRGPRVIERPEMVVLSPTPSMASGPGWLDSLLPRTNAVYQNPALLWRSARALFAKSDLVTPDDMRLLIEAVDDVEDTPPGLKMAADGAWAKHLSHRAFAAGAVLDFDEGYTLQSGAWDRETRTPTRLEEREQATLRLARVKDGKVVPYAGLAGDLRQAWTLSEVRVQRYRIAACPPPAGYSEAVNEARSQWGRWERESPHILLAILEVTKQEGRFMLQGENPDGHPVSAVYDATDGLRWLPASAG

SEQ ID NO: 11602 - protein, 763 aa, Thermotoga petrophila RKU-1
MSKILAKSNGVTLREHVLDLLEVLENLQIDSGVRELAGKAILYHDLGKVIYAFQKKVGGDVPEDGIPDIPHSFLSIAFIPENTLRELGEGLSRIFLSAVLYHHWRETYLDYLFGRKKESVCKAYERLLEVGDEIVWLLREEMGDLCEIELNKPLCEYLSHNSIIDSGLVFPPHLISLLPSIILKELNIRDENYKRYIITSGTVMRADRFASYVETAGNKELLKKADKRLERDQLETVRRYLERISNKVWQLDLLKDCRGENIVLVAPTGAGKTEFALMWSKGKTLFTLPLQSATNMMYERVKNYFGEENVGLLHSDAAVYLFFSSFLKNNFEDREGEVLQIVEQSRFFSHPFVISTGDQVFPSALKYPGYEMIYSILANSYLVIDEIQAYSPEAAAIIVKTAEDVKQLGGHFLIMTATLPGFIRDEILKRAELEEKNIKDVYEDIPQGRLLRNLVKVEKSLDPVEKAVEFFKKGCRVLIVRNTVRNAIETYRQLVEKLGKEDVLLIHSRMTLEDRRRIEEILESYRPGAKGRNIILVSTQVVEASMDIDFDILLTDIAPADSLVQRMGRIFRKREWTEEFPNTFIYADSNEKKRKELIAGVYSEDVVSATLNALEGMFDIEKPFKLDELSKRKWVEETYQALSQGSNYLKKFRETLDVLDSGYSSEKKHEAHRIFRRVVSMSIVPENLKEDLKRELKSVSDYFDFRRVTAKYLVDVPLHHIKSGALEPLEVESENEQVLKWASALYVLKGSRYEKGLGIFLEE

SEQ ID NO: 11603 - protein, 927 aa, Roseiflexus sp. RS-1
MKSIDPLLLQFWGKTPRPGTPVTQFHPAIFHMLDVACVAEALLRHGPQRVRQALLHAWRGADPEALISWLPFLIALHDLGKLSAAFQGQDEAQRERLTRAGVQFRSHSPELHHAAISALWIHDYLAQNEPEIAQDLVWIFRDATGGHHGRFVDESMEDLRKKLHYVERGESRWRDWRKQGYVLLRDLLAPEDKPLHRIGTPVAPRPATVALTGLLVWSDWIGSNEHDFPATPGMDIHCYLSLSRQRAQNALTTHYLRASRSQPQYSDFRALFQAIAPRPLQAVVDRLSDNDLRQPALVVIEAPTGEGKTEAALALARRIAALRGIDEIFFALPTMATGNQMFTRLERFFRTLYGDGGSVRLSHSQAIVVEDDLRRRVTLSADQDRSDPEGCSADVMLGWFVGPKKAMLAPFGVGTVDQVELGGLNVRHYPLRLFGLASKVVMIDEVHAYDAYMSVILEHTLAWLATLGCSIILLSATLPRQRHDALARAFLRATEPAAALSLPEKLPYPALSLYHATAQSHHTCDVFRGEQRFILRFRKQSAPEEEAGRLLELIRNGGAVARICNRVDDAQAIYRALIASGARDVTCVLLHARFPLHERQRREQCISNLVGKDSQRTPEQRIIIAGTQVLEQSLDYDVDVMVSDFAPIDLLLQRAGRLHRHNRCRPDDHREPVLEIVIPYDEQGEPDWRRWRAIYEPYILWRSLATLCDGLTDDTRIVTLPRDYRTLIEAVYSAAPVVGRYAGEVAKAEQEYRKTIDAQTAKARSPLTPDAMIRAPIVEHGGRSYIEEETGAEASWQLAKTRLGDRVTLVPVYRVNGEVSLDPGGTFRIPTDVPPTLEQMKDVINVAVPVSDRAVIAAYRDEHRDRALRWTWSVIPAPLRGLHPLPLDVQTHSITINRRRLRLDNELGLVIEKGDADVSGDWFEEDL

SEQ ID NO: 11604 - protein, 783 aa, Roseiflexus sp. RS-1
MKPLPWPDWMDHLLAKSKRYGGETLAGHTWDVLCRLADLYRLRPHLTDDTRLWHCLYWSAFLHDFGKAAQGFQRRLRGGPKWAHRHEVLSLAFVDAIAHDLNEAEQRWVVAAIVSHHRDATEIAELYPSGLRRDPLIDLCNELDAETVAHLLRWIAECANRWRDLLGLTADVGAIDPQPCSVGAQRVRYWLRMYHDWVDTLDGEGSDARRPGILLRGLITSADHMASAHLRRLPPPIRLSWQDVAMRCNLSPDQVYPHQRQSAGQSAQSALLMVPTGSGKTEAALSWALGDGRNPPARIFYTLPYQASMNAMYDRLRQTFGDDVVGLQHGRATQALYARFREGDEWSATAARRAQWEKNLNLLHARPLKVLSPYQLLKALFQLRGFEAMLTDYAHAAFIFDEIHAYEPERLALITGLMRYLREHFAARFFVMSATFPELIRSHLRTALGDTPLIRATPDIFDRFRRHQLCLRDGELTDPATITEIVEAVRNGKQVLVCANTVARAQMVRDLLTHAGLTDEHLILIHSRFTYGDRSRLEQAIGARCRSNSANRSPLALVATQVVEVSLDIDLDVLYSDPAPLEALLQRFGRVNRKAAKGICPVYVFRQPDDGQGVYGRDRDPERSGRIVRVTLAELEQHDGAIIDEATINEWLDRIYADPLLNQQWRDAYQRMAHQVDLIIQGIRPFQSDEQREDEFERMFDGVDVVPQCFERDYVHLLVEERFIEANDYLVSISKQRFAILRNQGKLRPAEETDQRRVWVAQTPYDARNGLSFGDRVVDMDWI

SEQ ID NO: 11605 - protein, 904 aa, Roseiflexus sp. RS-1
MLRFSPHVARRVQETRWHRSERTEPQPDGSLVWRAQIAEPKEMLPWIRGWGADVEVLGPEGLRGTLEAEVRKMARVYGVSEMKLQDALIAHRRERDGKEQSLVDHLKGTAELAKRFAGKIGLPELGEVMGLAHDFGKASKEFQDYLKSATGLKNPDEDDYIDYESRKGKIDHSTAGAQLVYEKCSHLGKEGEFLAQFLALAIASHHSGLIDCLTPTGEDNFSRRITKDDSVTHVSEARGKLPEIEDGLNKTLTLDILKQFMQKLQSLREQNDSKETIAFKLGILARFLLSCLLDADRLNTADFEFPENSVIRSYGNYVSWDMLIERLEKTFNEFAQAVAQTKEGSQAREVYQLRSQVARACREAATKPKGIYQLTVPTGGGKTLASLRFALHHAKHHGMDRVFYVAPYITIIDQNADTLRTILEPESERGRVVLEHHSNFVPEEDTHRRHSLLAENWDAPIVCTTQVQFLEALFGAGTRDTRRMHQLAKAVIILDEVQTVPIRIVHMLNVALRFLAHSCGSTVVLCTATQPPLDRLPDNPYRSLIVKQEQRIILNEVELFKSMQRVEVHYARKDGGMTNDEIVDLAGRALDSEGSVLIVVNTRAMARTLYEQIKVRRLAPTYHLSTNMCPAHRMDVLNTIKEKLAAKEPVICVSTQLIEAGVDIDFGAVIRSLAGLDSVAQSAGRCNRHGLRATPGKVWIVNPQEEDIDQLLDIKIGRDQAQRVLSEFKSGNDFIGLEAITTYYRYYYSSRKDEMDYLVRSSSAVGRDDTLFRLLSTNELSVASYRSSRGVNPPLLLNQSFQSAAREFCVIDSPTIGVIVPYGDEGKTIINALCSASELDNRVKFLRQAQRFSVCLFRRQFEELNRVGAILETNSGIHYLDERYYSKEFGWSHDPVNDMDTLIV

SEQ ID NO: 11606 - protein, 798 aa, Alkaliphilus metalliredigens QYMF
MFCAHINPTTRKEQSVKEHLHSVSKMSMEYGAKISLGATAELIGMLHDMGKQTDKFNSYIHYSATNPSDKSLRGSIDHSTAGAKFIYDNFYHTKDPYQKFTAQLISLAICSHHGGLIDCLDLNGMDRFTDRMNKDKDFLYEEALSNYRLEFSEMKHLNDLFNKSKEEIKAILTKVNKIDGSAKFGQFAAGMLEKYLFSCVIDADRYDTYLFMEGKESKQNIDKSDLWNELADVLEVKLKSYPKSGKIDLLREEVSIACKNFGENKTGIYQLAVPTGGGKTLSSLRYALQHAKKFNKERVFYIIPFTTIIDQNAKDIKDILGREDIILEHHSNLVVDNDQEEYKLLTERWDSPIVLTTMVQFLDTLFSGGTQGVRRMHNLTNSIIIFDEIQAIPIKCINMFNSAINFLSNICNATIILCTATQPLLSTTEMPLKLSENPNIIPDMHEKFEQFKRVNLIDKRTTEGYSAASLKDFVLDTMERVESVLIIVNTKNTAKEVFNELKKANADLPPEKQYAVFHLSTGMCPSHRMKILKEMRTKLGHERVICISTQLIEAGVNISFGSAIRSLAGLDSIAQAAGRCNRHGETTCSDVYIVNIEGESVNRLVDIKEGQECTRRVLDEFKENPKSFDHDLLSPKAMNQYYQYYFHNRSAEMNYTLAKPNDDKSMYDLLSGNKEAFNAFNSRNGYKSELMLRQAFKTAGSNFQVIDQNTTGVIVPYGRGKTLITLINGACNLSELKEYLKEAQQFSVNLFETDKRKLEEIGGIVGLKDGAIFAIRDGFYEDDVGVTFENAPMEFYNY

SEQ ID NO: 11607 - protein, 743 aa, Alkaliphilus metalliredigens QYMF
MKRYLAKSNPEETIQEHTDHLIENYKLLKLIYPNLQVNWDILYLACLYHDLGKMNLKFQDKIKGIKKSEDEIPHGILSLAFINSKELKDKGFSKSDIKILAHAIAYHHEREFNYDHNDIKEEIELLKGEGIHFSYDKIEKISVKNLSAKYFSKDRIYQQEDEEMFLSYIKVKGLLNRIDYASSGDIDIEVKNNFLNNCLRDLMKEWQEKNSNAEWNELQRHMLFHKNDNVIAIAETGMGKTEAGLLWIGDNKGFFTLPLKTAINAMYDRIALDMIKEGYENKIGLLHSDTYSEYLNRDGEAIDIDEYYNKTKQLSLPLTICTLDQIFDFVYRYRGFESKLATLAYAKVVIDEVQMYSADLLAYLIIGLSYITKIGGKFAILTATLPDLVLDLLQEEEITFVSPKTFTNNQRIRHSVKVLNEQLNHNTVLDLYNENKVLVICNTVKEAQRMYKLLKDSKKIRNLNLFHSNFIKKDRKEKEKQILEIGHRESKQYGVWVTTQVVEASLDIDFDILITELSDLNGLFQRMGRCYRGREWEKDGYNCYVFDGGAEECSGIGYVIDEDIFQLSKTALQDVGGELKEEKKMNLVQSLYTTENLKATKYYKQIKSNIDYVTSIEDHEKSKNEVKKIFRNIHSITVIPREVYEENQEAISEYILILSKNYSKLMDEEERRVLRTKKSVIRSRLMEFTMSVPYHRGQGNIIKNININRYESIPILNCNYSKELGIQYIEQSKVKKAPFDNFI

SEQ ID NO: 11608 - protein, 765 aa, Methanococcus vannielii SB
MSISFNLFSHPDQTLNDHLTGVRDIALNLHKNHNVNKDLTDVLEIICMAHDFGKATSFFQDRLKTGNKSKLTDHGEISACFAYWLLPELWKIPGFLIVKRHHGSMKNANDEILLNIDILKKQAKNILENNFEEVNLIYSEMLEKNSKYLNDFFDFLNSLNERSIKKHFRKEISNIKYDLELFIKIQYIYSILLSADKSQLILNKAYLPKVTIPSEYVEKYKEDLKKKFVEKIGNFENNMVFNIRNDAFNELKYELEEVDLNNNKIFSINMPTGTGKTMLGYYSAFKILERLKNEQNLNSQIIYCLPYMSIIDQNYAELYKLLEYNLNRHPNDEELLKFHSMTEIKYSDFKEYDARFCFENWQSKVVTTTFVQFFNTIFKSGKNSVMHRFHTLSNSVIILDEVQAIETKYFPLIKQFLEILSKNYNVYIILMTATMPILLDTYELIPNNEKYFKSLNRIKIINNTSKNISLNEYKDILLEKTIKNSDKSFLIVMNTVKSAKDVYQYLMKETNRKCIYLSTEIYPKLRLEKINEIRKMNKRGEKPVVVSTQLIEAGIDIDMDTVYRDFSTLDSINQTAGRANRNGLGEKGEVYIYNIIDDKKRPYCGYIYPHHLLDCTKSVLLETEINEKELYEVNNKYFKEVQNRSLNEIGENVQKSIKSLDFKTFRDNFELIKKEEWKKDIFINADNNSDEILKKLENSKDFSNLEIKNLFRALNNYRISINTQKYDKIKNNLISVDKFELEYLNIDNYSVEEGILDNLQNEIFF

SEQ ID NO: 11609 - protein, 772 aa, Methanococcus aeolicus Nankai-3
MELISHPNPDYPLKKHLIMTKNRALSKYNSLKLKYFNNAIIKDILKIICLSHDFGKTTTYFQKYIRNEKIEKRILKRHSEISFVLANYVIKSYLESKNIDNKYYQIFSLCIKKHHGNLSELLNDASIQDEDILKKQFDELNFNFINNILNENNFPKLNCDIEELISEVEELEYLCDDLKYEINDEMKIETYYLYQYLFSLLISSDKEDAIFRQNTELGVSNEIPSDIIDYIENKPKIKPIDHLRTEIFYKISNKVHNLDLNQKIYTLNAPTGIGKTLTIFNFALKLSNRIKTEKNIDMKIIYCLPFLSIIDQNYKVLNEVLKNPPSNILLKHHHLSDVVYWHEKNGEENILDENKSLHLMETWSSKIITTTFMQLFYSIFSNKNSDLKKFSSLSNSIIILDEIQSIPHKYWHLVNKIFRFLAEEYNIYFILTTATLPMIFDKNECVELLDDKEHYFSNLNRIKMKIHNEPMDLTEFVGVLDEDINNNPDKDFLIVLNTIKSSKEVYDLLKEYNYENTEYYYLSTNIYPKERLNRIEKINKNNKNNNRKIIVSTQLIEAGVDISVDIVYRDIAPLDSINQTAGRCNRHGEGTEQGIINIVKLINDNGHPFSRYIYNGALISKTEELLKNYDEIEERELLNINNCYFKKLKGYDDSSRELLEIIKSFKYNNVPKNFKLIDEIPQINLFVNVEDDAKKVYAEYERIKSIKDPFKRKREFLKIKKEFYQYIISIQKHAIKGKDILIDENKDITIIDNKYYNIETGFNAVEDNMLIL

SEQ ID NO: 11610 - protein, 811 aa, Actinobacillus succinogenes 130Z
MNESFIAHIREVDKQRQSVQVHLLETAVIASMFAVKLDLSEAGELLGLMHDFGKYSTAFQEYIRAVTGQDPDADNDYVLPNGKKIDHSTAGAQWVYRRLKKFGLQNGIGELVGQILGLCIASHHGEGLIDCLNMNGEAVWQKRFDKEDELTHLSECEQRADKAVKIRAEELAGENLVKSLLKLLAAIFKNPDSNDKIKEFYLGCLTRFLFSCLIDADRINSADFEREEQKDLRRLNQSPDWQQAIDKLETHLANFEIRYPIDEIRREISSTCLKRANDPQGIYTLTVPTGGGKTLASLRYALHHAHKHNLDRIIYIIPYTSIIDQNASAVREILGEDWVLEHHSNLEPEQQNWQDKLLSENWDKPIVFTTMVQFLDAWFGGGTRGVRHIHPMTKSVLIFDEIQTLPVKCVHLFCNVLNWLTQFGKSSAVLCTATQPLLDNLPKSEFGELKLAENSEIMGQNKTLNQLFDDLSRVEIHYKPKAGGWSADEAGAFLLEQFQTASSCLFIVNTKKWAQELYQYCQRQDVPPEALFHLSTNQCSVHRKAIFDEIKGRLKNKQPVICISTQLIEAGVDISMSCVIRALGGLDSIAQAAGRCNRHGEKVGKGQVYVLNLQEPNLARVLPDIDQGQQNAERVLREFAEQDILQPAAMRQYFEYYFYNRSNDMSYTVKGSTSGSLLDWLSDNRLNVYAAKNDKRRPKLPLLMQSFKSAGRAFQAIDAPTRAVIVPYSKGKDLIAELCGVWNPKEMYRILSKVQRYSVNVFPNVWEKLEKEQAVQEVQAGLGIYYLKERYYSDEYGLSVDEVGAMTFYEL

SEQ ID NO: 11611 - protein, 741 aa, Bacillus cytotoxicus NVH 391-98
MFLAKSNPKETLREHTDELRSRYKKLKESYGHYFDERIWELLLYAVDYHDAGKAHEPFQLNIRRALGEGVKLQRNLEVPHNYLSPFLLPESIFSLPKKDYQALIQAIAYHHERDIEPNDTLIRQALWQDLWPKMDEINKHLNINGANLEKKFNRILAQLHRRIKYSDNKENYVDYVILKGLLHRIDHAASAHVDIEIDAKQDFKKLVDAGFQKIAEKKRVPVEEVYRDLQKHAHKHRKENLIIVAQTGMGKTEAALLWASDSKTFFTLPLRVSINALFHRVYEKMNYKNVGLLHSSSMDYLTENLEEDWEVIAEQSKHFSSKLLFTTIDQILKFPFLYRGYEKELATMAYSSVVIDEIQAYDPKIAAVLVRALEMIYLVGGKFLLMTATLPSIYLETLNESDIISSDGFRVDTFIDDCVIRHCIEVVEKPIVDDFEKIVDLGKQKKILVIANTVKRAMELYNKIKEYSDNVHVFHSMYIQKHRTLIEKELLLFDENKEATGIWITTQLVEASIDIDFDVLFTEAATLDSLCQRFGRCYRRRQYMMHQEPNVFIYAVDMSGVKYVYDEEILMKSLDILRPFNRKILLESQKIELVSQLYSRENLKGTEFLKTFDDALEQLQTFEDYTLSSKDAQKLLRDIQAELVIPRNIYDENEHLFEQLKIVNKEERARLYREIAKLTVSLRKNRVRGKTSRIPHERIQSNGKKYNLLPWIKILELQYDFDEKSKTGTGVLLDQELDNFI

SEQ ID NO: 11612 - protein, 792 aa, Campylobacter hominis ATCC BAA-381
MFSVNDSFWAHKRDDKTPETLNEHTNLTKIYLEKIKKAKNLDIVINDLIVKILKDKNALKFKCLMLEIFDNLIIWHDIGKINPTFQAMKMKNKAYKRDRRVASTHSDKSFKEIKKSYEEEVFKTHNDTVIFLFYHLLSNVLNHHSTLKDGLNYDILGESILDVSFRNIDREGSQQSKEIYLLLKLHYSLLIACDFYATSEYMNDIETTDFGIFSTDEKERFFNKFKTFYNSLSKDKEIDILRNEIFKSSEQTLLENLNKNIFYLEAPTGSGKTLTSLNLALNLLNNNGNLNKIFYIFPFNTLISQTYEVFKNIFKDDEKIAVINSITPPVSKNTDDTYQENDESKYEKTYINRTFFNHPFILTSHVRLFETLFGVSKENNYPLFCLANSIVIIDEIQSYDPNLWEFMAFFLDEFAKFYNIKFIIMSATLPKISNLINSQNEWVELLKNREAVFSNPLFKDRVSPDFSLLEIKKDKIFNELINRAKEKETDKILFEFITKKSAREFYNFILDKFNGYDIFELSGDDNKLYRKKVIAATKEDKKCIVVATQIIEAGVDIDMDLGFKDIATIESEEQFLGRINRNSLKQAKVYFFDYDDANKVYRDDERMKFNTKDENLRKSLINKNFTPYYNTLLNELFSKNSKAENSLVSKRDEFFNEISALNFMQISNKMKLIKDNSEKIFLPFSIDIKKFDMSEYGDISELLDDENKLSGQKVWEAVKNINEVKSYSKRKIKVISLNALAEIFSFNVYNKFLPSPQYGYHFIDDFENLVDENGKFLRENFDNKFKNESMFL

SEQ ID NO: 11613 - protein, 800 aa, Fervidobacterium nodosum Rt17-B1
MAPFFYFLTSKLIGGLRVFYSHPDKRLIEHLKEVYEISQEKINDGDLKKCFKIIAYTHDFGKFTTYFQKYLETKKEGKYAKHGFISALFAAFCSLKEFGTESFLPLISYSVVLHHHGDLENVDNHLPISTRGIMNSDYKLADKIEIFEVQRNDIIKNKDSIIEEYKTIDEQEEYKINFVEYIQKFLECDIVEVLKMLKQIKIKLEKEKSDDVFFIHQLLYSALISADKLSASGTIIPNEAFASFAELNRGREVMIKTAINNLGINEIRNEIFERIQKNLEKYYNKSRIFTITAPTGTGKTFAGFFAAVKLRELLGGNRRIVYSLPFTSIIDQNYETIYQIHKVLKNFERESSKYIIKHHSLVKPEYIENEYKYDLLESELLIENWSSGIIVTTFVQLFETLISTRNRMLKKLINIKGSIIILDEIQAIDISLLPLIEYVLEKATELYDLRIILMTATKPYIFKDSLELLDNNEKYFSIFNRTTLLPNLSSRKLEDFIKELKENLQDKSYLIVCNTINSSLEVYENLKGINRPVFYLSTNLLPIHRLEKIKKIKELLSKGEKIILVSTQVVEAGVDIDFDVVIRDIGPLDSIIQCAGRCNRNNLKENGTVYVYSLIPNESNNDLTYGYGRYIYGLTTLQETKKILQKSEKYSEKDYFCLISEYFKSIQENLSKKRSENLIKSIKTLNFSEDKSENITPISDFSIIENKPNFVDVFVMCDDISEEGFKRFCDIIKLKDYYEKREKYLEIKPIISNYTISVPIEYHSSFVEQFGLYVIPREIVNDYYNYETGFKRHKKSYDII

SEQ ID NO: 11614 - protein, 859 aa, Roseiflexus castenholzii DSM 13941
MALYPYQEQVKSHLLSGCSVVLQAPTGSGKTRAALAPFIEAFFDLPDDAFPKQCLYSVPMRVLASQFYREYRTLAERYERIHRRALDVRIQTGERPEDPELVGDLVFATLDQTLSSALGVPYSLSTGRANLNVGAVLGSYLVFDEFHLFPPEATQATLQLLRLVGRLAPFLLMTATFSQTMLESIGKLLDAEVVVVPPDEVASIETRQGQRPRKQRRFEVADQALDAKAVLAAHGRRSLAVCNTVDRAIALYEQLRQAGCRPAPVSDPTLAPIYQALAQARGEEWDRAVAQGVQILRERLAEGGEDKPWVMLLHSRFERPHRQLKEALLQALWNPQGLEAGGDPSLIVVATQVVEVGLDISAQTLHTEIAPAASVLQRAGRCARYPGEQGRVIVYPVPAKENGEPDYAPYSSKAEVAVCDRSWQAFRERQCAILDFAAEQEVINQAHSEADAAMLQAMQEGQGELWQRITDALVRGDASARPQLIRKVDSRTVIVYEPPFGLSEESPYRFQGISLWHGTLRGKLKALNQLRGDLGLDWAVRYPVAHGDEDDESITYTWKDAQTPDDISLSLIFAVHPRLASYDAEHGLRLGVASAGSYTSPTATLRRQRPDYAGYQLESYADHIAAMRRVFEGDPTSRIPLANGRLRRRLAWPARRFAEQDGDWRLPQGLLERAVRLGFALHDVGKLSEAWQRFAAKYQKAIGEGAPPFLVAHTHYERGNPAHEEAQKKVRCYKPSTHAGESAFASAQLLYEALEGRTYAGLYRAAFAAIARHHSPGLDKANPYRLHPRAGETVAEALAVVGDTSWRDWAQWLRSKEEAPNVRKHLPEAPPDGDWAWWFQYFIIVRILRLCDGLSQEEG

SEQ ID NO: 11615 - protein, 779 aa, Roseiflexus castenholzii DSM 13941
MKPSPWPDWMDHILAKSQQYGGETLAAHTWDVLVKLSDLYRLRPRLDNGSQLWHCLYWAAFLHDFGKAARGFQQRLRGGQAWSHRHEVLSLAFVDTIADGFTPEEQRWLVAAIVSHHRDEPEIAETYPPGLRRDPLVDLCNELEPQVIDHLQRWLTECANPWREALGLAEVVGKITPQSVTVNPKRVRYWLQVYHDWVAANDPAARVPGILLRGLITTADHMASAHLHRVPPPITEPWSALAKRLLSQGQQVYDHQQQSGEMKGQSALLMAPTGSGKTEAALYWALGDGAAPPARIFYTLPYQASMNAMYDRLRQNFGDELVGLQHGRAAQALYARFREGEEWSAAARRVQWEKNLNILHARPLKVLSPYQLLKALFQLRGFEAMLTDYAQAAFVFDEIHAYEPERLALITGLMRYLREQFAARFFVMSATFPQLIRKQLTVALGDVPVIQACPEIFTHFRRHQLFLCDGELIDPTTIAAIVAEVQAGRQVLVCANTVARAQALRDQLAQAGLTDDQLLLIHSRFTYGDRSRIEQDIRARCGSNVTPRPPLALVATQVVEVSLDIDLDTIYTDPAPLEALLQRFGRVNRKGAKGICPVYVFRQPTDGQGVYGRDRDPQQAGHIVRVTLAELEQHNREIIDEAAINQWLDNIYADPVLSQQWTEAYQRMAQQVELIINGLRPFQSDEQREDDFEQMFDGVEVVPQCFEQAYVDCLVQERFIEANDYLVSISKQRFAILRNQGKIRPAEEVGQRRVWVALLPYDSRNGLSFGDTTYDPDWS

SEQ ID NO: 11616 - protein, 543 aa, Ignicoccus hospitalis KIN4/I
MPFKPKAAHEEAVRLLEESNVVMVAPTSYGKSKGVPYMQDRLKLPRSVHSMPLRSLVISQYNFLLREYGEACHASGLQLEGKCPYFGGKRVVSTVDYLSLNLLRLPPAELGWALKYSYGHYEYPRANLFSSLVVFDEAHLLSEPWSGGESAGRDFLHASLEALGALSQGLRFKVLVATATLPEVELKKIVKKMKPKAEVVAVCKGCYGGLRNIKRVNDFSSDVRWETEAEGVTLLNYLQSELKRVEDEASSGKVLIVANTVKEAIKAAELLRPYFGSDLVLVHGRLSEEDKKNSVNKIEKAKVVVSTQVIEAGVDVDATWLITEAAPVSSLAQRAGRLCRSRDCDVAKVTVLAPSKGDPYGDASEKAFKTVKEVAEGGGIEWRELDDTQSGKTFLSLINALESNFKPYQTKSTITKIITTPLPNIKGIKELLDELCSFVRDSALIELRAGEERLEVSLSWLAGALKRGLEVSGVKAVKFGGEEPLSEGDVSNFLKRLVKAKNSPKASCRAYSTLLEKYGALSLAVEVPADEYRKGWGMRVDLR

SEQ ID NO: 11617 - protein, 744 aa, Pseudothermotoga lettingae TMO
MLDGLKSHPERLLLDHINGVKKRALEKANSIKWNNFGITEKDAIKLIEICALCHDFAKASSGFQKYITSSKKGVHVSHAPLSSIITYHIAKNTGFEPKYASFAYFVVRCHHESMKDFQAFGENLEALEKQMSSIPKEFIDWVESKLNTQVTPKISEIYGKLEKDVAKLNFFRPFSLKDYLFVHTLLSILVSSDHEDAALHDTPLILKTRLTLENLRKYMHAIPEDNPLYSLRKEFHIDLDNSLKYLDDSKIYSITAPTGLGKTLANLKVALSLSDESLIVYALPFINIIDQTVETFQKIMQDTEFDASTILPYHHLANPKYEEDIYGEKAIQKVLIESWHSQIVVTTFVGLFESLLTSKRVPFFYKLLNATIILDEVQSIPHKYWNPLADILSCLSEFGTKIIFSTATQPMIITKTRELINKNYNSKLNRTRIHYCGEIDYPSFMKQVEEEANKCLEKNQRLLVVVNTIRQSKELFNHLRSTIDISKLVYLSSNVIPKQRLERVSGLKKLKNQGIICISTQVIEAGVDLSFNKIIRDEGPIDSVIQVAGRCNRNFETPISSAHIYRVIDKERNRSFSSYVYDHFLLDMTRELLSSKKEFEEKEFPEIVSRYFNMVKERGNTDRENLTEQLRLLKFEEISSKFKLIEKRYDTVPVFIEYDEYAQFLRKKLNETLNSKMEKFEKLAQISELIRQMSLYTIDVPLKSEDLRGALLIENGFLVVTKDNLNYWYDEYTGFQRSQELMIF

SEQ ID NO: 11618 - protein, 929 aa, Salinispora arenicola CNS-205
MGVDHDGVDAGIWGKSNHLPRPYPLLWHLIDTAAVAGALWDRYLAPNQRRVIAEGLATDDSHAKSLIMFWAGLHDVGKATPGFQKKDGSAFDALRSAGSYEDVVGDGSLRHDTAGQLAMPDLLAPLGYPPLVRRVSDRLAYRVAQIVGGHHGRFQQTSGPHGGRLQLGEGGWSKQRAALVRVVHEAVGSPERPPAIGAAASVLVTGVVILADWLASQEHFLRQQSSRVPQYTGAEAVSTHLAVLSAPAAALLDDAGLGSPSYRALGFEDLFPHRPNALQRSIIEELLPVVDSPGLLVVTAATGDGKTEAALVAAKRLAEVCGAHGFFFALPTMATSDEMYRRVRAFAARLAAGPAPVTLLHSMSWLNAEYEARAGVDPGDAAEVVSDEPSGDVVAPEWLRGPKRGLLAPMAVGTVDQALLAVLTTKHNALRLLALSGKVFVVDEAHAYDDFTTSLLCGLLNWLGAYGCPVVLLSATLPSSQAATLVGAYEEGAGVGPTNTSVPYPGWTFVPAIQGRDTVSISPTMREALVSGRTVEFTLDVRPVRHLVGSESDPADRRAVVRQVLAPVAEQGGCAAVVCNTVNDAQQTYRVVRDWASGGVDVVLLHSRFPARRREEITTQIIGRLGKDGHRPRSMIVVATQVLEQSLDLDFDLLVTDLAPMAQLLQRAGRCHRHRRTRPPWAAQPRVVVLDPRGPDGVEHVRPAAWGDVYARYLLRATHLRLAGTDRIAVPHAVQNQVEAVYSPQSVDHDLVLSAEYDEYRAEAMALRGMAELGVIPDPAQVADLAALSLTETPEWRASTRLGAESERVLCCYLDAGGRQWLDPERRILLPQRGARPDGRFSSQEVRMILQETIPLRTDILMGYDPPAILPASWSNNAWLKRLRPLWLPILPDGPGSAAWARRSVHLDPELGLVVLSSSEGRQPGVVSE

SEQ ID NO: 11619 - protein, 582 aa, Caldivirga maquilingensis IC-167
MPNLKPRPGIDKLLEVLDSKLKGHEKPFIIAELPTGYGKTTASPYIYKLVNEYGISDRVIHVLPLRAIIRKLIQDITDEGTWIGSLFREIRLGINDIAYQMGEFVVNVRKEPFFDAKYTLTTLDSFVHNLFKIPITELYRDKKHYFIPLGRIFTSTVLLDEAHIALAAESEKTISTVIASINALLSSHVPIVMMTATLPSKYEKLIIEKVNNIKKARPIVIRLGKKEEVKSNEITIITVHDPDFENTYSNVKYVHEKVSKLRIIDKAMDEVNNGRRVLIVLNNIRKVINIYREISDRINDSDIALVHSKLIGRDREMYESRINKVKVLIGTSAIEAGVDVSFDTLITTIDNPMSFIQRIGRICRKGPDDCADGEGRIYLINDDSDNLEGAINYVLTKKINWRLPYNVSNDFMGYMEFLETFTEKMGAITYDERHLSILNRVFMNIYISSKTLNELLKLTRGSLLREPLINVFIGDLNKPCSDVGINEFLERSFTIDLSEVVLNKSGFCAKMKECMVGIGILENDVLSCSYLTNDSEDFKKSLCTDNVYNMFFKLVEKYKAPLVIIIKDECYEEGIGFKLHGG

SEQ ID NO: 11620 - protein, 733 aa, Acaryochloris marina MBIC11017
MTAPATSNFYRLHPRVQQWIASKKWPSLREIQELAIPPILAGDKDVIITAATAQGKTEAAFLPVFSQLVDQPAKGIQVIGLGPLKALINDQHRRLSAIGDCLDVPVCPWHGDIGSGPKQRLLKQPAGVLLITPESLEALFVLRGQELNRLFASLSYIVIDEMHSFISIERGRQLQSLMQRVEQVVGRPVPRIGLSATLGDMSLAAEFLRPGQQERVQLVQSFAKGDELKLQLRGYRSSPTPDPDEEEDETTPPPDALDIAQHLFQSLRGEKNLIFINSRRQVERYADILRNLSAEYRVPNEFMPHHGSLSKELRAEAEEALKRDHPVNVICTMTLEMGIDVGAVQSIAQIGPPSSVASTRQRLGRSGRRAGDPAIMRVYVSVPQLDSYTSPEQALYPDLVQAIAIINLLLEGWYEPPIAGRLHISTLIQQLLSSIAQQGGIRADQAWHDFCEAGPFQEMEQGLFIKLLRCLGERDLIQQSQDGLLLLGLKGERLVNHYTFYTAFSTTEEYRISTPENVLGTLPTSMPIAEEMVLLFAGRRWQVQSVDSEKQVVMVVPADGEGQAPRFGGSSGFVHDRVRQTMREIYRSTDMPVYLDDTAKTLLKEARTQFRDCGLDQEYIVGEDEQVLLFPWRGSLVMNTLQMLLLDSGLKASQEGLAIKVKGVEPDELMPYFQSLVNLGPANPLRLADVVRTKRSEKYDWVLTDELLNHNYVARFFDPQGTWETVSEICSGG

SEQ ID NO: 11621 - protein, 804 aa, Herpetosiphon aurantiacus DSM 785
MRDGFVEPDFLMAILAKSADRSEHNIPETLARHTWLVVTKVAELAKIRPDLTVVANTADLWHLLYWGCFLHDFGKATGGFQQQLQGVSWNGHRHEVISLVFLDWIAANFPKHQQAWLSAAIASHHRDRGIIQEKYVVDSVLAEAWSTFDLTHVPLMWRWLTEYANQWIGLLGLDAVGVRPLQFPNADQAIQHVQTDACSRIRYWLCQYYRLKQVFDDQPAHAPVPLLILLRGLTTTADHMASAHLAAIPQPIQENWQALAKRILNADQQPYSHQQQSADAHNTSCLLIAPTGSGKTEAALYWALGEGEQPVPRIFYALPFQASMNAMFDRLRQPAKGFGEQAVGLQHGRALQVLYLRLLESENGLDSRTAAEGERWERNINSLHARPLKVFSPYQMLKALFQIKGFEAILSDYAQARFIFDEIHAYEPQRLALIICLINYLSEHFAATFFVMSATFPTIIREHLANALGRHQVIHASASLFQAFARHQLQLLDGELISASSIEHIVNDFKAGKQVLVCANTVRRSQTILALLRDAGVAESDLLLIHSRFTMKDRSALEQRVVQRCQLGLDQPEPFILITTQVIEVSLNIDLDTLYSDPAPLEALLQRFGRVNRSRKKGIVPVHVFREPRDGQGVYGRSKDPKQQGRIVQVTLSELEKHNGEIIDESMIDQWLDTIYADAILAKQWQDEYQKIYDNAQWIAHNLRPFESDKTTEDQFDELFDNVDVIPQSLVQTYLDLLNNHEYVESSRYFVGISKQKYAQFKQNGLILALEDAALKHPRWIINLPYSSESGLSFEQTTTDDDWS

SEQ ID NO: 11622 - protein, 844 aa, Lactobacillus helveticus DPC 4571
MVGNFIGHTKKLKNNTIETQSLRDHLLNTQKYAEKYASDLSLEHVAGLAGILHDLGKYQSKFQEYIIESTRKGDQSKKGSIDHSSFGAIFLRDFISENFSEKENYYDFLDFGGILENAIFSHHNYLGLKDYINPDLMSPFLNRIEKFKDDEEKKRQLKKCKELFYKDVITEEKFTKYFQLAFDEYEAFISKIRNKVTLKTEQILNENAKNNKQVMLELQAKYFLSEYVYSCLLDADRTDATAFKLSKNPNFSDNTELFEKYYSKLVGKLHKLNKNDNSKINQLRAEISEECDQAAERPSGIYTLSASTGSGKTLTSLRFGLKHAKLYHKKHIIYVLPYITIIEQNSEVIRKFLNDNKDDSQNILEFHSNVSQKVADKSEETTNTLDLTEDSWDSPIIVTTMVQFLDSIFASGTKHRRRFHNLCDSIVIFDEVQKVPIKCLDMFNEAVNFLKNFGNTNVLLCTATQPALEEVKQKLDLNIDHEIIPNLIEHEQQFKRVEFIDKTQNDDGIDLVLNSIQAAELIFKKSQNFKSILGIFNTIDVTKKIYSNLKNKFDSISDQIKLEYLSTNMCPADRKERIKNVLNLVKEGKRVICISTPLIEAGVDASFECVFRSLSGLDSLVQAAGRCNRNNELKLGKVYLLNMDPSEEHIAKLNEVKTGKDQVLELLSEGIKADDFLNANVIKKYFEMFYSKLASTMSYPTNGINLENYIDGIKNVHELAYQSKRKDASKFEKLTQFSGSETIAKYFQVIKNNTKSVLAPYGDKGEKLIADLNGNQDINSLIMLVKDAQPYIVNLYDNKFNQLFEEGDIYTLCQVGNEVIYAFRPYAYNKLVLGDRKQIEKSIF

SEQ ID NO: 11623 - protein, 730 aa, Petrotoga mobilis SJ95
MKLFGFLNGQESHPDKLLKDHLEGVFEKSKEISNFHGYNDLVDPLKPICLTHDVAKSHVKFQQYLKTKKGKYPHSEPSSYLTFMLTKDVFQAEIVRRHHSYQLNFEDIMSFWRNLNYQDVIKALEEFLDLNKIEYLTEKEWKRLIFQSWHSQYLLNKTVKAEELWFNTRIENSIFITSDRLDALNVDRINFDKISYQQDRFDKFLESLPKNHLSDWKNKIRESTLSNVDTISEPGIYTITLPTGAGKTLTGLQASMKLANKLSLKTIIYVLPFISIVDQNSEVAKKIYDKVQEDHHLVSASKEKEDLDNLERFILSFRYFKEPLIVTTLAKFWEVLYSPNANDSMSFHRLKDAVVILDEPQSIPPEYWQGFGETMSFLSKKMGTYFILMTATQPKIAEGKELAPKSSFPKNRHCYNIVNEKIKLSDIKQFTADRTDNSSLLILNTRKEALKAFILLREHLKSNLFFLSTWVIPKERLERIKQIKQLENKNLPRNLISTQVVEAGVDLDFDYVFKDLSPFDSIVQAAGRCNRRMLNKLGTVMVAEIVDDDSENERSYASYVYDSISLNKTKEIFSNKNKFSENEVQELLDKYYTALSVSKYQKGPWYEIKEGNWSNYKPLIKEHLYEDVVFVDSDGTVSNKLYEIESLEHSLENYERKKQLWKEIQNYSINVPHKELEEWENYCNEVFLEDDKKLEYKGNGIWLITQLGIGEIYSEEVGFIPYELKEDFHG

SEQ ID NO: 11624 - protein, 801 aa, Chloroflexus aurantiacus J-10-fl
MQLYPYQQRVKDIILAGENVVLQAPTGAGKTRAALVPFIEGFFDRPDTTPRKCLYVTPMRVLANQFYAEYRELAARYQRLHGRQLDVRIQTGEQPEDRRFEGDLIFCTVDQFLSSYLMMPYSLPYRLANVNAGALAGAYLVFDEFHLFDPDAALPTILHVLRQLHGLAPFMLMTATFSSAMLQSLATLLQPAQVVTLSAAEIAAINTRGGQPARQRVWQVADQPLQAAAVLAHHQHASLVICNTVRRAREVYAELKQQAPPETEVLLLHSQFLPDDRRQIEAKLRSRLGVSSQRQQANLIVVATQVVEVGVDISVEVLHTELAPPASLIQRAGRCARYPGDTGTVIVYPVETYVPYAFKPDEILKHEMDATLAWLKERQGAVFDFDHEQELVNAVSAARDQNIIAGIQADRHNRRASIQGCLEGQRAGASRLLVRDVDSRLVLIHPDPDQLLASPYDAVGLNIPLYSLRSMGKDWLQRPTDAPWRVRRLDESDAGDQAESNRPLYRWVDVHDSKELAQSAIIVVHPALAGYSAHEGFSPETGNLPFISTLPPARPLIDRPRSSLYVETYAEHIQRVLDAFQELVLPELRFAASALECAAGWSPGSVLRAAWLACLFHDVGKLSKGWQQWAHAYQQAIGQPVAKTIALAHTTFDFQNPTHRQAEREVSRSTPRPRHAAEGALAVAQILAGAFNISHEKELVQAILTAIARHHAPFVQDCQAFSLVSEAGNLIQNTLQFLPEEVNYSLNINDLWVNSHHHQQFAELLIKPTSRYGWIAYTLLARALRRADQRGTEMGAGQTLP

SEQ ID NO: 11625 - protein, 784 aa, Chloroflexus aurantiacus J-10-fl
MKPLPWPDWQEDLLAKSQQYGGETLASHTWDVLCRLADLYRLRPNLADLAGGVRLWHCLYWATFLHDFGKAAAGFQRRLRGGPAWSHRHEVLSLAFVDAIAHDLNELEQRWVVAAIVSHHRDAPEIRELYPAGLRKDPLSDLCAELQPATADHLHRWLGECANPWRIELGMADVVAEISPQSHPIDARRIRYWLSVYHQWVDILTAAGTATTARIPGILLRGLITTADHMASAHLQRIPEPIRHSWQAVIPAGRETYSHQVASAGASAQHVLLMAPTGSGKTEAALAWALGDGSNPPARIFYTLPYQASMNAMYDRLCGLFGNNVVGLQHGRAAQALYARFRDGEEWSATTVRKVQWEKNLNLLHARPLKVLSPYQLLKALFQLRGFEAMLTDYARAGFIFDEIHAYEPERLALITGLMRYLRRHVAARFFVMSATFPTLILEQLSDVLDTPTIIQATPDIFARFRRHQLYLRDGELTDPAIITEIVTAVRDGKQVLVCVNTVARAQMVRDLLMQAGLSDEQLILIHSRFTYGDRNRLEQTIVERCRSDSARRPPLALVATQVVEVSLDIDLDTLYSDPAPLEALLQRFGRVNRRAAKGICPVYIFRQPNDGQGVYGRHRDPEQAGHIVRVTLAELERHHGDIVDESAVQTWLDTIYADPLLREQWLTAYQNISRQVEQIINGLCPFQSDAQREDEFEQMFDGVDVVPACFERDYVSLLVEERFIEANDYLVSISKQRFAILRSQGKVRPAEETGQRRVWVVQTPYDSRNGLSFGDTVIDPDWS

SEQ ID NO: 11626 - protein, 778 aa, Thermoanaerobacter sp. X514
MKYYSHYDEEMKYEKLLYEHLIEVKNLSINQIPEEYKKAYEIIALCHDFGKYTSYFQEYLKTKKKTSLSNHSFISAVFGGYVAIQYYGEENILPLIVYNTILHHHGNLESFSVNLPSKFKDVSRKDFPLNVSEKIDISYKQLKDMRQNLSFIIPDFERLGLAKEFKQFVEEENVIKDTLAILKKLEALSIRRLKSDENYFIHQMLYSALISADKISASNTYLPEELYVDYKTLNKIRENQFEISEKDIDKIRTEIFKVVIENLEKNYNKSKIFSITAPTGTGKTVTGFFAALKLKELLGGNRKIIYSLPFTSIIEQNYGVLFELLEKLDKFKGNSSRYIIKHHNLAMIEYESEYRDYKKTEAELLIENWQSGIIITTFVQLLETLVGARNRMLKKFNALKGSIIILDEIQAINIKYFQLVDYILNKASEYLDLRIIIMTATKPMILNDAVELLDNNEKYFSIFKRTRLMPQMEKLTIESFIEKFKENLEDKSYLIVCNTIMQSLEIYKRLVELGLNREIFYLSTNILPLHRRERINKIKEKLEKEEKIILVSTQVVEAGVDFDFDVVIRDLGPIDSIIQSAGRCNRNGKKEIGDVYVYKMIDEEENLFGKYVYGNTLMNISENILKRYDTIMEEKYFQLINEYFSMVMQNKSSQVSREFIKSIENLDFSEGEYAIDSFSLIENNPGYFEAFFIYDDVAEDIFKKYLKLSNIKDFNARREAYLEIQKNIKDYILSLPKKYINNFQLDKGIPYLPKEGIKDIYDFKTGFKRDIDDKYMIF

SEQ ID NO: 11627 - protein, 784 aa, Thermoanaerobacter pseudethanolicus ATCC 33223
MSSFSELYSHPDKFLEDHLINTSKIIRSYFNEKKVAIIDKETFLKTATIISLCHDFGKATNYFQKYLFTENEKERNKLKTMEEMHHSLLSAVVAFYLVKNEINAQDRKGILFPFIAFLIVKNHHGDLKNVFNEVILDDKELEVLKKQLNSIDDEKLQVLNGKLRNAGLNENLTKSAINDYIDSINSELRKIKRELRRLKEEQDVSIYLLLNFLFSLLVDADKTEVVVGIDNIKRPEIKFEEQLVKEYKASFPDKESKINLLREEAYKEVLEKDIDIKQKIMSINLPTGLGKTLTTIAFAMKLWAKLYKETGVKYRIIYSLPFLSIIEQNSNVLEDLLRYNGIQPDTEIILKHHHLSDIRYTKNNTEFEDEQAKILIEGWNSEIIITTFVQFFHTLVSEKNKTLRKFHRLANSIIILDEVQSIPFKYWLLTKELLKAVANELNSYIIFVTATQPLIFREEEIYPLVAKTKYFTQMDRVEIIPKLSRDITLEELSEMFDLNDGKSYLFILNTIKSAQQFYNILRAKIPNDEIIYMSTHVVPMERMERIEKIKEGKIRFAVTTQLVEAGVDIDFDVVVRDIAPLDSINQSAGRCNRNWRGKGEVYVVSLIDEKGQKYSKYVYDKILLGITREILSKYDTIKEQELLKIIEKYYQEVSERMSSNEGRELLDAIYTLRYDSEDGNMCISKFELIEDDYYKVDAFIELNDEAKELWHKYVELKDIKNLFERRNIFNRFKADFYKYVISIPATVENMPPDIWGFKYVNYDSLNDYYDKETGFITKGVTSIW

SEQ ID NO: 11628 - protein, 754 aa, Heliobacterium modesticaldum Ice1
MGLALQGHHGSFVVPCKRVDDGSASINELWKQLRLQVVEELLRFFQMDIWKQQDFPDHSTFGMLLSGITVLADWIASSEAFFGGDIPDWHQAKQKNFEVLALQFLDQVGLSGKKPINAEMTEEDSFLRFWRHLHLPSLRPLQALCEQIARSEKTGGLAIIEAPMGEGKSEAGIYLLNCWVAGSGGDGMYVALPTAATANQMYSRVQELLSNQGTEKGLRLVHGMAWLLDLQKQYWEEDEREDWFRPKKRALLAPYGVGTVDQAMLAAMRVKFGCLRLLGLAGKGLLIDEVHAYDTYMNTIIDQLLAWCGHLSIPVVLLSATLPVKRRKQLLEAYGGDVIEGAVNQQYPLVTVAVDAKTCEFPVLPSRPNQEYNLRMLPGALENAEAIVNAVLDWADAHDSGCAGVVVNTVYMAQQVFRKLKKLHRKGRLPSDVELLLYHARFTAGRRKAIEDKVLRWLDKGSLQDPARRPKRAVLVATQVVEQSLDIDFDVLFTELAPIDLLLQRIGRLWRHERPRRLNHAESKANVSIFAPEIAERFYWGKTGAVYEPLVLLKTLAVLQKRNQFQLPQDFRPLIESVYDDEIANVPDEWLYSLASVREEYRKNQVEQQQRARESLYPKPLKSELAVTPIFAVNEEVSEGEVSSHLHAVTRIGSETRSVLAVPKDEWERVGQGLVSHEQLHHWMKYHVSLPEKWLSGCELPALKPYRQWSVMPMHPGSPSFWEGTSKGGNVIRIEYDDELGFRLGKEEPNATSL

SEQ ID NO: 11629 - protein, 837 aa, Heliobacterium modesticaldum Ice1
MQPELTALFTQITGKKPYGFQTQVAREVLEQERVILRAPTGSGKTWAALLPFLYAKENRTPWADRLIYAVPLRTLGKNLYSTIKKRLDDQFPGKYRVTMQTGDVPDDPLFEGDIILCTVDQLLSAYILHPYAVGPRRANVVAGALSGAYVVIDETHLLTPRESLATAVDMVRRYQGLMTALFMTATMPDTVMDEVARRCKAKTITVTEEQMESDPQSRQVKPERRIHRMTIPLSPEAVLSEHRTSSLVVCNTVDRAVRFYQTLKKMLGENKSDIPLFLLHSRFLPEDRARLERRITEQFGPDRTGRGIIISTQVLEAGVDISADVLHTELAPANAIVQRSGRVARYGGLGSIFVYDITEDGKRNYAPYFGVSIAANASSATNDINASSDEAEARRIMDATWDSLEKWDGKVIGFTQELAWVNEIHAAVEQRALRSRTERKVIDDVNAAMRSQSSHFLRDLVRNAASINLLVHPDPNTLDMRRQPPLFSLHPGVFRRIVRRVLRGEQDGAMWFMDFRENDEIIWMEIKNEKDLDGRYFFAVSPQLAAYHPEIGLTMESGTFQCKEKLDKPPVYERFRYRKELLSDHLQAVAGECEQQGKRNQAAVARWAELLCLRTDTIESFSWLGAAGHDAGKASLQWQTWARNYQFVLTGKVEEECLAHTDYDPENPRVKEAEKSKRKPSHAAEGAYYLFDRLLQPVADGLIPDDLPKAEIIARSVMTAIARHHGPHVKELNRQIEFCGMPDAVANWLSEQVKTMPVDTAILENIGLQSAWKSESSFDRNRFAKLLVDPKLNECGNNVLKELAWLFYLYLVRRLRMADWASMERAHPEKEVEKGDC

SEQ ID NO: 11630 - protein, 443 aa, Ureaplasma parvum serovar 3 str. ATCC 27815; identical to SEQ ID NO: 11529

SEQ ID NO: 11631 - protein, 795 aa, Candidatus Desulforudis audaxviator MP104C
MKIVLPDFDHIWAKSRVGKATSGETLVSHTQRVLANVVALHARMPELDQLSQMPRFWSRMALAAVLHDVGKCAGGFQKMLRGNGEFPFRHEVLSAAFLPWLLDNDPHQDLPWVAAGILSHHKDFSILERDFPPGCDWEEPPLSDSLEQVALDLDEEFFHLAPKMVLYGLLPLLKGCLLLASNERFILPASDGTFDRSTFPGFARRALDAYAQLVVRLRKEDARSSAALAGRFTRGVLILADHAGSAWQAFAKLESLASPAIMARVLDLPPPAKTGDEVYAHQTHASETPGCAVLVAPTGSGKTEAALLWAAANGRQTVGNPPLFYVLPYQASLNAMRSRLGERFGDDRVVLQHSRALQALYRQLLDRGYTPGEAKNQAEREINLGRLHVAPVRILTPYQLLRGAFQLRGHEAIWTDCAGGRIVFDEIHAYDPSRLGMILALLEHMVRDLTVNVLVMSATLPSILKEILNEKLNRPTPIIATTKAYEAFRRHRLCLKAADLLDEETILEIHQKARRGLAVMVVATTVQRAQQMWETLNAVSNGEIPVELLHGKFCSRDRFKKEQWLLQQVSTRNAGKRKNPLILVATQVVEVSLDVDFDVLFTDPAPLEALLQRFGRVNRGRRYRERDVIVLTEIPKGCPVYSKTLIEKALQQLVPLDGHMVDEAKIQLLLDAVYSGSVSDWWRDEVLKAAEAFKSEVLSNLYAFETDERLEEKFCEMFDGQEVLPMDLCDEYIRLNQEEPLHTQSLLVSVSNRQFWRLRKEHLLEKVDQHLWGVRVPYDSRFGLQLQRELLRETG

SEQ ID NO: 11632 - protein, 763 aa, Synechococcus sp. PCC 7002
MQPKLKPNCLLAKSFEPGHWKGSYSLVGHTADVVNAITTLVDTLGDRLITQFGLTCSFQYLRSTARLAAYLHDWGKGNNHFQGMVRASIPGATPKRFFDQSPQMLRHEIASVLLAWEFREWLEQADGDFYTALVAAGGHHLKLGGRDGKATDELGEIRQSGDAQIYLYALQKKEGKIAYHPQFKGLLKYSVKALGLPKNIKLSKAPSLQWTRKDIETKQHEIRDYLTLDWEGDPVFIAVVKALLVAGDCSGSALAKEDVSLQKWIQDELKNTLDEDKLDRVIKSRLGDHELRRFQQDLGKVKSRVAIARAGCGTGKTLGAYNWAKTHALDRKLFFCYPTTGTSTEGFIDYVHGKVEAELFHSRYQVDLEMMQTGEENDLDSGADATIKLESFRAWGAESIVCTVDTVLGLFQCNRRPLYCFPAIANGAFVFDEVHCYDAKPFGTLLRFLQVVKAPVLLMSASVLPWQKAAIEAAVGEPVEVIEGAKDLEALPRYRFHVLDQPDWERVEQELNSGGKVLWVCNQVQTAIDVYDEAKRRGLDALLYHSRYRYQDRRDHHRAVVDAFKPDQTKPVIAICTQVAEMSLDLSATLLVSQIADPAGLIQRLGRLNRHYCGHVLDALFYPDEKEGYPYKKEQLADGLAMVQNFVEDVSQAELAQWLEAFTPEPNQDDGELGLVWLDGNWKTYPASLREGGHNVTALLEEDLPKIKKLPAKEVPRFTVPIPNQSWKPKEKHKFYPIAPANIWGYSEEKGAFDLRKQGGDVS

SEQ ID NO: 11633 - protein, 564 aa, Candidatus Korarchaeum cryptofilum OPF8
MTFLSHYLERVLSTLPGREDRPFLNFAIKKAEDSRVSIIEAPTGYGKSAISQAIALRSLEEGLKCVIAFPLRTLLEDQLAKFRGTLRKLDLDERYVGARYMHYPESRYLIRPITLTTADTLSLTLFGIAPEDLETAFKHYDGTLTGSMGHYLFSRAMVLLSDLVLDEVHLLSDTTKSLNFLIALIWIVTFHGGRATFMSATIPKALENLLRRECEGIGLKIIRFSEDPDNAFLEERRKKRYEVNLEKLGSDKFERISEWIKIGMRDGFRRAIVVFNTVNEAIEFYRFVRENLDLRKDRILLLHSRFSGKDREAKMRRIEELRNEEYLLVSTQVIEAGVDISSDLFVSDLAPASSLIQRLGRFLRYGGEQEGRAFLWYEEGDGEKYKGVYDIDLFERTLYFLEGNDVRFHDPESYQALLDSVYDESSFNLKPRDVNELISIESILESSYRAIEKFIELEGSFVRDSTLVPVVPGSLWREDMPISELRELLVPMNLSTVYQIKPKEMLIIEEGKVIKKPTETLWNRKREHVLKYTLSSKFVAFSVEGDYDEELGMVVRYGEGHQLL

SEQ ID NO: 11634 - protein, 794 aa, Leptothrix cholodnii SP-6
MSEFWAHSPSTASKGSGHLLHDHLQSVAERACKSFMQQPGSDLAYLAGLWHDLGKYRPGFQRYIRMAADAHIEGKLPQGSDKSHSAAGALWALEHLSKQHGAEGCVAARILQYVIAGHHAGLDNWDDGLKPRLAGADTHREFTSALDAQPPEAVLRPPIDRPAVKTLPLPFKGPEEIPGRFALWVRMLFSALVDADFLDTEAFMNPTTAQAREAETLPMCALLACFDTYMELKAETLVAAGLANTLVNRRRAEVLAACRTKAAEAPGTFTLTVPTGGGKTLAGLAFALTHAVHHGKRRVVMVIPYTSIIEQTAQVYREVFAPLGDEVVLEHHSNAESDERDETSRSRLACENWDAPVIVTTSVQLFESLFARKTSRCRKLHNLAHSVLVIDEAQLLPVQYLQPVVDVLRLLVRDHGVTVVLCTATQPMLTEQRHFGGRGLRGYQSGEVRAIIDDEAGLYKALQRVRVHLPSDLTTPQPWDATAQALQQHDAVLTIVSRRADARDLYDRLKRELPTGARGLHHLSALMCAQHRSEVIADIKAALVIRREALACGDAAEPVRVVSTQLVEAGVDLDFPVVYRALAGLDSIAQAAGRCNREGRLAMGEVHVFVPPKAPPAGLMRQAAQTCALVWDDIGDTDPLALDRVSRYFAHLYGNANTLDIGDVCDALRLTVDTQAWTLPVRFRDAAENFRLIDNEEAATVIVRYRSPRCRDNVDQLIAMLERDGPQRWLMRKLQRYGVTIYRHALQRLLACGDISELAGVPGLYVQTESDVFYDPVLGVQVGGAPGDPAAFVF

SEQ ID NO: 11635 - protein, 491 aa, Pyrobaculum neutrophilum V24Sta
MRRAVERGLELARAGASRIVLELPTGYGKTYAAPLFYKALREGGLCSKAIHVMPLRALIRKQIERYASAHPDIKFAYQDGDVLLRDRYVKDPYFREEYVLTTLDSFIHNLAKVPVAEMWKFYKSERPSVRYHIPLAYIYPSCVFLDEAHMAAGSRKELAAVKAAVRFLKELGVPTVVMSATLGEWKRDVFKGFRFVSLGERDEERGGDVKVADPEFERRMSNVAYKVGRVDNIEEVARRKAEEGKRVLVIVNDVCRVQRLSETLGAPAVHSLMTRRDRERAERELDKAQIVVGTDAIGAGVDVDFDVLITEADEVERVAQRVGRVCRNRESCVGEIYFVGEVDEELLKVKNWRLPHKPDSYLRLLRGEAEVDEKHFWFLGTVMKEEVVDTHNLREKLLEEGGSFVRHALLEAEVGEGPEESFTVSLDRLGQLEFEVYVGERRIEPPRSYGDRELMEWLLDVVDEYGDVPRIRVVKYREGLGAVLKKCGEGV

SEQ ID NO: 11636 - protein, 566 aa, Pyrobaculum neutrophilum V24Sta
MTGRGLDTLVRELSLAWCRSKGEPSCAVREEVLAEQAKAAEGIERSDGVILLKAPTGFGKTEIWTAPFFAQWLRGEWFAPRLYVVEPMHALLRQMKRRMEVYAQAVQGLGLPRLNVAEDHGEVAKPLFLYGGHIVLTTVDSLAYGYLARRVQRWREEGVERGRYSMPAGLLASAYIVLDEAHLIQDEAYLGPRVLGKIVCDLASAGAKVVISTATVPETFLKHIPCLGGRLTLGSGTVRRNVEVERRKGVLKAEEIECGRPTIVIVNTIERARRIYKQVRCGKKAVVHSLMRREDRERQLSRVLADGKVAEDAVLIGTQALEVGLDFSNLRALYTETAPVDALIQRIGRVGRDGGKAEAYIYEAEGDAPYPQTLMQATREALEEELRGGAALTSWEDAQRAVDRVYNEKAVEELMTRGLAWYGQALGYLQELSLFSYPPRGEVRIRPSSYITLVIADVKQDGDKGRYITEEDVERGAMKMSYTSREDPRINALLQKVSTAYTVRGIATAKDETLYYLSELRGGWDGVEVVVVDRRDVEELYDEAGLDVAQLSGGGQKRRGRGRRRR

SEQ ID NO: 11637 - protein, 773 aa, Exiguobacterium sibiricum 255-15
MRYIAHVHSTDGKIQEVKTHLLEARGLAENWGKDIGLMHVCGVAGLLHDIGKLSDEFQTYIRKATSGEHVRRGEVDHATAGGRLLFEQLKGNRGQLLAEMVANAILSHHGNLQDYYLEEESPFLQRVERKELPSYKMCRERFFQVVIDEQEFNRYVERAVDELYSWILRDGGSTARVSLATKYIFSILLDADRTNTREFEQGITTMTTQVDFEELKRRLETHLSTFSQQTEITPINRLRQEMSDACRVFANQPSGVYTLSIPTGGGKTLASLRYALHHATTYQKKRIIYVVPFTTIIEQNARVARDVLGTDMILEHHSNVVEIEDASDDVMDIQAKLHLAKDNWDAPIIFTTMVQYLNTFYAKGNRNTRRLHHLSEAIIIFDEVQKVPLKCISLFNESVKFLKDSLESSVVLCTATQPALEFVKYQLHQDGEMIDALPQVMEAFRRTDLEVVEGEMDTARLAEVVTRQVEEKNSVLVILNTKSVVKKLYETLRQQHPDEEVIHLSTAMCAAHRMDILRTINQRLEQGERIICISTQLIEAGVDVSFACVIRSLAGLDSIAQAAGRCNRHGEVARQTVYLVDHIEENLKHLPEIARGKEIVRAILIDFLRDEQSYEGNLLGTVAMTRYFQELYDASEVELDFPIRGTTLTLAPMLFKPRKVPELILSSRHRTVANHFKVIEDMTETVLVPYGEEGKRLIASLNGQADWEDLRKWLKQAQQYSINLHAHERKKLEATQGLNVILDGTVLVLSERAYDDHYGLNLEQDSLLEDLMM

SEQ ID NO: 11638 - protein, 722 aa, Xanthomonas oryzae pv. oryzae PXO99A
MARVAGQLHDLGKYTEKFQARLAGDPTRVDHATWGARKACELYRSGGTLLAYGIAGHHAGLADGRRDDLTSRPSLHERLSDEYCAHALPPLLPDWEREVMLPAKLELPTGFRGHPRTERRAFQMTVLARMLFSCLVDADFVDTDDFYRRVEGRKTRAEQAGTRLTLEELRERLDSHLAGLSSEHGINPIRATILRQARSKAHARIGLFSLTVPTGGGKTLASLAFALDHAIAHGLRRVIYVIPFTSIVDQTAQVFRKALGVQDRDDVVLEHHSAFFDDPAKALQAIDKRKLAMENWDAPIVVTTSVQFFESLFADRPSRCRKLHNIAGSVVILDEAQTLPQTLLRPCVALLDELARNYRVSPVLCTATQPALRQDQGFPGGLEQVEELVAEPKVLYAQLRRVRVRHVGALEDDALAEELRQRTQVLCIVNNRRHARALFDAIAEQPGAHHLTTLMHARHRSAALTRVREELKAGRPCRLVATSLIEAGVDVDFPTVLRAEAGLDSVAQAAGRCNREGRRPTDASEVLVFSPVNWQPPQELKVFTEVFREIERTHSGDLLAMEAIHAYFQRLYRRLGDNLLDDEAILTQLRTADLGDLPFDTLAQKFRMIQTTMRPLIVPYAPYVTDRNAAEREVAEVNEVLRQLEHADRIGVAGAARRLQPWLVQVPEQAYRALWQASAIAPIAPERYGEQFVCLRNSRLYDARFGLHWEDPQFLDAQALCP

SEQ ID NO: 11639 - protein, 729 aa, Sulfurihydrogenibium sp. YO3AOP1
MNQYIAKLSGNNQQTLQEHTEKLLENFEILKKYIQLDKETEKAVYLACLFHDIGKASKEFQAKIAKQKPQPKQEIPHNLLSAVIFYFLRKHFKDNIDLFRKIQYAVAYHHDRYDTDINKSKPILEDFAVRVENDLKDWILEKLKIYEITQLNIDKSKLIDGLRSALEFKKQILRNENFLKDKKTILLKGLLHRLDHAASADVEVEKGLIEDYQSIFIKGLSKKGINKLKDFQKKALDYKDKSVILTASTGMGKTEFALNWVAGDKAFYTLPVRVSVNSMYERISNIFGKDNVGILHANTTDFYLNQFKNLEDNGIEVLINQVQSVRQLSMPITVSTADQIFLATLKYSGFEKIYATLTYSKVIVDEPQGYSPDTLAVILKGLEEIYNLGGKFCLMTATMHPFIKEYLKDKAEILEPVFNPEKKHKIKLVDKTVDEMVDFAIKEYQKGKKVLILTNTVRKAQEVYKALENLKQPIQFHLLHSLYIQKTKREKEMQIQNTTEPVIWISTQIVEASLDIDYDLLITELSTADSLIQRMGRVYRKTGRTITPDNQPNIIICTKEPSGKGKVYDKEIVDYTLKELEKYDEKILTEEIKQEIVSTVFDLKRIENTNFYKKFDKNIKLLDYGFMADSKKEAQDIFRDIMNLSVIPKVIFDKNQEKINTLLEKINQKDKIERIKAMQELNDFTVSAQFYRIKNIIPYKEILISDIPYDDKLGFNLLDKDYKEIGEIL

SEQ ID NO: 11640 - protein, 906 aa, Geobacter lovleyi SZ
MQPYFQYWGKAEKDGLRYHLLPYHCLDVAAVGWLLFDPEKPLCKRLAKQLEIAPAHLQRWITFFLCLHDIGKFAVVFQGQVTGLSDDLVKPNSRKRYEERHDSLGYCLWRAEDGLRDRLEMEDSCFLSRSNSRHLKLALDIWMQIVTGHHGIPPKTDLHLTNYFDSQDNEAAWQYLLEISRMFVVDEMVAVLSDKTFCTRLKSSSWILAGLVVLADWLGSSRLPDSFCYQEISLDDYWQNNALAFAEMAVEQAQLIPSPVAPYLNIQNLFNFITTPTPLQQWAENVELASGNQLFILEDVTGAGKTEAALILAHRLMANGFADGLYVALPTMATSNAMYERLGKVYRRLYEDDHAPSLVLAHGARHLSEAFRESLSMPEAGESRKYDHDEETIEAVCSAWLADSRKKALLAEVGVGTLDQALLAVLPARHQSLRCLGLARKILIIDEVHAYDPYMNKLLQSLLEYHAAQGGSVIMLSATLPFSMRVEYLCAFCKGAGTEVSVLKKTEQYPLVTHFSSISHLETGLSTRQEVERTVTVALLDTVDNALEHIRQAVEQGQCVCWVRNTVGDAIKTYRLLARQKWLDKERLSLFHSRFAMIDRQRIELETLSLFGKESTAEMRRGRVLIATQVVEQSLDLDFDMMISDLAPIDLLIQRVGREHRHIRDADGTRLEHEGAVDKRETPVFYIFGPSASETPAENWLKAVLPGTQKVYQNVGQLWLTQKLLAKAGKLSMPGDARSLIEGVYSDEAQATIPDSLQTLSDKAEAEAYAKLGIARMNALKLAKGYSRDSAEDSGGWEEETKIPTRLGDDTVRVALVLPDGEMWRPYADSKNFAWDMSMLSVPKNSWLRAKEVIPTDVRSSLEKFKEEVKAVKWIELFPLTTELSSWYDKLMGWGIQKEESADESY

SEQ ID NO: 11641 - protein, 594 aa, Chlorobium phaeobacteroides BS1
MNYSGYIVEAPMGIGKTEASLYAAYSIIAAGGATGLYFALPTQLTSNKIHDRVNDFLKKILAPDCIHRQALLLHSNAWLKENEMGADGGPGGNWFSSGKRGILAPFAVGTIDQALMAVMNVKHGFVRAFGLAGKVVVLDEVHSYDAYTGTILDKLVEALRKLQCTVIILSATLTKERRMNILQQPVHDISYPLITVSQNHGESVIETTAVVPGKTVVSIHSSSFFDLAIEEALSRAEGGQQVLWIENTVAEAQNSFSILAARSAGMEIECGLLHSRFIKADRERNEEYWVTRYGKGCDELRRQSGRILVGTQVLEQSLDIDADFLVSKICPTDMLLQRIGRLWRHGDTFRPVGAVCEVLILKPEFHSALLNPEKEFGPTANVYSPYVLLRTLVVWNDMADIVLPEQIRSLIEATYMEIEEDPMMLKYKAKLQQEKAKLELLALGGVSEGTKTLPESKASTRYSEQESVEVLLLRSFHFDRNQNVTNVKLLDGSDLFLPLVCSKKSKKEQRSLAASLAQYTLHVADYLAPEVISVKNLDWLKNYFYLGDRDHDESLLRVAIVGQDEELKSLNGRNASSSYGLSYNPRLGYRAIKI

SEQ ID NO: 11642 - protein, 723 aa, Chloroherpeton thalassium ATCC 35110
MEWVCPHIKAKGKPEETTLHEHLLLVCNVAEKIAIYSNMNPQIAKLGAILHDIGKTSTIFQERLTINKKPDTPFRHEIASCFFLSLFDKEIHPALIEMIIAHHKSIENDAKRKGILDLNEDRDNTFLLHSKNWELWKSDALQLLSAFGITVRDISIEEAQASYDAVVAYCEDAVRESGYSEWRGLLMAADHFASALSGKTDDYLVRLFKQPKLDFYQRRHELYPLSLKNASSEKKHTMVVASTGAGKTDFLFRRCKGRVFYTLPFQASINAMYKRVKKDLATDNPDMDIRLLHAASKIALDGKSKEEKIIQGHVGAAVKVLTPHQIAAIAFGTNGYEAMIMDIKGCDVILDEIHTYTEVTRAIVLKIIQVLKHLGCNIHIGTATMPTLLYNRIIDLLGKETVSEIRLEDDELEQFNRHIIHKIDNRESAAEIITQAINEQKKVLVVCNRVKAAQDEYSKLQEMFPETPILLIHSRFTKGDRDEKERLLLGLDDDGNPNGNFNTSNKACIVVSTQVVEVSLDISFDVMVTDAAPLDALIQRFGRVNRIRTKETIGTYKPVYVLPPPENKKEAKPYDLEVINRSYDVLPNGEVLEEKSLQEKIDHVFTEIDFLAIEEHSVFKETGKWRIDKLTHNSKAMLLELLDIDSVSCILEADKETYMLANYEERYKMEIHTRYYVVKDLQQFKDEYGSSPFIIPDKAYNKDLGLIEYLAKPENYNVEYSFL

SEQ ID NO: 11643 - protein, 860 aa, Prosthecochloris aestuarii DSM 271
MRLPRAKQNDEAARQPNKSLPIEACLAKTRVSENKKSVSGRNVLDHCSIVGEVARELLSRMPVFLRSALFPDGTELVAAIHDIGKVSPSFQEKIYRGTDGYIWNTLDGLSFSNPEHEKNWGGHAGVSMAAARARRIGKYIPEIIGQHHGYSPELNGLVAEDEVFGGNAWQKMREELLCILKDSLKKEFPAIENALQAKAIAGLTTVADWIGSGSFFDDPDEQWLPLIKHAVDSAGFVQPEIIKGLGFSEIFSFRPREIQQLLIEQATQPGVYILEAPMGIGKTEAALYAAYSIIAAGGATGLYFALPTQLTSNRIHDRVNDFLKKILAPDCIHRQALLLHSNAWLKEIEMGADGGPGGNWFNSGKRGILAPFAVGTIDQALMAVMNVKHGFVRTFGLAGKVVILDEVHSYDAYTGTILDKLVEALRKLQCTVIILSATLTKERRMNILQQPVHDISYPLITASQNHGESVIETTAVVPGKTVVSIQSSSYFDLAIEEALTRAEGGQQVLWIENTVAEAQNSFSILAARSAGMEIECGLLHSRFIKADRERNEEYWVTRYGKGCDELRRQSGRILVGTQVLEQSLDIDADFLVTKICPTDMLLQRIGRLWRHGDTFRPVGAVCEVLILKPEFHSALLNPEKEFGPTANVYSPYVLLRTLVVWNDLADIVLPEQIRSLIEATYMEIEEHPMMLKYKAKLQQEKAKLELLALGGVSEGTKTLPESKASTRYSEQESVEVLLLRSFLFDRNQNVTNVKLLDGSDLFLPLVCSKKSKKEQRSLAASLAQYTLHVADYLAPEVISVKNLDWLKNYFYLGDRDHDESLLRVAIVGQDEELRSLSGQNASSSYRISYSSRQGYRAIKI

SEQ ID NO: 11644 - protein, 888 aa, Anaeromyxobacter sp. K
MDGAPSGVWGKLRRTPGSPVERWHPLVAHCADVAACLEALLADAVIRSRLARLAGLRDLEAPQRARLCILAALHDAGKFNHGFQRKGALAPADVAGHVGELFGALAVPSPERAALVAALGLREIDAWGASRLLVAALAHHGAPENVRNPSRPPRAALWRATEDRDPIAGIAALATTARSWYPAWREPAEPFPDRPPFQHAFSGLVTLADWIGSDEAAFPYAADPEADRMPFARERAQQVLRRLWVDPSAARAALRGVMPAFTDLFDVERPRPAQQAVLDLAVAPEGGLSILEAETGSGKTEAAVARFVRLFAEGRVDGMYFALPTRTSATQIHRRLVDAMRRCFPDERERPPVVLAVPGYLRVDDLVGGRDPRLPPFAVCWPDDEQERMRWRGWAVEHGKRYLAGTVVVGTIDQILLSALPLKHAHLRAAALLRHFLVVDEVHASDAYMNRLLETVLERHLAAGGHALLMSATLGAAARERFVRSSADGSLPPLAACEEMRYPGISCRGAGTELADREPRPAGGPADSKPLAIEPVPILDEASAIAGMALDAARAGGRVLVIRNTVKGALAVQRDLEARAGSRDRALLFECEGQAAPHHSRYAAPDRERLDRAIEAALGKRAGAGGRVVVATQTVQQSLDLDADLLLTDLCPADVLLQRAGRLHRHAVRKRPAGFERARVALLVPCDPDLGKYITARGDARGPQGIGTVYRDLRILQATWSFVGEHAEIEIPANNRAFVEAATHPEALGRVVARGGERWTLHARAVTGALLGEQVLATTNVFDWNRPLGDAAFGAGFDGLVKTRLGAGDRIARFDGGIPSPFAGSVEVLSIPAWFASGAGPDEVPREVNVSGPCVGFQFGGKRFVYDRLGLRPEAAAAPAHEEDAADA

SEQ ID NO: 11645 - protein, 828 aa, Borrelia duttonii Ly
MNDFGLPIYKYKDDLIKKLSTNSVLIVESPTGSGKTTQIPRIIYEAGLAKLGKIGVTQPRRIATISIAEYIAKHIGVNLGEEVGYKIRFQEVISPKTKIKLMTDGVLLQELKKDTLLYEYDVIIIDEAHERSLNIDFILGLLKDILNKRNDFKVIISSATINTKIFSKYFNNAPILSIETITYPVQIIYNPPLLNTSKSMILKIKEIIAGIIKEKKEGDILIFLSGEKEIKETIKEIHALNLKKDLIILPLYGRMAKEAQEQIFMPTPKNKRKIIVSTNIAETSITIENIKIVIDSGKVKTNKFQMKTHTYSLQEVPISKSSATQRAGRAGRLSKGTCYRLYKRDEYQLRDEYQKEEIYRTDLSEVILRMADIGIKNFTKFDFISKPSIKSIQTASDILKSLDAINEKNELTEIGKYMIIFPLIPIHSRALVEAMMHYQQAIYPTTIGLSFLSTSGIFLLPQNEEIEARQAHLKYKNPLGDLIGFINIFEDYRKAINKEDFAKENYLDLQGLEEINNVQRQLENIVSSFDIPIVHKNEIDHEGYLKSIMRGMKDYICFKTSKNKYKTIKAQNVVIHPGSLINTDSVKYFVAGEIIETSKRYARAIGVLKKEWLNNIQFEENKNIPQKENKQSHHSHKNNILHKENKDSLKKEIKIGGKKFYIQNEYKNQLTFSLKEIKQLISKGLKNEEEKAIKNVLAKLTYENLIIFKNKKLIEIMRIVNGMEPNWTLLKTYENTNVNINEIDKIKNILECTMNFIQHSNKKSVLFLSLRSDYADNFWLKPQKSFIVAIEESMDSIKSLIDNQDNITKLTSIKKTINKVYKKLNFFF

SEQ ID NO: 11646 - protein, 828 aa, Borrelia recurrentis A1
MNDFELPIYKYKDDLIKKLSTNSVLIVESPTGSGKTTQIPRIIYEAGLAKLGKIGVTQPRRIATISIAEYIAKHIGVNLGEEVGYKIRFQEVISPKTKIKLMTDGVLLQELKKDTLLYEYDVIIIDEAHERSLNIDFILGLLKDILNKRNDFKVIISSATINTKIFSKYFNNAPILSIETITYPVQIIYNPPLLNTSKSMILKIKEIIAGIIKEKKEGDILIFLSGEKEIKETIKEIHALNLKKDLIILPLYGRMAKEAQEQIFMPTPKNKRKIIVSTNIAETSITIENIKIVIDSGKVKTNKFQMKTHTYSLQEVPISKSSATQRAGRAGRLSKGTCYRLYKRDEYQLRDEYQKEEIYRTDLSEVILRMADIGIKNFTKFDFISKPSIKSIQTASDILKSLDAINEKNELTEIGKYMIIFPLVPIHSRALVEAMMHYQQAIYPTTIGLSFLSTSGIFLLPQNEEIEARQAHLKYKNPLGDLIGFINIFEDYRKAINKEDFAKENYLDLQGLEEINNIQRQLENIVNSFDIPIVHKNEIDHEGYLKSIMRGMKDYICFKTSKNKYKTIKAQNVVIHPGSLINTDSVKYFVAGEIIETSKRYARAIGVLKKEWLNNIQFEENKNIPQKENKQSHHSHKNNILNKENKDSLKKEIKIGGKKFYIQNEYKNQLTFSLKEIKQLISKGLKNEEEKAIKNVLAKLTYENLIIFKNKKLIEIMRIVNGMEPNWTLLKTYENTSVNINEIDKIKNILECTMNFIQHSNKKSVLFLSLRSDYADNFWLKPQKSFIVAIEESMDSIKSLIDNQENITKLTSIKKTINKVYKKLNFFF

SEQ ID NO: 11647 - protein, 801 aa, Dictyoglomus thermophilum H-6-12
MDRFYSHLERRGEEVDLERSILLKNHLREVGLKTIEYFFFEGGDLKNIGYYIGITHDFGKYTTYFQKRLFEIEHCGDLANHGFISSLYSAYLISRKLEEFKNVEDIKEFLPLVAFFVVYHHHLDLSSLSKLKSNLESSDKKELILKQIEDMKSNSEIINRDLKELELPLLEEFERDLDDVINLLRKRIYQFENKLEEKIKEKIAIFCLVLFSALIDADKKSAGKVRDVERRDIPEDIVEVYKRETFKDNSDEINLLREEIFQKVINKLKEIDISKNKIFTFTSPTGSGKTLTGFAFAVKLRKRIEKEFGYTPRIIYSLPFISIINQNYDVLRNVLSKLPDFEGNSSAYIISHHHLSKVEYEEGDELREVDESLALIESWESEVIVTTFVQLLHTIIGFKNSFLKKYHNIARSIIILDEVQNIPAEYWKLTERIFKLMSQYLNCYIILMTATKPLIFSDGDTLEILDNNEVYFEKLNRVVLYSNVKEQKGLDSLLSWFIDIYDPQKSYMIVLNTIKSSIEFYRMLKEQLSLKEKSIYYLSANIIPKERLDRIHRIKQDLGNNKKPILVSTQVVEAGVDLDFDVVIRDLGPLDSVVQVAGRCNRNFKKENGEIFVFFLKDDKGRSYANMVYQKLTPRITFELFSELESVKESEFIKIINKYFERLRFEKSQEESELIISALNNLRFYEGKEIISVSSFELIKEKGIVYPVFIEVDEKAMETWSKFKSIISDDSIDRWEKKKLLLNIKSQLEEYIVNVRVNKNEPWIFDIAFDQNIGYVANKDIPEYYDSETGFKKTELSSVIF

SEQ ID NO: 11648 - protein, 755 aa, Dictyoglomus thermophilum H-6-12
MISLGNLDIVYAKTYYENGKIVAETLEEHTSLLLKNLELLKERYYEEIKRVLEKENYNSEKFWEILKIAALYHDLGKINSLFQNKIRELLGKEKIESRFSQEIPHNFLSPALLPKETLSKKIAEYEDIFTLIYAIIYHHYRDLDFNEEYFKDYIKEEVLNKVDHLSWVKKYDENFGNSESLGNEYLWLLRDRGKIENLEKKLKFIMLKGLLYRLDHSSSAHVEIEKERIRNCEKLLISYLIKKPNSIGLKPFQKKAIHLRDKNILLVAPTGSGKTEFAVNWIGNDKAVYTLPLRVSVNAMYERLKEIFGKDKIGLLHGDCAYYGLDEIRTLENDFQEHLHHVTSSRQLSYPITVSTADQIFISFFHFPGYEKIFSIFPYTKIVVDEPQAYTSESLAVIVEGLKRIDNVGGKFCLMSATFYPILRNELQDISEIIEVEASNNSSHFIRYYPEKDIEDMISEIIENYKKGKKVLVITNTVKKAQSIYNLLRSNKELKVNLLHSRFIWKDRNMKEKQIFLDEKSHAPCIWISTQIVEASLDIDFDILFSELAPLDTLIQRMGRVYRKREYSEDIPNIVIAGSLGKPSGKSHVYDSALIDATHNILSEINTKKLDERIKKMLVERLYSLEQLANTKYYKKFRDYQKLLKLEYKAENKLEAERIFRRISNIEAIPVEVYENNKEKLLEIQEKIYSKDALKKLQGLRELKDLTVNIPLEIKDYAQNLISLEKDLELRIFLINLNYDTELGLLPDKNTENII

SEQ ID NO: 11649 - protein, 728 aa, Thermodesulfovibrio yellowstonii DSM 11347
MPVFAKSNPPETIEEHNKKIFENYERIKPFLDPEKIKKYDEVIKKIIYYHDLGKLNHKFQNKLGLSKKVIIPELKDIDEIPHEWLSLAFLSREDKRYFHTLSTDTIHFADLVQYCIAFHHTRTKPFDKKALEKTICHDLEKNKGLLGINHSLNFDYDIFKDIKQKIDSQKNFKNYFELLVFLKGILHKCDYTASANIEPESHYSGNYEKDFNNWLSKKGWHLKPFQNEAKRLSDKSVVLVASTGTGKTEYSMNWINGQKAFYLLGIRTAVNEMYRRFKDIFGENVSLLHGEISNIIEDDDTEERYVERIETARKLSTPLTVATADQLVTSVFKYNGFEMTYLTASYSKIVLDEIQSFSPDSIAAIMVFLKEVHRLGSKFLIMTATLPPFIKEELKELQNVEFPEPVLLPNKRHFITVYDEPIDSERSLKMIDKNFKSGKKILIVCNTVKKAQQMYDMLKNFNPSLLHSRYILKDRKNKESRDHGIMAVNNPKHPPVIWIATQVVEASLDLDFDALFTECSPIDSLLQRFGRCWRKREYTDNKPNIHIFKAEDNRIYDKELLDRTYSLIFNNYKNKIMDERDKQDAIFTIFKDIEKTKYYEKYKRNKELLELGFKAQSKTEAEAFFRNIAFNYCVIPRLVYEENEKEIRNLIELIDNKDTEKMQRIKAKAKIKDFIIPLQIFGNFKNLTPVPDSEYCKRNNIMIMNEVTYSYEKGLQLKDTAGEGVLID

SEQ ID NO: 11650 - protein, 543 aa, Thermodesulfovibrio yellowstonii DSM 11347
MKCEEFYKNYFGIESPYEYQVKVWDGIYSLKYPLLIKAPTGSGKTEAVLAPFLSQFINNSFSIAPRLIYLLPMRVLVNNVAQRIKKYCEKVSPYISVEIQHGDLPSAPFFIADIIVTTLDQFLYGFARASKQVGRHIDVPAGAIASSMVVFDEAHMYRDEFTFSITRALMEILYKSNIPFVVMTATMPESLDKNLFENISMDSERRIFGDIDLKSHLEITIKEEPLIKNNEVNISDEILEEIKHKKTLIVLNQVGRAQRVYEEIKNRLDLNNGKIVLLHSRFTKSDRERHEKEAVSIIPHKEDGMIIRPEKRGIVVSTQVLEAGIDFSSELLLTELAPADCLVQRAGRCARYEGENGKMIIFPVEDDKGHLPYKKEHLEKALEWLKINSVFNIKDFNQVCFFADQTLDYQANDYEARDTLIDLYECVLYADEKPENIQLREGKPITLVIIDLSIGEGRKKEDRIRNVLQKTNIRANSISVDFKVGWKLLKDGILKYRLTFDAEKGLWDFVETQDISPFNYYLLEKDNYDPYKGVIPDASSFII

SEQ ID NO: 11651 - protein, 897 aa, Gluconacetobacter diazotrophicus PA1 5
MRSNGLEFFWGKARAVPAEGAMIGPVMHPLIAHMLDVAAVAVLLPENAKCGLDRRQLGLLVALHDIGKLMPAFQAKVEICWPEAILGGFPVELVPCFHDAAGLALLDLMVDDVLAALFANGQDGKCWRLTHKLKLLRAVAGHHGQPVSAQDRNTLAPDTIERARTLVALLFDVFRPPPILRPGDDTLRRLEWMLARVTIQADWIGSQQEWFPYVTPESVADPSGYFWNHALPRAQSAIHRAGLGPMVGAPFAGTAGLFDHIREPSPMQALLETLPVPSGPVLVVIEDATGSGKTEAALVMAQRLIAAGRSSGLFVALPTMATANAMYDRLAAAYRRLFQPSARPSLALAHGRARLDERFAAALAPDDGSDAFPDARIMDETAEAYCAAWLGSESRRALMAQVGVGTIDQALMAVLPVRFATVRHAGLAGKILIVDECHAFDPYMRREMVALLRFHAAMGGSALLLSATLTQRIRQELTNAFRSGLDTVDPAPLSGTAYPLVTLVGKAGAEEYPCALRPGLARSIAVRRLADTDAASREVIAAAAAGAAVAWIRNTVDEVIATARFLRAQGVELLVFHARFAMVDRLAIERDVLARFGKNKETTGRSAVLVASQVIEQSLDLDFDVLVTDLAPMDQVIQRAGRLRRHDRIARPVDREELLVISPEPVAEPDPSWVRRVLPGTAAVYRDPALLWRTARTLFRYGRIESPGRIRALIEEAGDADAPGAVPDGLAAGSTDAMGKALAAGFAADRNVLSFDAGYVADGALWEREARTPTRLEDLPYVTVRLAVMQDGRVLPWAAKIDPGLACAGEHRRAWALSEVSVAQYRLARCPPPPGLERVVAAARAEWPRWEREDESSVLLLILQKMEEGWRGAGQIETGHEVVIGYDRTYGLEVVPA

SEQ ID NO: 11652 - protein, 782 aa, Gluconacetobacter diazotrophicus PA1 5
MDIFAHSLPDDPSTERWETLRAHSLRVAALAEQFAAVFGAAHKGRALGLLHDIGKCSAAYQDYIRKPGPCHGPDHSTAGARAVVASYGPLGRLLAFAIAGHHSGLMDGSGHDGPGRSLNERLDEQAYAVPASDNWPDYCPARPTLQDLVDESPPVASTDYPGFATSFFVRMLFSCLTDADFIATEGYYAESAGLPPPARGGTITQAHLDAIRRFMKTRRRDDTPLNRLRSRILDHAIGKAALGPGLFTMTVPTGGGKTLASLSFALDHAVRHGLRRVIYVIPFTSIIEQTATVFREALGTTDGILEHHSNFDWDRRAPAGENDEEAEGADGLAKLRRDAENWDAPIIVTTSVQFFESLFAARGSQARKLHNIAGSVIILDEVQTLPLHLLRPCLAVLDELARNYGVSIVLCTATQSALRQIDDALPPGRKGRRAGLDIQDTHELAPEPAALYDALRRATVTWRKEPVSDGEIAARFAVREQMLCIVNTRAHAHDLFTAIADQDGARHLTTLMCPLHRRATLVAIRQDLKNGRPVRLVSTSLIEAGVDVDFPEVWREATGLSSITQAAGRCNREGRLDEPGPVVVFETPDPADPTQPWLVRAMRPFWQATRPILRQGLDPLSLEAIHAYFRELYFQHSHDTHGHDGLDAARIGTVRYAILEAIAQSGAGHTYPYATIARAFRMIDTVMESVIIPWDETVRQMLHALDHAPVPPAGFMRRLQQYCVPVPAPIRLKLLAAGALRTVKPEAYGDRFVYLESMDLYDARRGLKLDDPTFRHAESNVW

SEQ ID NO: 11653 - protein, 726 aa, Anoxybacillus flavithermus WK1
MMVFYAKSEGKETIREHTDRLLYNLNLLKNSYSNKFTLMDEKMWKLLEIAVQYHDVGKANTVFQNKIRQAIRESMLETDIETDVPHNYLSVGCIPLKQLDLTKEEERLLIHGVGYHHEREQLPEKEMIRQVLENDIKKQLPQLSEHMRLPMTEKFSYRFVDRLLNRYTYHDGEEFWKYVMIKGLLHRLDHAASAHIDVESDVEKSIYINVNEYMKKQGFHKNDLQQFAEQHHDKHVIAIAQTGMGKTEAALLWIQHDKAFFTLPLRVSINAIYDRIKEKMGYDAVGLLHSTSVHYLVDKEENWEELKQQSEHYAKKLLLTTIDQILKFPFYYKGFEKELSAMANAKVVIDEIQAYEPRIAAMLIKSLEMIHRVGGKFMIMTATLPTLYLEELKQRNVINDDQIAIEEFIDTSVNRHRIRLRSEGIEEAIGEVLELGETSQVLVIVNTVRQAMSLYDKFLDCDTQVPIYLLHSQFTQEDRQLLEKHIKQFNEDNERGIWITTQLVEASIDIDFDYLFTEMSTLDSLFQRFGRCYRKRELDHDNCNIHIFTENISGIPRVYNEHLVNESIRLLEPYDHQIVDERAKVEMVKQLYDRKQLKGTSFLKEFEDALYMFDNLDPYGMDKRKAQQKLRDIQNIQIITRQMYDQIEHLFERYKEEKEWKKRLKLRMEIEKKTVSVQRYIAEKYVSERLPKPFDHIYIAEVEYDFNRERLKGKGILLDKPSSNQH

SEQ ID NO: 11654 - protein, 801 aa, Thermosipho africanus TCF52B
MKLFTFSKSIDDKMAHKKDEKFEPFIEHVRKTKNYLEELIEKYGIEEILKNLFYEFKISDSYIETVYEIIKYHDIGKLTEEFQNGLKLGDISITHSDIGFYTISSLLVDKVLSKKLSNKEFVFLLLIATVVSRHHSFLSDISDIIFWNEEKEKYVRYILEFLETENDKDTIINMTKSVFGNLNMKKIKKVINIEFFLLYKLLNSLLITCDYLATMEFMKGVKFVPKIIDDYLKDIILNNISSSKINGNFNPYIDKKINKFRTMKKEEVFDLNTLRSVITAKIEEKFEKSKKNVFFIEVPTGGGKTNISLRLVRKLLEKKKKVFYVIPYVNIIEQSFDYFSKFIPGEYITRYDHKYIDIADDENKEKSYTQTLFLNFPFVFTTHVGFFDMFFRKGKSDNFNFYQIANSVIILDEVQAYNPKFWNTLSNIFYYLSKYLNTTIIIMSATLPDFTKFIEKENFVENLTPDVVDHKLFERASYVFLDKDIEEKILEEVNKSKKTLVVVNTVKESYRMYENLKSKIDGEVYILNSTLLYVRKRELIDYIKKYNKEKPLVLVSTQSIEAGVDLDFDVGFRAFSLLDSIIQTMGRVNRNARLKSAKLYLFDDGNWKRIYKSDEREKILEENFSKFKSGKLKLNEFYSLTIEKLKKKLNAFTLDYLDYFKDLKFKNIDKELKLIDGDTFSLFIPLEIPLSKLNNIKKLLLEYNLISDKDKVLQGKKVWNVYMDNDFSYVENRLFSKIFSLFVVSLYNYRTEGKSIKEILKDEMNEEFYFAEDFEKYYSYKDGLNVEKFLELKSSREYDFL

SEQ ID NO: 11655 - protein, 784 aa, Dictyoglomus turgidum DSM 6724
MSSFSELYSHPEKPLELHLKNVKELSWKFLEDIPIEKLPIKKEHIKKLAQIITLSHDIGKSTTFFQDYLLKGEKRGEKETRHSLLSSIIAYYITKNSFSRENIPEDVKIFFPVIAFLTVKRHHGNFSDITIELDLDEEEKNLLKKQIDSIDEEKFGKLIKNLEDPNFQEISKEKLYSILEEVSKDIKILRLSMKRLSKQKSLDYYFLNNLLFSLLIDSDKSEVTIGKPERNLQEIPYIIVDAFKKTIKIEKKPINNLREKAYNEALSKEIDLSQKIYSLNLPTGLGKTFISLAFALKLREKIKKKLNYTPRIIYSLPFLSIIEQNAEVIEKILKDYFGKIDTTILLKHHHLADIYYKIDEKELEPDDAKILIEGWNSEIIITTFVQLFQTLLSNRNSNLRKLHRIFGSIIILDEVQSIPMKYWLLLREIFIGLVEKFNCYIIFSTATQPLIFQKDEMFNLVKGEDYFVQLNRTILIPNLSEVLSLEEFVERINFEPDKSYMFILNTINSAKTFYELLREKTKEDIIFLSSHVTPKERLERIEKIRNKKSRIVISTQLVEAGVDIDLDIVYRDIAPLDSINQSAGRCNRNWEKDIGEVDIFILKDERRKYASYIYDKILLEVTTDLLKKEEKIEEIKFINFIQDYFLEINDRKSHDISKNLLNAVYTLRYSGWTETEDKEQVGIENFKLIEEDYPKIDVFIELDEYAEELWKKYCNLKEIKDIYERRTEFQKIKGDFYKYVISVPTKIENLPPIVNGFGYVSKDNLEDFYSKITGYQAKAEILLW

SEQ ID NO: 11656 - protein, 876 aa, Thauera sp. MZ1T
MRHNLSEAFAFGKLDRSEDAIKWHPLVDHLADVAAVFEALCACRAIRRSIEAVAGRSLDHRDFARLAALAFLHDLGKANAGFQAKRWLNEERPRGRLTAGHSAEAIALLEASNHSDEAEALLLHLPILEICGWGKPETLDNLLRASIAHHGRPIANAPDWFNARIHWSRQGEYDPAEQLKSIGAALQRFVPEAFVEGGLPLPDTPRFAHYFAGLVQLADWLGSDTRFFPFTNVGDRDRIGNSRELASTAVREIGLDPEPCRKRFEQASPDFGDVFDTTTPYPAQSAMSDPALGQVVVLEAETGSGKTEAALWRYLHLFARGAVDGLYFALPTRVAASQAYRRVREALSRAWPEGAPLAVRALAGYAAADGETARALPDFKVLWSDDPSDAEAGRRWAGESSKRFLAAPVAVGTVDQALLGTLQVKHAHLRHALTARSLLVIDEVHASDAYMAVLIEQLINAQIALGGHTLLLSATLGAAARTRYLAAGNRKAQHLPSLAQASGLPYPAISDAWGIRSTSGAPREKRVAWQCEDAIDDPQRVAALALEAAEQGARVLVIRNTVPAAVATLAALEAATPNVTWLFNRDGVITLHHSRFSREDRLMLDATVEAQLGKGRSSGPLIVVGTQTLEQSLDLDADFLITDLCPMDVLLQRIGRLHRHMRPVEARPNAFREARVLVLTPEGGDLTPCLTRPRHGLGRFHDGGGVYADTRILEATRKLIHSESQVRIPADNRRLVESATHPEALHAIESLDTAWATHGQQIDGDTGARRTSAKLGLLPLDTAFVELGFPDEVKLATRLGAADRLLTFDSPLQGPFGRTVRELPIRHHLLPRALPLEALPDEIVVEHGGFRFRLADTHYRYSRIGLEKLPQTAASE

SEQ ID NO: 11657 - protein, 851 aa, Desulfatibacillum aliphaticivorans
MRPPKNHNVPKPPPPFPPSFIAKTFSAPGGASCPGVDVFTHCKIVGMVAREWMQRQLEWLVQKLFPCGSELIAAIHDIGKISPGFQEKIYRSLDMVPGLAAPDLDKNVGYHFTVSQAAARDLGRYVPEIVGRHHGISPASPGYPDDEIYGGPTWQAERMNTVKRLREYFQSSWPEVVSDIHADVLSGLTTVADWIGSALDICPDAPQGLPSDEELSRMTAKALDDAGFIRPRINSGLTFKDIFSFSPYSLQAEMAQAVSSPGVYVLEAPMGMGKTEAALFAAYKALEENRATGVYFALPTQLTSDKMHERMNKFLDVILDQNCPHKNALLLHSAAWLRATEMGEDGRPDKSWFDYRKRGLLAPFAVGTVDQALMAAMNVKHGFVRTFALAGKCVILDEVHSYDAYTGVILDRLVQALREIHCTVIILSATLDTTRRAELIYSPGETPASVDDVYPLITAHPNSGPPQAIASPAVEEPEILTRIHPDDEEALEEAIDRAQQGQQVLWIENTVDGAREVFQRLGARTAGLGIESGLIHSRFLKVDRETNESYWSGVFGKTGREKRGEQGRILVGTQVLEQSLDIDGDFLVSRLCPTDMILQRLGRLWRHDINVRPKGARREAWILGPALEAAQADRQSMGKSAVVYAPYVLCRSLDVWEDQPQFKLTGVKIRALMAATYSHRDDQGSMAAYKQELERVKDKLSRLARTGLSRSGKTLSETRAQTRYSEIEITDVLLIKSKIHDRNGTRLELPDGTSLVLSPDRRLRDKAYWRKAAARIQLNTVTVPEKLAPAFHGLNMNFLKGFVYLGEDDERPFRAAMVRESGVLAGLDGQEALPGYELKYDSVLGYRAIQH

SEQ ID NO: 11658 - protein, 740 aa, Desulfovibrio vulgaris str. 'Miyazaki F'
MKYAHTLANRPESDWEPLSRHLEEVADLAAHFASAFGAGEWGLAAGLLHDVGKQSTAFQAYLRASTAGKGPGRGPDHSTAGAQWAHGHYNAKLGKLLAYALAGHHAGLPDGIESLAPRLKRAVEPWHSPGDDIAARVPEITGLPLAGRMPSLGFQLMLFVRMVFSCLVDADSLCTEAFTTPDKAAWRRGYLPLSELKVRLDRHLDHLATHAPATPVNSLRAGILAACRNAAPNVPGLFSLTVPTGGGKTLSSLAFALDHAQAHGLRRVIYAIPYTSIIEQTARVFREALNDTDDQAVLEHHSNFVPLRADGTPVTPRREGQDDDAGEGRRSVLAAENWDAPVVVTTNVQFLESLFAARRSPCRKLHNIARSVVILDEAQMLPPEHLLPCLEALRALVLDYGCSVVLCTATQPALGKREGFDRGLEQVREITPNPEQLATALRRVEVTDAGTLDDAQLAARLAGQPQVLCVVNTRPHARALYELLAPQGDAVHLSAAMCPAHRTEVLRGVRQRLLQGQPCRVVATQLVEAGVDIDFPVVYRAMAGVDSLAQAAGRCNREGNLERGQVYLFTPQDSPPPFVRQAAQAARTALRRNPDPLALDTVEAYFRELYWQKGDRLDSANLLPLMRDSAPRLDFPFPEVAHLFRLIPDDTIPLLIPYDDDARALIAELPYTPAPARLLRRAQRYTVGVYPRVLAALVQAGAAHLATEECAVLINEDLYDDRLGLCADNPTYRNPESLLG

SEQ ID NO: 11659 - protein, 912 aa, Methanosphaerula palustris E1-9c
MKTGSDNYYSYWGKAQREGEPEKGAGYHLLVYHCLDVAAVGQKLLEQDPLLMHRFTALTGFNDDQVLHLIPFLLALHDLGKFSDRFQNLKPDLMELLQGNRGSRRYPIRHDSMALYLFEQDIRDLAWKKNWFWMDHDLPYAEDEWFEIFAPLFRAVSGHHGEPPQHDETVSVDSLFLDGDRAAARDFAVQAATLLLGSGSYPPIEYSEGWFEQFSTASWLLAGLVTLSDWLGSNRTFFPFQTEAMDLAVYWKNFAQKGAEDAVRDAGVLPATVSSNCGMAGLFPPDLPPKITSPSPIQTYLSSCSLTPEPRLTIIEETTGGGKTEAALVLAHRLMNYGCGEGIFMGLPTMATADSLYGRIAQTYQRMYTGDQRASVVLATSARDLSDLFKKSVLPPGQWSHEQYKPGEETASATCTIWLAQNRKKALLAQVGVGTIDQALMAVLPFRHQSLRLLGLARNILIVDEVHAYDPYMHTVLCGLLKFQAAFGGSAILLSATLTMAQRQDLTSAFCAGLGRRAKTLTDETYPLITMATAQDVTETPIDSSAARVRTVRVQMVDDSADVLEQIVRAAGDGRCVCWVRNTIDDAINAFNELNTRLESRQVLLFHARFALGDRLDIEKKVLDTFGKESLDPIRRGMVLVATQVVEQSLDLDFDLMITDLAPMDLIIQRAGRLHRHPRGDRGEAVMVVLAPPLTRTPDPDWYKRVFPKGGYVYPNHGQLWLTAQLLDTKGKIVMPDGARDLIEGVFGDGAQIRIPLSLLPREVLVDGKKRGDISIARLNTLEVSDGYRRTPTQWVEEAHVSTRLGQLTSTLVLARWDGTTLTPWYSSNQNAWDLSQVHIAEKKVASAAVFEGELGAAVKRLEDQIPGLGKWLILVPLSCTSAGTWEGPARNDADENVTVIYDPVLGFMMKN

SEQ ID NO: 11660 - protein, 805 aa, Desulfitobacterium hafniense DCB-2
MSRLIPFAQCIARPDEQGGTHLLKDHLLGVKEAVEQRLKSECCPYCHDRIFIRLAGLAGVCHDMAKAHRRWQSYIRGQNKGGPNHAPEGAFLFSYLGFHLLQQESKWPSYAVFWLWLTRDIADHHGALKHLDEKHRIGAGTWEEMDLPGITRFIEQIYPELRQVPITAEALDQWIDRLYDVLQEASDGLDLGYSPDYGKAMAQLTFWRELTTALIAGDRFHVAPMERVGFSQEDHIRHDRALDEFCRNNGEQVMADIRGQAQRQILNQLARDPRRRIYTLEMPTGYGKTITALKIAAWLGREQGYEKIIYVAPYLSILEQTSGVMEKAMGASVLEHHSLAVLEEKQKDEDREEEGQFHSGQLMMEAWANPVICTSFQQWSKALFPGKAQDTLRRAYLHNSVVIIDEPQIFAPESWNVFLCGLESVAQLYNLRIFFLSATMPPFDYGLSEQPGCLAVNPVQQIERYQVEQKREMDEQGVAGYLLKGSELLAADERGLSQAAILNTIADAYLVYKQLAARVEPSQLKLLHGMMIPLHKRVEIEKIRHFQAENKREGQYVVSTQIIEAGVDLSFDHIMRALPILPSLIQAAGRVNRNGSGRRGILTLMTFLRGGEKNTRGFIYPSELQKLTDELLQKQDVWLESELLELIKEYYRRMFARNSYEAGKQAIIDAYEGNWPLLGQQFKPFGEDYFKLPVFVPWQTEEEDQAYFPQRFVELQERLGLYEAEDIYACYEDRDYYSRLSFKGRKEFMILLNHYVVNVPAKLAFSLVGKELYLKNRIPCLWSGNDYDPVAGLAKRAVEGFDAII

SEQ ID NO: 11661 - protein, 781 aa, Chloroflexus aggregans DSM 9485
MNPSPWPHWIDNLLAKSQRYGGETLAAHTWAVLCRLADLYRLRPQIANSDSNRLWHCLYWAAFLHDFGKAARGFQQRLRGGPTWPHRHEVLSLAFVDAIAHGLSEDEQRWVVAAIVSHHRDEAEIAQTYPLGVRNDPLIELCREVDDETVRLLDEWLATCANPWREALGLAMVVEEITPQSVTVDAKRVRYWLQVYHDWVAANDPVARVPGILLRGLITTADHMASAHLHRVPPPITGSWSALAKRLLPQGEQIYEHQRQSGEMKGQSALLMAPTGSGKTEAALYWALGDGTAPPARIFYTLPYQASMNAMYDRLRQNFGDELVGLQHGRAAQALYARFREGEEWSAAARRVQWEKNLNILHARPLKVLSPYQLLKALFQLRGFEAMLTDYAQAAFVFDEIHAYEPERLALITGLMRYLREQFAARFFVMSATFPQLIRRRLTIALGNVPLIRASPEIFTRFRRHRLFLREGEITDPTTITEIVDKVRAGRQVLVCANTVARAQALRDQLAQAGLTDDQLLLIHSRFTHGDRTRLEQRIRSYCGSDVAERPPLVLVATQVVEVSLDIDLDTIYTDPAPLEALLQRFGRVNRRGAKGICPVYVFRQPNDGQGVYGRDRDPNRAGHIVRVTLAELEPHNGEIIDESAINDWLDRIYADPVLSQQWTEAYQRMAQQVELIINGLRPFQSDEQREDEFEQMFDGVEVVPQCFEQAYVDCLVQERLIEANDYLVSISKQRFAILRSQGKLRPAEEAGKRRVWVAQLPYDERNGLSFSDIVIDPDWS

SEQ ID NO: 11662 - protein, 799 aa, Chloroflexus aggregans DSM 9485
MVLYPYQQRVRNHILQGKSVILQAPTGAGKTRAALAPFIEGFFDRPDSTPRKCLYVTPMRVLANQFYAEYRALADSYCRRHGRHLDVRIQTGEQPDDRRFEGDLIFCTIDQFLSSYLVMPYSLPYRLANLNAGAIAGSYLVFDEFHLFDPEAALPTILHALPTLSRLAPVMLMTATFSIHMLESLTSFLSNAEIVTLTRDEITAIDCRGGQSPRQRYWTAVDQPLCADAVLQRHQRSSLVICNTVTRARALYRELKQKVGQNTELLLLHSQFLPNDRRRIEGELQRRIGVNANRTCANVIVVATQAIEVGVDISAEVLHTELAPPASLIQRAGRCARYPGEKGEVIVYRVEKYAPYAFKPDELLKREMDTAWQWLHECKREIFDFTREQELVNTVSAPRDEQVIDGLNADRVNRSNYIHTCQQGNRRGASRLLVRDVDSRLVLIHPNPDQLLDSPYDAIGLNIPVYSLRAMVREWLQRSVTAPWRVKRLDERQADDRAESRQMVYHWVDVQDTKELDETAILVVHPVLAGYSEREGFLPDTGDLPFVSSLPSATTRIERALQPLQVETYTEHIQRVLQAFSELALPELRYAAPALERAANWPEGSLIQAAWLACLLHDVGKLSSAWQQWAHAYQQAINQPVAKHVALAHTAFDRQNPSHVQAQQQVSAKIPRPRHASEGALACAEIITEALGKQPSLTKATITAIARHHAPFVNDCQPFQLVPNADQILACTVQYIPSALRQHIKVNLLWKQSNINQIQQFGNLITTPDDQFGWMAYTLLVRALRRADQRGTGLGSGAL

SEQ ID NO: 11663 - protein, 860 aa, Desulfovibrio desulfuricans ATCC 27774
MEKYTFWAKTYASNLPGISVLLHGRFASAVGRCLVRAMFPPQWQDLHAVVAFLLSIHDVGKISPQFQGKCLLWLEQNGLAREAANNAWPSFTTTHACLSQEILDYFWQQKGLLSESYSLWSAIVGAHHGKWAKAKPHHYGQVSPPCLAPSPSVDWLREELNFVAYQWEQHANTELPPVTGASASLYASAGLLVLADWIASDEHHFPANPTLAPIADEQIDRVAHDVVGSLGFASLEIRTGLSFEDIFGCSPYPMQVAAWCNITEPGIYVIEAPMGMGKTEAALMAAYKLMEQGKARGLYFGLPTQATSNRIYERVLEFILRISPTAQRVQLIHGNSWLLDDTLAMPEQQQLPDDSAADPKAGSGADPLRWFCSSRRALLAPVGVGTADQAMLAALAVKHFALRRLALLGKVVILDEVHSYDHYTRAIIQQLCRVLADLGSTVIILSATLSGSARSALLQSHSPVSSMGAEEDSLPYPCISGRAHDQDTVQVIPCTPPPSHTVHVDFQPLQGAISRTIDIAASGGQVLWVCNTVANAQETFRNIQAHAAVTDCQADMGILHARLPFFMREERETEWMQRLGKKGQRQRGCILVSTQIVEQSVDLDADVLFTELAPTDMLLQRMGRLWRHTRRDRPVPHPCMHIIAENFSLTDLLDMSAPAITKALGSKAKVYDPFILLRTLEVWGKAVSVTLPDDIRRFIYATYTEPEFLTEALQELYDAQFGKSAAMKMQAQINTDIWRLAGTDVEEYAPTRLSDHQEYGFVMYRSNVKNQITLLDGSVVNANDKDFRKDTARKLHRNAVRIPDYRLVKNPEKSKFLSGYNLMHWIKICDDGNLILPCLKNSAPPHWDKELGIIWPKQRK

SEQ ID NO: 11664 - protein, 783 aa, Methylobacterium nodulans ORS 2060
MTRQVELPVAAGRAEEASRAFDRLAEPVRRWIWQQGWSTLRDVQERAVPAILAGGDVILAARTAAGKTEAAFLPLLSRVLPKRDGGRPGFSLLYVSPLKALINDQFRRLESLLEACDMPLHRWHGDVSADAKRRARERPQGVVLITPESLEATLVRRGREAPRLFGALDAIVIDELHAFIGTERGRQLQSVLSRIEACAGRDRIDRVGLSATLGDMDLAREALRPGASDAVTLVESQEGGTELLLQIRGYERPLRQPTAPPKDRLQQPSGPGPNEEREAASAVPDLCAVEAIQTASLVEEPVARHLFEVLRGRRNLLFAGSRQNVEIYTDRLRALSEAARLPNEFFAHHGNLSRAERETVELRLREDARPTTAVATTTLELGIDIGDVESVAQIGPGWSVSSLRQRLGRSGRRPGKPAVLRIYVIEDEAGPTLHPADRLRLDLVQAVAMVELLLERWCEPPRTRGLHLSTLVHQTLALIVQTGGLRPGTAWQLLCEHGPFRNVSRDLFVEVLRSMARPEAELVEMSPDGLLMLGPRGERLTAGHDFFAVFQSPEEYRIVEGSRPLGTVPLDTTLAPGQTIIFAGRRWCIETVDERAKVVVVIPTNAALPPRFDGSGAGLHDRVAAAMRACLSGTHVPPFLDAGARTLLGQARDAFFAFGLDRGSIVEVEGDCVIFPWAGSPKLETLTLALRTRHFQASPFQHVIEVRDCSARNLRAALAEIAGSPPPDGHELARFAVKPMREKYDAYLTEALLVQAMTVERLEAQALPGIARLVLDPPFSSGP

SEQ ID NO: 11665 - protein, 887 aa, Anaeromyxobacter dehalogenans 2CP-1
MDGAPSGFWGKLRRPPGGPVERWHPLVAHCADVAACLEALLADDVIRSRLARLAGLGDLTPPQRARLCVLGALHDAGKFNHGFQRKGDPAPSDVAGHVGELFALLAAPGPERSALAEALSLREIDGWGASRLLVAALAHHGAPENVRSPSRPPRAALWRPADGRDPIGGIACLADAARSWFPAWREPADPFLDRPAFQHAFSGLVTLADWVGSDEASFPYASTKDGRMSFARERAPEGLRRLWIDPSAARTALGGRAPAFTRLFDVPSPRPAQQAVLDLPVAPEGGLTVLEAETGSGKTEAAVARFARLFADGLVNGMYFALPTRTSATQIHRRLVDAMRRCFPDENSRPPVVLAVPGYLRVDDAEGKRDPRLPPFSVSWPDDEQERMRWRGWAVEHGKRYLAGTVVVGTIDQVLLSALPLKHAHLRAASLLRHLLVVDEVHASDAYMNRLLATVLDRHLAAGGHALLMSATLGAAARERFTRARDDATPPPLSTCAEMRYPGITCRSAGSRVADSRPRPAGAAGNPKPITVESVAILEDPSAVARRALDAARAGARVLVIRNTVNGALAVQRALEVLAAPADGARLFTCEGQAAPHHSRYAGPDRERLDRAIESALGKGTDPGGHVVVATQTVQQSLDLDADFLLTDLCPADVLLQRAGRLHRHADRVRPAGFERARVMLLVPSTPDLGRYIDGRGAARGPHGIGTVYRDLRILEATWAFIRHRPEIDIPAMNRAFVEAATHPEALAGVVARGAGRWGLHARAVTGALLGEQVLAATNAFDWDRPFGDAGFPTGFDAVVKTRLGAGDRIARFEPAVPSPFAGSVEFLSIPAWFAQGAGSEEVPRSVNVSGRFVRFQFGARRFVYDRLGLRPEDASGPPHEEDAADA

SEQ ID NO: 11666 - protein, 728 aa, Ruminiclostridium cellulolyticum H10
MFAAHIREDGTKQSVKEHLLNTAVKARDFAHPFNGDDYAYTAALLHDIGKYSNEFQNRILKGGKKCDHSTAGAKEIVKINKSGRLIAYCIAGHHSGLPNYGSVSDVGIEGTLNARLNKVAIPRYDRFFDEIETINLPVMPNIKLTKNTNIGFILSFYIRFIYSCLVDADFLDTEVFMSNNSVDRTANYDFYLFRKKLNKKLSSFKTDTMINRYRKKILDACIEKAKLKRNLFNLTVPTGGGKTLSSLAFAVNHLIKNSMDRIIYVIPYTSIIEQTAREFKNIFGEENVLEHHSNFDFDDDENSIKNKMRLSSENWDMPFLVTTNVQFFESLFSHKSSRCRKLHNIANSIIIFDEVQILPIDYLKPCIEAIKQLVLNFNSTVVMCSATQPPFDKLFGELEPIEICDNHAELYNAFKRTNVKTHGVINSSNLAKEMNNIEQVLCIVNTRKHALKIFSMLEEQGSYHLSTLMCPVHRKEVINTIKERLREGLTCRVCSTRLIEAGVDVDFPLVYRAMSGLDSIVQSAGRCNREGKLMAEEKLVYGEVHVFYPEDEFVQHQPEAFKRPTMVTESIMRNFDDITSPRAICTYFEELFEITGDGLDFKKILERLESDVTNFNFSFQDISRDFKLIEDTAIPVIIPYDDKACTLIEKLKYSDYKSGILRSLQGYTVTIYKNEYDNLFGMGALDFITNGEINNKDIAILKRDSFNHLYDKNTGLKVTEETGIAIYI

SEQ ID NO: 11667 - protein, 773 aa, Thermomicrobium roseum DSM 5159
MVGEPLAKSGDPPITLRQHTLEVLAYVEQVIPAYRALWSRVLDSRSVDHLGRALPLAAAGHDLGKAALGFQRSLQERGFRWEFRHEVLSAALLLASGHATGDPGQLAIAAVLTHHRDLTEERLWRDCGVPQLPRPQFLEKAQRQFRERAAELGPFWEWIVRFSQEVEVLRTDQWPCSPHDLEPPAEFLRSLQERADRLHAFRSAEGLLLTLSRGWLLAADHAASAGIPRFVSTIPTEWRARHAERLAHSRAQGDGQLRAFQRALGEYEGSALLIAPTGAGKTDAAIRWIARNRIGGERIFYILPYQASIEAMGQTLERLFGRETVGTLHARTLEVAFQRYFSGDDYEEAYQAARQDAELNRLVHKPIKVTTPFQLIKWLFGLPRFEVGLAEMVGALVIFDEIHAYDAHVTALILELVRVLRELGARCLFMSATFPDFLRQYIEDAYAQPLRLFRLDQPPAHDTWAERFLAQARHRVEWTADPLEELVDLVVEAAQNGERVLVVANRVQQAQALYQRLVECVPDGLQLLHARLMRRDRVAREQRILAALRGESPEPVRVLVATQVVEVSLDISFDRLVTEVAPVDDLLQRFGRVNRYYEHNSPRPIVISRTYGDALYYVYDRERLERTLEEAPPHGHALDAFDAEQWVERVYREGWTTNEGRRFEQALASFRAVIEGLRPLQHADMAYEDFYRLFQGAEVLPSPFQEEYLRYQIEGKHLLAQQLLVPVPYGTFWKLHRAGRISQLKDGTLVASVQYDPDLGLLPEVADLDAVIV

SEQ ID NO: 11668 - protein, 801 aa, Chloroflexus aurantiacus Y-400-fl; identical to SEQ ID NO: 11624

SEQ ID NO: 11669 - protein, 784 aa, Chloroflexus aurantiacus Y-400-fl; identical to SEQ ID NO: 11625

SEQ ID NO: 11670 - protein, 775 aa, Caldicellulosiruptor bescii DSM 6725
MKAYEDIDLYAKRFKTEKGYEYQTIYEHTMTLLQNMEKLFKEYREEIEEGFQKLQIDLEMFKYLLKLAIIYHDLGKANSNFQRKIRDKTKSNEVPQVKCLSVEVPHNFISIAFVALEDEIDKGNISPEDFENLLFAIAFSHDRGFDFNYQYFEKYICEDVSKYLTNKTLLPLFKELPSFPTKDEIEKSSNYVYRTIDWLKEVMLKSYTDLYNKNTIMRILLKGFLHRLDHSSSAGISTEEGKITDFSHKVESYLKEKGNFVGFKEFQLKALDFSNQNVILFAPTGSGKTEFGLNWAGRSKLIYTLPIRVSINAMYERLAKIFGSNKVGILHSDSMIYLLEKYSQSAEDVQELESLFDNVNLARNLSFPIIVTTGDQIFTSALKWPGFEKIYSLFLYSKIIIDEPQSYSPESLAIIIKTLEEIVNLNGRFCLMSATVNPLVLKYLGDISEYLQAYSDEELKKCWSHVVSVKPLSILDCVDEIVNCGKQQNVLVICNTVRRSQEVYKAIKESIGNSDDVPVELLHSRFLEGQRRQKEHFILSNQRKNSIVISTQLVEASLDIDYDVLFTELASADSLLQRMGRVYRKRPYEGQKPNVIILTKEPSGIGRVYQKEIVTRTEEFLKRFDGRKITEYDKKELNEYAYDVEVLSNTNFMKSFKKAYELLKLGFKADRKIEAQKIFRDVVTVEGIPRKVFEVNEETIRECLKRIGSKSLSPIEKLQLISDVRKYTVTVPVYFFAKGGASEYSKKLGIFILNCDYDDELGLLPPKESEKDDIW

SEQ ID NO: 11671 - protein, 753 aa, Desulfobacterium autotrophicum HRM2
MSSFNIDEHYSSHPDYPLQRHLSNIAASFDDDTHRKAAMFHDLGKLSDEFQNYLNDPDHKKGTTHALESALIYLWFVNCQLTPQTFAVFFSILKHHGDLEDVHDFLYYKLAFSEDLLEKDPGLEEKIRVICDRASILSDIDMRNLCDGFDLDDIVRENKLNLIQNYFLVKDVFSRLIFSDKYEAIFKESFSEKNETCWEEYLSRLIKLIESKKNKMASIRNQARNEILDNYRENRDKKIYIIEAPTGIGKTFSALHLALEICRDKNKKRIINALPMTSIIDQTYEEYGLVINDDDLLKFHHLTRSKSYGSSEGDEKKETNSLGRQQNDFIAMSWSSDKVIVTTFNQLFNAFYSNKNRDLIKFWTLRDSVVILDEIQAVPRILIQDLIKTILYLSEHFNIDFVIMSATIPAIKNFIPSEKIAELLDNRYFSMDFNNRYSLKIDTDINTPESLWSAITINYENVNSLLCVLNTKKLSLETYNELEHSIDSSELFFLNTNFIPKHRSEIIRNIRNRLKNNQKTLLVSTQVVEAGVDLDFDFGIREFAPLYSMIQTAGRVNREGTKTGAVLQVTNKIGFSPYHGNDLLKKEVSELFQSQMEENEILPILKKYFQMAIERTPPDPILLSPMKELKFQTVHNLFIDNYMKEIPNLSSVFIEVEVGLYSQFYYKIESLYEALKHPGISLEEKMNYRSRLKGVFKEISQYVINVSRDEVVDLKDFYKNVEIQVCPHEFIGDKKRYSINKGWLGEKSLDIHF

SEQ ID NO: 11672 - protein, 755 aa, Sulfurihydrogenibium azorense Az-Fu1
MEEFYAKLYFQDGKAFPETLREHTENLLEELERIKKIYGKELESIGANEDFWNALKIACLFHDLGKISSHFQRKIKRYIGEDVKISSGTKEEIPHNYLSGIFLFNSSIANVLNNEFFDYVLYSVLFHHNREISFSVDYMDSVFKRDLKPKLCLLSWLSKFNIDLSNINEESPYFVYDEIKSYMNNSDKKISQIKKNKIFILFKGLLHRLDHSASAHLPVEENRIHNVDEKLISYLSKKDNFKGLKPFQEKAKELRNKNVLLTASTGIGKTEFAVNWIGEDKAFYTLPVRVSVNAMYDRFVSIFESDKEKIGLLHSDALFYGMESNETIDEFLSLEEHIIRTQTSRQFSMPITITTADQLFTSVLKYPGYEKIYATLMYSKVVLDEPQSYSPDTLAIIIKGLQEIAYYGGKFCFMSATIHPFINEYLKDFVEELDPVFNSEKKHKIKLENRTIDELSKEIISQFNQGKKVLVITNTVKKAQELYKILKEIENLNVKLLHSLFIQIDRNEKEKQIKSPTEPVIWISTQLVEASLDIDYDIMFAEISTLDSLIQRMGRVYRKQGRIINESDNANIVIATKEPSDKGKIYNNEIISFTLEALEEFNNKILSDEEKQNLMKKVYEIEKIKNTSFYKNFIKNMELLNAGFKTDTKGEAQQLFRGILNINVIPEEVYQENLDEIEKAIEIALDKSKKYSEKIQAFYTLNKFTVSMPFYKLKNIIPTQITPDKFRNKIFTVNFEYDSEFGLDISKDPELGEIL

SEQ ID NO: 11673 - protein, 762 aa, Sulfurihydrogenibium azorense Az-Fu1
MFSGLLSHPDRYIEEHLSNVLEIGLKFFQDIYQDKVLKDVFSIILFSHDLGKTTDYFQRYIQGEKVDKKLKNHSLLGAVVSLYLTDRYLKTEQIDDNFLLVISFVVPKRHHSDLQDFMDDLVLDDDDIDLLKQQIETIDKEKFKVFLENLKIENKDIFDFDFDEIDLEKIKNLVSDLKRFVRKEIRKTDKLDYYVKALLFYSLLLDADKSDVGIKTDKDVLFKKFDLKPDLVANYVENLPKQDNILYNLRQQAYTEIKNQEVDLKHKIYTLNLPTGIGKTLLSFKYALKIADKFKQETGKDLRIIYVLPFLSVIEQNHKVIENLLKHSNINVDNSLLLKYHHLTGFNYKDEEEILDYDTSRILTEGFNSKIIITTFMQFFYSIIGNKKGMVRKFHRLTNSVVILDEVQSIPTKYWLLIREVLYFLAERFNLYVIYTTATLPDIFINGKNLSSGEYFNKLNRYQINIDLSQKTVSEFCSNLQLQHDKSYLFILNTVSSAKEVYNFLKQKYPDQVIYLSTHIIPKERLKRIQALKDKLKPIAVSTQLVEAGVDIDFDVVYRDFSPLDSIIQSAGRCNREGLREKGLVYVINLIDDKNRKYSSYVYDTVLLEATKDVLTKDLYDEIEIQELVKRYYRLLNERKYQDRDILKSATGLVFSGENSIEDFLLIEEGKYKQDVFIQLDDRAVEVWNEFKKVLTIENLFERKKAFNSIKKDFYEYVVSVPIKNNEPNKDGNFYVVHKSELEGFYDEETGYKVKGDIFLEY

SEQ ID NO: 11674 - protein, 771 aa, Acidobacterium capsulatum ATCC 51196
MTYWAHSDANRSPDEEGHRWQPLSEHLAQVAALARELAERATAPASALSTLAYAAGMLHDYGKYQECFQRMLHGGSSRCPHAIYGAIALRCFDEDGCGTDRKWAMPAVCAIAAHHAGLKDFSEHECITDPGNPAFAAEREIAQKLLGAAATDFPEIRSAFSREKSRLEQRSVDMQTRMLLSCLVDADRLNTAGRLLVQQELHSEHRLEQMNIYLDRVADAARKRGTAASVLNVRAQVQQHCSDAAKQSPGVFSLCVPTGGGKTLGAMRFALEHAAHSQGKLRRVIVVIPYLSIIEQNAKIYADVFGPEAVLEHHSGAVTPLMRSERETTSTTCASEEDEISPSVHPRTIETENWDAPVIVTTSVRFFESLFSNRPSDLRRIHNIARSVIILDEVQTIPRRLLAPLLGMLRELAEEWGCSVVLSTATQPAFEARNPRQTYLFPFGSIKPIIPGETSAAMARTLQRVQIDWEIEDRIRWEELATRLAEQRQVLCVVNLRDHAATVFDGLRTRLPSEEQTGLFHLSTRMCAQHRLRVLDEIRHRLGAGLTCRIVSTQLIEAGVDLSVPIAFRALGPLDSIIQVAGRVDREGTASAAAGAPAGKLIVFRPEDERYPGMDYKAAAAITQGVLDEFESLQTDHLRSISDYFQRYYESGGTGGRGEHLADMRQRDNPYFAELADAFEMIESRTATVFVPYGEGASLLRELADTRQLDRDLLRKLQRYTVSLQRYEFEAAKSQGLFEIWSGSDLWTCDAAQYSAEKGLLPQLPAQAFVV

SEQ ID NO: 11675 - protein, 661 aa, Azotobacter vinelandii DJ
MLAVERYGALGRLLAYGIAGHHSGLANGRDPGECSTLEERLKGQSLPALLDQWQNEIQLPAMSELGPLPIKPVRERQVFQLAFLARMLFSCLVDADFLDTEAYYDRIEQRPSRRSARPSLPHLQQALNVHLAGFRADSPVNRIRADILGHVRQQAVQEPGLFSLTVPTGGGKTLASLAFALDHAIRHGLRRIIYVIPFTSIVEQNAAVFRKALGEFGEQAVLEHHSAFSDNRAQDRQARDKLRLAMENWDAPIIVTTAVQFFESLYADRPSRCRKLHNIAGSVIILDEAQTLPLRLLRPCVTAIDELALNYRCSPVLCTATQPALQAPEFRGGLQGVRELAPQPEQLFQRLVRVQVRQVGILSDAALQRQMAEREQVLCIVNNRRHARALYESIAGSDGARHLTTLMCARHRSQVLAEVRQRLHDGQPCRLVATSLIEAGVDVDFPTVLRAEAGLDSIAQAAGRCNREGLRALEASEVLVFQAENPDWKAPQDLQQFAQAAREVLRNTTGDPLAPGVITRYFQHLYWQKGDRELDAKDLLAQIESKRLEGIPFEMLAREFRMIDSMQCPVIIPFDDEAQESLRALEFADGCGELARQLQPYIVQLPRQGYDALLKAGAIQPVAPERYAEQFMQLVNPDLYHAQYGLHWDNPTFMDVTNLVI

SEQ ID NO: 11676 - protein, 501 aa, Sulfolobus islandicus L.S.2.15
MLSLADFYNDFITRHGFEERKGIEETLLNLEKGHSVILKAPTGYGKTTLTMILANAVSSDIDLGSRVIHVLPYRAIVQDLYLKLKNYADKGVISTKNIGAQDMDYQDSPFFMKKVNVTTLDTFILNLFKLPTIDFKLIFKNHGSHYEFPRALIYSSIVIFDEFHLLGEDGKSLGAGLAALEVLKDAGVPIVVTSATIDKGLERVLMNKLGKNVKVVNADDFKIDRKVYVNVLENDEISITEEKVKEGKRVLLVYNTRMGAIEAYKKLKGMGLSPILIHSKFSKKDRIDKVNKINEAKLVVSTQVIEAGIDTSFDVLITEASPSHNLIQRAGRVARYGKGGRGKLEGEVYIFPFSGKVYDEREVKETVERIRELKTIDENLLIERNYTEVIDSILAKDLSVIDNSVFVDSKKMKSMYEEICSITRNASIILGFPPNSNDVNDAIPLTEKEAIEIIENKGSSAFVGNGNVKLYNKKCLQLEMLKNDILGVRIQDYNSEIGGVY

SEQ ID NO: 11677 - protein, 548 aa, Sulfolobus islandicus M.14.25
MRKGIQKFLDILNCRDNSIYYECEDVNFILTFPTGYGKTTLSLEIAQMIDLKPTQNFSRLIHVVPTRSLAKDIQNSACERGLGFAVQYSFTPSHIKSPLFLAKLIITTYDSFLLNLYKASIGETFSYHGHYDLPRFGIYTSLVHFDEFHLMNEGNSWTSLLGAVRHLSKVGVNMILSSATPSKSVEEELIRMMENRKVVRLAVVNEYGESAKNRNCVKVNEGYYECKVGSVKYISLEVKDKIKVPNININFLDKEDEVLEVVKRNKDKKIMVIVNTVDKAITIYEKLRDLSPCLIHSRFKIGDRDEKLRKECNIIIATQVIEVGVNISSEVMISEQAPITSIVQRVGRLLRDNKKDEGELYIWKSGNYYPYDKDEVENTVKELKSKKDNISLKLPSSYGEIVDRIIKPPEEDLDLLKELDYIAENLFATREDLEKLLDKYCTLTNSYVINVAYDTPASERDLIPLDGDLALKIAIRGNDCVYAYVEEYMPERKVELDKVNVRETCVKITKPCRDYRKVFYDEDKRYIIYALKIDKELYNEETGLRLKK

SEQ ID NO: 11678 - protein, 501 aa, Sulfolobus islandicus M.14.25
MLSLADFYNDFITRHGFEERKGIEETLLNLENGHSVILKAPTGYGKTTLTMILANAVSSDIDLGSRVIHVLPYRAIVQDLYLKLKNYADRGVIYTKSIGAQDMDYQDSPFFMKKVNVTTLDTFILNLFKLPTVDFKLIFKNYGSHYEFPRALIYSSIVIFDEFHLLGEDGKSLGAGLAALEVLKDAGVPIVVTSATIDKGLERVLMNKLGKNVKVVNANDFKIDRKIYVNVLENDEISITEVKVKEGKRVLLVYNTRMGAIEAYKKLKGRGLSPILIHSKFSKKDRIDKVNKINEAKLVVSTQVIEAGIDTSFDVLITEASPSHNLIQRAGRVARYGKGGRGKLEGEVYIFPFSGKVYVEREVKETVERVRKLKTIDENLLIERDYTEVIDSILAKDLSVIDNSVFVDSKKVKSIYEEICSITRNASIILGFPPNSNDVNDAIPLTEEEAIKIIESKGSSAFVGNGNVKLYNKKCLQLEMLKNDILGVRIQDYNSEIGGVY

SEQ ID NO: 11679 - protein, 501 aa, Sulfolobus islandicus Y.G.57.14
MLSLADFYNDFITRHGFEERKGIEETLLNLENGHSVILKAPTGYGKTTLTMILANAVSSDIDLGSRVIHVLPYRAIVQDLYLKLKNYADRGVIYTKNIGAQDMDYQDSPFFMKKVNVTTLDTFILNLFKLPTVDFKLIFKNYGSHYEFPRALIYSSIVIFDEFHLLGEDGKSLGAGLAALEVLRDAGVPIVVTSATIDKGLERVLMNKLGKNVKVVNADDFKIDRKIYVNVLENDEISITDEKVKEGKRVLLVYNTRMGAIEAYKKLKGRGLSPILIHSKFSKKDRIDKVNKINEAKLVVSTQVIEAGIDTSFDVLITEASPSHNLIQRAGRVARYGKGGRGKLEGEVYIFPFSGKVYDEREVKETVERVRELKTIDENLLIERDYTEVIDSILAKDLSVIDNSVFVDSKKVKSIYEKICSITRNASIILGFPPNSNDVNDAIPLTEEEAIKIIESKGSSAFVGNGNVKLYNKKCLQLEMLKNDILGVRIQDYNSEIGGVY

SEQ ID NO: 11680 - protein, 501 aa, Sulfolobus islandicus Y.N.15.51
MLSLADFYNDFITRHGFEERKGIEETLLNLENGHSVILKAPTGYGKTTLTMILANAVSSDIDLGSRVIHVLPYRAIVQDLYLKLKNYADRGVIYTKNIGAQDMDYQDSPFFMKKVNVTTLDTFILNLFKLPTVDFKLIFKNYGSHYEFPRALIYSSIVIFDEFHLLGEDGKSLGAGLAALEVLRDAGVPIVVTSATIDKGLERVLMNKLGKNVKVVNADDFKIDRKIYVNVLENDEISISDEKVKEGKRVLLVYNTRMGAIEAYKKLKGRGLSPILIHSKFSKKDRIDKVNKINEAKLVVSTQVIEAGIDTSFDVLITEASPSHNLIQRAGRVARYGKGGRGKLEGEVYIFPFSGKVYDEREVKETVERVRELKTIDENLLIERDYTEVIDSILAKDLSVIDNSVFVDSKKVKSIYEKICSITRNASIILGFPPNSNDVNDAIPLTEEEAIKIIESKGSSAFVGNGNVKLYNKKCLQLEMLKNDILGVRIQDYNSEIGGVY

SEQ ID NO: 11681 - protein, 548 aa, Sulfolobus islandicus M.16.27; identical to SEQ ID NO: 11677

SEQ ID NO: 11682 - protein, 501 aa, Sulfolobus islandicus M.16.27
MLSLADFYNDFITRHGFEERKGIEETLLNLENGHSVILKAPTGYGKTTLTMILANAVSSDIDLGSRVIHVLPYRAIVQDLYLKLKNYANRGVIYTKSIGAQDMDYQDSPFFMKKVNVTTLDTFILNLFKLSTVDFKLIFKNYGSHYEFPRALIYSSIVIFDEFHLLGEDGKSLGAGLAALEVLKDAGVPIVVTSATIDNGLERVLMNKLGKNVKVVNANDFKIDRKIYVNVLENDEISITEVKVKEGKRVLLVYNTRMGAIEAYKKLKGRGLSPILIHSKFSKKDRIDKVNKINEAKLVVSTQVIEAGIDTSFDVLITEASPSHNLIQRAGRVARYGKGGRGKLEGEVYIFPFSGKVYVEREVKETVERVRKLKTIDENLLIERDYTEVIDSILAKDLSVIDNSVFVDSKKVKSIYEEICSITRNASIILGFPPNSNDVNDAIPLTEEEAIKIIESKGSSAFVGNGNVKLYNKKCLQLEMLKNDILGVRIQDYNSEIGGVY

SEQ ID NO: 11683 - protein, 472 aa, Exiguobacterium sp. AT1b
MYEATLKRVFGYESFRPGQRDIIHAVIEGQDVLAVMPTGAGKSLTFQLPSYIKNQGLTVIVSPLLSLIEDQMLHIRERGERGVARLTSMESAEEKQDIINHLKRYRFLYLSPEQLAVPYVTRALANVKIQMLVIDEAHCISQWGHEFRPEYARLGELRKQIGSPQCMAVTATAPEGVKQDIIEKLALFSPEQFVHSANRPEIRLLVERLEKEKKLERLKELIREIPKPAVVYTATRREAEALAFELEDALFYHGGMSTEDRRLVQSQFLRDEVSVMVCTSAFGMGVNKDNVRSVVHFQLPATVEAYMQEIGRAGRDGQPAFAVLLYADGDERIQQFLIDGQYPKDEDMRLAYFERENGTSIAQLPRLLRMNEEDPKFLLLKQLLTERSLQEALDWVKERKRDRYRQLGQMMDYALIRTCRRDYLLRYFSEQTVDQEECCDVCGPIPFPDTPQIVRKNVTEWKIRLTQIFSFE

SEQ ID NO: 11684 - protein, 818 aa, Teredinibacter turnerae T7901
MDYIAHIRATGERQLLQTHLSEVGELAASFAEKVGLAEAGRLLGLLHDFGKYSNSFQAYIKSANADLDRDDADFVDPVAMKGKIDHSTAGTQFIWKLLLERYPAVGNVHCVAQILAICIASHHGGLINFLDQSGDNRFNIRLAKADDLTHYTECLENCGEVFREGIQSQVNNEFLRSFIVVLKSMYPADAKQTIAFFYLGFCTRFLFSCLVDADRINSIEFDNPKAKALRLKRKKQFSWDTAIERLEAYLSTLDTNKSINRLRAQISLDCLNKAASPTGLFKLSVPTGGGKTLASLRFALQHAKLNKLDRVIYIIPYTSIIEQNAHVAREVLEHAGDEFSWVLEHHSNLEPELQTWESKLLSQNWDAPVVFTTMVQFLEALFGGGTRGARRIHQLARSVLIFDEIQTLPVRCMHLFCNAINFLTQSANTTAVMCTATQPLLDRLSKPELGQLEFSSGAELVEDPTALFASLNRVSVEDLCKQPGWTESEIVELVLDTYKKNKTCLVIVNTKAWAKRLFERCGEFLPADNIYHLSTNLCAAHREDIFKEVRMRLEAKRPTLCISTQLIEAGVDISFASVVRFLAGLDSIAQAAGRCNRNRELEDESGNAALGHVYIVSPEDENLGSLVDIQLGQAATRRVLGEGFSNLLSPEAIERYFFYYFSDRKDDMAYQLQEKSLDKSENIVRLLSTNHANMAYKQPPAKHLPQLQQSFADAAKHFKAIDAPTVGIITPYGEGQEIINELCGLDRYTERDRMRELLARAQKFSINIYENLFNELRSLEAILEAQHGLEIYYLKQEYYLNESGLSVEGGALPFLFDC

SEQ ID NO: 11685 - protein, 501 aa, Sulfolobus islandicus M.16.4
MLSLADFYNDFITRHGFEERKGIEETLLNLENGHSVILKAPTGYGKTTLTMILANAVSSDIDLGSRVIHVLPYRAIVQDLYLKLKNYADRGVIYTKSIGAQDMDYQDSPFFMKKVNVTTLDTFILNLFKLPTFDFKLIFKNYGSHYEFPRALIYSSIVIFDEFHLLGEDGKSLGAGLAALEVLKDAGVPIVVTSATIDKGLERVLMNKLGKNVKVVNANDFKIDRKVYVNVLENDEISITEVKVKEGKRVLLVYNTRMGAIEAYKKLKGRGLSPILIHSKFSKKDRIDKVNKINEAKLVVSTQVIEAGIDTSFDVLITEASPSHNLIQRAGRVARYGKGGRGKLEGEVYIFPFSGKVYAEREVKETVERVRKLKTIDENLLIERDYTEVIDSILAKDLSVIDNSVFVDSKKVKSIYEEICSITRNASIILGFPPNSNDVNDAIPLTEEEAIKIIESKGSSAFVGNGNVKLYNKKCLQLEMLKNDILGVRIQDYNSEIGGVY

SEQ ID NO: 11686 - protein, 704 aa, Eubacterium rectale  ATCC 33656
MEYIAHIEEERKQRLIDHLDGTAKLAGKFAESFGKYEWGYCIGMLHDLGKYSKEFQHKIQFNTNDRVDHSTAGMRLCNEKGGYYSILQYAIAGHHSGLMDYYKLEERYRKSICDYQAYRQEVEIPQIKSDPFESCKTQNPHFSMGIFMRMLYSCLVDADFLETESFMKNNHVERTSGEEMASLLARLERHIGSWLENDDLNSINGRRTEILKACLIAGENDRGLFHLTVPTGGGKTIASLAFALKHAVRHQMEHIIYVIPYTSIIEQNAQVFREILGQDNVLENHCNVDYGDSEELKPMQLASENWDKPVIVTTNVQFFESLFASRSSKCRKIHNIANSVVIFDEAQMLPLEYLKPCIAMMENLMDFYRTSIVLCTATQPALDSIFDQHRRYIELCPNINEQFKFFKRVIYENLGIIEFDTLIERLKTEKRALCIVNTKKCAQQLYEQLSGDGVYHLSTSMYPKHRKKILAQIKERMSDKSKSCVLISTSLVEAGVDLDFNSVYRQVAGVDSVIQAAGRCNREGIEKKENSKVYIFDINGMKTVPGQSLQSSITKGLLQDYHDISNLECITEYFKRLYHFRENDLDKKNIIGEFKDWKYNFETVSEKFHLIEENTRIVFIPIEQEAKDLLFEIKNQGYGKARMRKASQYCVQIYNQLFDTLYGAGIIKEITSDIENFYELVDEEMYTDDKGLNLSVESGMDLYL

SEQ ID NO: 11687 - protein, 726 aa, Geobacillus sp. WCH70
MTFYAKSETKETIREHTDRLLDNLWLLKNSYGHKFVRMDERMWELLRLAVEYHDVGKANTVFQNKIRRAIREEMLETDCDADVPHNYLSVGLIPFSRLDLTKEESRLLIHAVGYHHERDKPPDKEMIRHILETDMKNQRNAISEHMKLPLAEKLSFRFVDRLLKRYTIHDGDQFWNYVLLKGLLHRIDHAASAHLPVEIDIDQSIGASVRNYMNQQGFRKNALQQFTEANQDKNVVVVAQTGMGKTEAALLWIGDDKAFFTLPLRVSINAIYERIRDKMGYDAVGLLHSTSVHYLAEKGEENWEAIKQQSQQLSTKLLMTTIDQILKFPFYYRGFEKELATMANSKIVIDEIQAYDPKIAAMLIKALEMIHNVGGKFMIMTATLPTLYLDELKKRNIINEEHSVFGEFIDTSKHRHRIQLHAKEITEGLEDIVRKAQTSQVLVIVNTVRRAIELYQSLSEHEQNIPVYLLHSQFTQEDRQLLERKIKEFNDKKINGIWITTQLVEASIDIDFDYLFTEMSTLDSLFQRLGRCYRKRILDEERCNVHIFTENISGVPRVYNEHLINESIKLLQPYDGHILDERTKVEMVKQLYERKRLIGTAFLQEFEDALYMFDNLDPYGMNKKEAQRKLRDIQNIQVVPRRIYDGMIDLLEAYAACRDVKERLRLRMEIEKKTVSVQRFIAEKYVSERLPKPFEHIYIIDVEYDFQRETSKGKGILLDTPMSTFY

SEQ ID NO: 11688 - protein, 667 aa, Thermococcus gammatolerans EJ3
MASRELSAEELFRRITGHEPYDYQLRAWEKIDTAMSNGGKVVIEVPTAGGKTEAAIVPFLVEAYNGTWAVSRLIYALPTRSLVEKQAERIRKLLVKVLELKGKSEREAKELAERLVIVEYGLEPTHAFLGWVVVTTWDAFLYGLAAHRTVGRRFTFPAGAIAQSLVVFDEVQMYQDESLYMPRLLSLVVKQLSKANVPVVVMSATIPSELRKMISGEPEIVMVRSDDGKKPERGKVSVQVVEGTIESVLDDIKKALKRKERVLIVRNTVDRAVSTYLTLKPVAEELGVEALLIHGRFAVEDRKKKERALDGAQLIVATQVVEAGLDLLNVGLVVTDIAPLDALIQRIGRCARRKGEKGKAIVLVETQDIGSFPKIKSFSEARRIIEERIGAKIEPFVEFENHKEYKRVLKLTLVSDKKQTTWYIGTLETIKELKKKKPPKDLFIVPYDTAPYDPLVLLRTYDELDSLGHYLYNVEEARKALDRVYEFHYANNIVPKEFHSAYIYFRELKLFSAPPEYELRSRPELYSMLYILDEDLEKELKPNSRNEVNLNPNRIIRISHSTLGAMWDSIKNCIKRKVVREWDSKKEKYRWVLESVNEKSPRALTIYAVSKDCYSEELGLWRRTSDATVNGRKEVNQTQVTRTSKTHEKKNFEKKGQATLLDFVGGE

SEQ ID NO: 11689 - protein, 772 aa, Methylorubrum extorquens AM1
MTGPAAAPVPALSEDRASQAFEKLAEPVRRWIWQQGWSELRDVQEQAVPAILAGGDVILAARTAAGKTEAAFLPLLSRVLPTLDGGRPGFSVLYVSPLKALINDQFRRLESLLEACDLPLHRWHGDVSADAKRKARERPQGVVLITPESLEATLVRRGGDAPRLFGALAAIVIDELHAFVGTERGRQLQSVLSRIEAGAGRDRIDRIGLSATLGDMALAREALRPGEPDRVRLVESREGGSDLLLQVRGYECPQRREPSRDTPALPPAGPGARGTLPVRPEDGSHPASAEVGPIAEHLFEVLRGRRNLLFAGSRQNVEIFTDRLRSLSETARLPNEFFPHHGNLARAEREAVETRLREDGRPTTAVATTTLELGIDIGDVESVAQIGPGWSVSSLRQRLGRSGRRKGKPSILRIYVAEHAFAPTLHPADRLRLDLAQAVAMVELLLDRWCEPPRVQGLHLSTLVHQVLALIAQTGGLRPDTAWQVLCRRGPFRNVGRDLFVEVLRAIARPEASLVEMSPDGLLMLGRAGERLAAGYDFYAVFQVDEEYRVVVAGGKTLGTVPLDTTLAPGQTIIFNGRRWRVESIDARAKVLLVIPTAAALPPRFGGDGAAIHDEVVAAMQRCLAGTHVPAFLDPGARALLEQGRQAFRADGLDRRSILQIKRDCVIFPWVGSLKLETLALALLARNFQASPLWHTVEVRDCSADDLRAVLSEMAASPPPDSEVLAVLAAKPAREKYDPYLTDALLTKAATAERLDAASIPAVARRILGTCA

SEQ ID NO: 11690 - protein, 733 aa, Thermococcus sibiricus MM 739
MINEKMLPNLGLDTLSKTSHKNEQQEKSLKQHIEEVIRVSKSLAKKHGLQEYEKVLKTLAWWHDLGKLNPKWDITKKKKPPHSALSAYLFLRHSNIKDPRIFYFILRHHSHLTPILSHPNYLAKNVLGRIQFPIDYNSVFRLIYQETKQFNEFIEKNKRENVIYVDLFGIFKTADIVSAMFESENEIIKEKPSFRETDIKQGLQRYVKDKGLQFNEKKWELFLNMANSGENILFSAPTGWGKTFASLTIASTKTPTHIIYVLPTITSIRKMKETIKKILKMKVEDNYYFADVEKVAKQKDYERSVDWELFISRSFMSPVTLTTLDQIVLTFLHVGKYFLKRFHFRNSIFIFDEFHLYPISGLYILLKFIQKYNQEFDYNIKTVFMSATVHPALENLVSSYISPISFDFTEEYKRKRRYMYSINEEDIVSPAILEEIAKKAQDGNVLVICNTVEKAIKLYLLLKRHYKIKKTLLLHSRFTYKDRKEKETQLEWLSRIPKGFVFVSTQVAEVSLDMSFDYLFTELAPLSSLIQRFGRVNRYSTFTNNENVKILKPSELVDKRRYPYDLDELSLAKTILEEFDGNIKTEFELIEQFKESSLKLDKTKLKEIDKYLQKWDNDTRYFFSIDLNDKELDKILNFRETNTILVIPECFIDKIADILASSSKYKLQKIKEYLTPIPIWWLFFDDSFLSMYHNLPVLSSSRFLYSNEVGYFDSGKLSEFINEINVCEKEEIV

SEQ ID NO: 11691 - protein, 763 aa, Aggregatibacter aphrophilus NJ8700
MSQSVIRYAHSAQDEFGNLLPYEHWQTLQSHSVNVGEMAAEFARVFGAQEIACQTGQLHDLGKYSDPFNHRLHGGPPVDHATAGAKIAVERWGNAIGKLIAFCIAGHHAGLANGNGEGDNRRTLKQRLALQFGADIPTLDNLWQQEIKLPQNLSAPPLKADAHHPFFSYAFFTRMLYSCLVDADYLDTEAFYLNLENKTVERDGYPNLNALQHNFNQFINDFRRRIAQTPKQTEAEKRNAALNRLRSEILDHAVEQAVQAQGLFTLTVPTGGGKTFTSMAFALEHAKRHDMRRVIYVIPFTSIIEQNAAEFRKAFGELGEQAVLEHHSTFDDGKLQNEATKDKLRLASENWDAPIVVTTAVQFFESLFADRSSRCHKLHNIAGSVIILDEAQMLPLNLLLPIMQAIKELAQNYHCSVVMCTATQPAVQAENGFYRGFENVREIAPKPTALFDKLRRTTVQHIGTQTDADLLAKLGEYPQMLVIVNNRRHARSLYDQAKHLDGTFHLTTLMCAKHRSQKLDEIRGRLKNGDPCRVIATSLIETGVDVDFPLVMRAEAGLDSVAQAAGRCNREGKRPSENSFVWIFAPEEQWKAPPELATQAAVMRLTADSFSDDLLSTQAVAAYFAELYQLKGSELDNKKILKMHNDTGQSLDFPFQTIADKFRMIESHMQPLIIPFDVEAENLISSLHHADHISGLLRKLQPYTVQIPEKALAALYKAGRIEPINEKNFGKQFYTLIGLDLYDDVAGLSWEDVEFLKGESLVF

SEQ ID NO: 11692 - protein, 698 aa, Paenibacillus sp. JDR-2
MKAFVYVVRVGGAWSAQMTIAPEVDQLFWMEEGLAEAARLADGRYGGMRNKDKGRNEAVEMRLKGERAEEGWLWQEALPLGDAIRCVELWEREAGSRASRDSSGVGSAQRRGIAGSLGSTANSDGGPLASLAACVAQARREAGAPMNGPGPQAAGDASLLARRWARAAAAAGGSSPGTARAAARAREALAAAAQQAAAAMQGRALLRSEAHALLEGAAADMGGALQLAQLLGWLRLAGAVAAEHGRRRRECRCRRCGSGEAHMHRTQCAACGRMCAYCSACLTMGRSRECELLVLGMPALPLESGSISADLSKWQLSPAQAAATASALQFIEAPTTPYQPEKNKEFLLWAVTGAGKTEMIFPLVESVIFRGGRALIATPRRDVVIELDPRIRRAFPQARVVTLYGGSEQRWEAGDITLATTHQLMRFHQAFDLVIIDELDAFPYHGDPILHYAAEKSRAPHAPKLLLSATPPTELQRRVKSGQLSHARVPVRYHRHPLPVPVLLRTPTVAKLLQTRKIPRALLAALNHSLDRDAQLFIFVQRISQVEPMAKLLSVLLKLSAVEGTSSQDPDRADKVSRFRKSEIRVLVTTTILERGVTIPRSDVYILDADGRLFDEASLVQMAGRAGRSGDDPNGFVYFCGRERTGAQAAAVSQIRAMNRIARKRGYLLPEGQVSSGWWSSLFKRSNKTSFDRPSSYE

SEQ ID NO: 11693 - protein, 871 aa, Dickeya chrysanthemi Ech1591
MIRLTKRPPQTDNTAPAIHFENCPAKSWKQNDGTVVQGRSVLNHCQIVGEIARYLISRFPESMRNHLFPPGSEMAAGSHDIGKVSPTFVAKILSACGIDYKTIPELAGVNPELEKQWGGHAGVSQATAEEIGVPKYVAEILGQHHGFNPMVDDKPGNADAFGGSHWFDERKKLVAALKACLQTDWPTFDSAAQARIVAGLTSVADWIGSGEFFENPNEDWQPNIIAALNNAGFITPVIRKGLSFTEVFDPLNRSMQLREPQSLFIEQVSGPGVYILEAQMGMGKTEAALYAAYQLLVQEKARGIYFALPTQLTSNKIYERFNAFLEQIVSDQTPKRGLLLHSNAWLLDTEIGEEGSPGGSWFDQKKRGLLAPFAVGTIDQALMAVMNVKHGFVRAFGLAGKVVILDEVHSYDLYTGTILNELVAFLRQIDCTVIILSATLSQSRRAALLQQTATSTAYPLITAVPAAMEKNTPLEVGVPTVDSDPVTLELCHESEPALEEALRRAALGQQVLWIENTVAEAQQRYLDIASRATEAGCETGLLHSRFTPQHRTINEDRWVTLYGRAGWQQRANCGRILVGTQVLEQSLDIDADFLVTRFAPTDMLLQRLGRLWRHTDTPRHASARPECWLLAPALEHALALPHSAFGKSAMVYSPYVLCRSLEVWKDINAIRLPSGIRPLIDQTYAERSETGQWAGLLHELKNGSRFRTGEQAQQALAKLTLSKGGKTLPEHKAETRYSDQDTHDLLLLRSLRSQDGTTTIRLLDGTELTLPHSRHRLTKAEWRKLAVALNQQLVRVNPAYCPPKTAKHELEKLHLNEVFYLGRPEDDEALLRVAIVNHVGELLTLDGHPAGDKYILEYREDLGLRAISNKE

SEQ ID NO: 11694 - protein, 743 aa, Geobacter sp. M21
MQHSSSEESQAFYLLDEKIRRWVWDQGWMALRDAQERAIPPILSGDTDLIIAAATATGKTEAAFLPICSRLLSQEGQDACVVYLSPLKALINDQFSRMEQLCERLDIPVHPWHGDISGSKKKNFLKNPKGILLITPESMESLFVNHGTAIPHLFGNLLYIVVDELHSFIGSERGQQLQSLLHRIEFSIKRRVPRIGLSATIGDMHLASQFLRPNGDTETEMIVSTATGQELQLLLKGYIQRRPVLTPVGESEVEVEVDGSLLDIGANLFKTLRGNSNLIFANSRNRTEFFADHLRRLCEEQHLPNEFWPHHGSLSKELREDAEAAIKDKSHPVSIVCTSTLEMGIDIGSVKSIAQVGVPPSVASMRQRLGRSGRREGDPAILRIYVQEEELTEKSDPSDCLRAGLVQTIAMVRLLLAKWYEPPTTGGLHLSTMVQQMLSLIAQYGGVTAAQTYNVLCKNGAFPLVSQKMFAEFLRNLGEQRLIMQASDGLLLHGQFGERIVNHYSFYTAFTTPEEYRLVSGDRTLGTLPIDRPIAVDSLMIFGGRRWHVVEVDVAKKVIFLKPAKGGKAPVFGGEAGWIHDRIRQEMFAVYKEKTVPVFLDAQAKELLSEARENFHRYYLTEKNMMPQGNATYLFCWMGDRVQETLAAMLRSKGLKAVNEGIAVVVGGTPPDDVNRCLRELQKEGLPDAYDLAKSVLNKACEKYDLFLTDDLLSTDYAASKLDAEGAFNTLKTIHLQKKEMLS

SEQ ID NO: 11695 - protein, 832 aa, Saccharomonospora viridis DSM 43017
MQAPWGKRRGLEAADGSPREYPLVCHLCDTAAAALVLWEDHTAPGVREWVANELDMTPHEAGRFIAYLAGLHDIGKTTPGFQCQDSTDKNSVDTIRHEIASYLAVPTLIEHPEKPASFISGIAHRIGEILGGHHGVFPPVDRRTRKPLHVPELGGPEWDTARRTIHTELRAHLNPTLPTCLPQPVAAALTGLVIVADWIVSDARWILESQWDAPIGIAARWEHTLNATRARVHQLGLAHPTPGPLDLARILGGPNRSPNPLQQSIIDDFHPTGPGLLTIATPTGSGKTETAWIAAHKLATATDRYGTLMCLPTQATTNSMWARTSATVDNTVTLAHSMAVFHSPYRHYSTHDPDALRWLNGRKRPMLSAHAVVTIDQLLAAGLTAKHNMVRQWALTGKVVIVDEVHACDIYMLTVLARVLEWLGRLGVPVVLLSATLPGHVSRQLTAAYLTGAGCSSPNPRPVAYPGWVWHPITGSPVEPRNRAQISRAHARTARVTVTHYTGPVEAAAANAIQPVAKNGGCAAVVCSTVDTAQRIYIRIRDTYPGMCVWLLHSRFPHAHRAEIEADIVSMFGPAGDRPDGVVVATSVIEQSLDVDFDVMISELAPVALLFQRLGRVWRHDNPRPAWATEPTLHILDRDGALPYGPAAIYRDSLRELRATRAALAGHGTLIRIPEDVSTLVQQVHNRDLDDLNDLQSQRERRDAGLANIVAIPNPHQLGHLETMTCPDVDDATVAARLGMDTIRLIPAHIGIDGRYYLDPKHEIPYPQGRPPHRFVEAALNASITCPAHWVRDWPTNPDWAGTHLADTVLFPNTCHDGLRLDPELGLVKGNQ

SEQ ID NO: 11696 - protein, 914 aa, Rippkaea orientalis PCC 8802
MSKRYDFGRLFFPESHEDSLSDVILFQPLGNHVSNVRFLVNKWQFPKVSKLSRKRISKSAGLHDIGKPQKFSIKVDFKKGKPQLTYSFSGHRFLAECPNDPWVEKLARGHHDYSVHDICRDTYILKNLINGLDENNPLFKVASSYYQDLSVDSLIYAQELYILEMCDQIEAEIACRFYEDDDQAESRAFMDFNITSDSDNKNIFYIEPWIFEEDKIKLTLATWSMNIPQELKDKIQNSSEEDKQKLTQDLQSSIKNWWKSQPKKLRAKTNKVILKPLLSERLEKFNATQLYQKLKGFTPNPMQEKLINALNPEINPSPSCLLKAPTGSGKLEAILIPSLAYDYKLILVLPTKSLLEDHRQRIDSYLLKFSELPSNQDRDISLVIDTGTKMTRYIYKNGSMRLPENTPRRHLYKGNIILTTLDKFMYRYFSFGDKQKSFIFPYRIHQDNTLICFDEAHSYDDISFTNFCSLIKALYEAGRSLILMTATLSHKHLERFDYLQDDLIDYIDDADNLQKLYKFSQQILKQQFVNQKHFEWIQDVEHNSESPETFHNAFTQRVLNEWQSNSNQRIIATVETVKDAVVIYEKIKSILETNKDSQGRFLFLYHGRISDIPKDSEFSRTNIYQQIKARDEKNQPYILVTTSAIEVGCDLNSTKLITQFCNPENLIQRGGRCNRKGDIKGAKIIVIGKNIPEFANTLSEFELKNYQLVLQNLNNKNFDTKTIMNCVSSKQQVDDYRVVELFSMLHDYVYNADLTCQPSHEKGLVITRSWTPSVTLVYDNGKNRDKMNEMPQITVPINRLVIKKNKETDESNEYNNIDVYEYIYNKEETRWKLEPLKYWGQAYKKDIVIIIKEEHKEASYGTSQPYEYDPELGFVKLPGVFIKWKSIDNEERLQYKTSENKSVVITYIKPLSNN

SEQ ID NO: 11697 - protein, 549 aa, Methanocaldococcus fervens AG86
MIRYYNSILKKLGEIKGFKPKRRPLIERVLKDIESSEKPFFIVKAPTGYGKTTISYTLALYSLYNAERFDKVIHILPMRSIVEDLSMSAKELFDFSRAKMMGVSEEVFHLFPLNFTTIDTFIWDVLKLNTKKFSRIKDGKEFGYDFFTQASILNSMLIFDEAHFILEDDKLKSVFLCVLKFLLENDVPILILTATLSKGYEELFKRYAIPKKYDFKIYELSDENGKSSKSHIFVEDKEFLEREMKKDFKISVFNENSVNNYLKYVEERKRNIVVVNSPKKCVKIYDIALQDSGFDNILLIHGKMTYNHRKKIVEKIRDLKNEKEFLIISTQVIEAGVDISSDIMVTEIAPPNSLIQRFGRVARYNEREGKIIVLKSDGKPYNKEKIEKTWRYLESNVDIHPRFSKTYQEWIDEVHGKRLANAEAKIGKHKKITNILIEKLREFRTRSFEIYEIITKYISEGHAFLRDFLIPVEVENDVVLITPKELFKLCKLEKVDVIEIKKIGNNIVEEKLEVKDEDEAYKVAIAITCGKPIEVKLLNGYDKERGLVL

SEQ ID NO: 11698 - protein, 787 aa, Methanocaldococcus fervens AG86
MILAKREGNAFQTLKGHTYDALRIYKEYLERNFDVVDNFCNRWQIPTEKFIKNTFFTIYLHDIGKITEEFQNNIIKGKRSNKHPHPLYALPIIDSIEFDYLFDIPIEVFAILSHHTQLYNNLYADYQQYKKGTFLIEEIKEFIKNSKDAYESLGFSKFFEFEELKINEIPKDAKPLELHKLRRKYWIETNNYIKSLSFDEKIKLKSIFSFMFAILQLCDDFASLNFSEYAKDKEGTFEDVLENLEIYVPTLDIKNPISLILKGYEPYKFQKELYNSKNKFVILFAPCGRGKTEGALLWALNALKNFKRNKIILAMPTQVTSNAMYDRLIKIFGEENVGLFHGKSFIKLKDSKEIDDEEDLEEIRDENFKGNVFFKPITITTIDHVIYSFVHGFSQADFALGNIQNSVIIFDEVHYYEKYTLEHLLTLFDILKRMDIPHLLMSGTLPSFLMNKLEGYEIVVDEEGLNYKPFKLEYLENHLIWKENGEWKVDGYIINEIIENYKKGVSQAIILNTVERAKEFYKAIKDKVPAILYHSQFAYRDRVKKEDEIFTLEEMRKNQNKPYVIVATQVIEISLDMSVDVMYSELSPPDALGQRAGRLHRKGRNWKENGKEYKLKIFLPYKHLPYSKELVEKTINYIKFYEKPLNYRDIKDFVDNVYKDYNLSIPSDLKLFFDEAILFGRHWTDISTIDEEGRFFKVRDDKFMKIEVVPQVYFDELGEDSLKAEYMAKIPAYLILNEMKNEEGMIHFYPYEKRVGRRTRKYIICSFKYNYEIGFDYKEEEEFEDIL

SEQ ID NO: 11699 - protein, 871 aa, Candidatus Accumulibacter phosphatis clade IIA str. UW-1
MSEEKPLKDSEAFGKLERGADGNVLRSHPLIDHMIDVAACFCRLAGCRSIRRAMERSAGRQLTDQDVTRLAVLAFLHDIGKANSGFQAKRWRDRIPVAWPVRISAGHGPEAFKLFDVPTAAAAVQPLIEQVCSWGTASDPLLIASISHHGRPIKDSPGSSLLFWKTQTGAYDPASVLRAIAESALCLYPLAFESGGEDLPDASAFGHLFAGLVQLADWLGSDTRFFEFSGPGEARAARATDLADRAITTLGLDAEDWRERLIATKQDFARTFGGFPPHPIQAAMGDDTLGPLVILESETGSGKTEAALWRYLQLFRAGEVDSLYFALPTRVAAGQLYKRVQDTLDRLWPENPPLALRALPGYVAADGQEAKALPDFKVLWSDDLNDQAAPHRWAGENAKRFLAAPIAVGTIDQALLGALQVAHAHLRHATLARSLLVVDEVHASDAYMTVLLEQLLKAHLNCGGHAVLLSATLGSRARNRYLALNAESRTSSLLAAMPFADACQVPYPAISDNQSLCAVAGTGQCKCVRWTARDIIDSPEHIVELALAAAAQGAKVLIVRNTVPAAIATVAALEAKVPDRAWLFQINGVVTLHHSRFSRQDRPILDAAIEERLGKNRSSGALIVVGTQTLEQSLDIDADFLITDLCPMDVLLQRIGRLHRHANERPEPYHIAQVVILTPTGNDLTPLLTRPKNGLGRHRNGGGVYDDLRVLEATRRLLADKPVVNIPDDNRYLVEAATHPERLEALQAELGEAWQSLAAKLEGDTSAEKTIGHLHTLDVQQRFGEEEFPTGVQVGTRLGAQDRVVRFDAEQPGPFGEPLKALPIRHHLLPKDLPLDVEPSAVTHHENCTTFRLGEALFRYSRLGLESLKDQ

SEQ ID NO: 11700 - protein, 711 aa, Candidatus Accumulibacter phosphatis clade IIA str. UW-1
MSEEQAAFDRLHPAVQHHIVNSLGWNGLRPTQQAAVAPILDGQHCILLAPTAGGKTEAAIFPVLSRMLSEDWRGLSVLYVCPIRALLNNLEPRLSCYFGLVGRRVGVWHGDISDSIKKRAIKDPPDLLLTTPESLEGMLISANDDKRNLLLGVGLIIVDELHAFCGDDRGWHVRCLIQRVQRLAGRRIQVLGLTATVGNPKFLIDWMLPGQPTTVIGAGHSGIDADLTIDFVGSLENAATVIFKLHAGEKRLVFCDSRAKTEELSAVLRGFGVRTFVSHSSLSADERRQAEKAFAEEPNCVIVATSTLELGIDVGDLDRVIQIDAPGSVASFLQRMGRTGRRKGEMRNCLFLATDDEGLMIASAIVRLWREDFVEPINPPVAPWHLVAQQGIALILQSRGLERASLESQLTDIFFDLDSNKISQIISTMLSRSILWEDEGIGGLIGLGEVGEDEFGRRHFEAIVSTFNSPLLLTVLHGQRELGFVDPMSIRTNDESAPTLILAGRYWRVVTSDWRSRVVYVEPSENRGKASWLGSSRALRLELCQKIKALLIDRKVPAVLSNRAKNRLDNLSSSFAFLEVGKTTAEKTVGANQPEWRWWTFAGGAANFLLAEMMTLSGNKSIGHDNFSIRLTFPPNVAEGMALPVELTQQGEKRIRQIGKDLKFSRCLEDADVAAVIKPRLLDRGGAASITAQAIVASNEYFAPHQSRDAP

SEQ ID NO: 11701 - protein, 804 aa, Leptotrichia buccalis C-1013-b
MKNEFLAKSNGETIMEHTENLINNFKNFFTIYSEINVDKELLLLACIYHDLGKINKKFQSKLSGQKQNGELPHGLLSTSFIDSKSLSENGFDKSDIKVLSYSVALHHERDISEIEEEDFSSEIELMNIEADYFLKYLEKLQNIYFDYVNKNIEENLKYSIFKIENEKVKLKKLSKKYYKLNGRIYSQDFILSEKETFETFQKYVMLKGLLNKIDYAASSYIPVEEKNDFLEEKMDDFLKNVLKKDNPKNDWNELQKFMIHNQNENVVVVAQTGYGKTEAGLLWIGNNKGFFTLPLRVAINSIFNRVKNQIVIEKLENRIGLLHSDFREIYIEDTKKKEKNNLEKMDNDDLFMYIDKTKQLSLPLTVCTIDQLFDFVFRAPGFELKVATLSYSKVVIDEIQMYSTDLLAYLIYGLKYITDFGGKFAIMTATLPGIIIDLLKKEEIEFVTTEPFINDKKRHNIKVLKDTINAEFIKENYKDNKILVVCNTVKKSKQMYENLKNLGIECKELNLLHSRFIKKDRAKKEKEISEFANPKRFKQSVKKERKSKNIFENGIWIGTQVVEASLDLDFDILITELSDLNGLFQRMGRCYRNREILDEKYNCYVFTEECSGIKGSKAVIDKEIHQKSKEALINIDGLLTEKEKLELIDKVYSTESLKDTEYYGKLVKNIYALKNYIVEYEKTKSEVQKIFRNIASRDIIPKIIYQENKEEIEKNIEILQKKTKGLNEKERKNLRSEKIEARREINQFKVAIPEYELDDISPEQVEKMEINDYETLIILDCDYSYEKGFEVKIKNRDFFEDNTF

SEQ ID NO: 11702 - protein, 856 aa, Halomicrobium mukohataei DSM 12286
MGTEPISHPATDGDEATRLLDHLDDVAGRAESVVSADATTIGGDPLPEMTAVVARCHDFGKATTWFQAYVVGERDASDRTNHSLLGAYLGYYVLDRLGYDSEDCLAALVALAKHHGQLPDVEEYVDGVSRFENTSEASNERQRILIEQVGNVDDHRRQFAQSFVADATDGNGSWEEFAQSIEDESLFDTVHEHVSLFGFGSDRSAPSEEFYGLLLQLWSGLVFADKTVAAGIENGDLDGSEPDARLLSEYIADLGGDTDEDGQAAALDTLRGEARDDVLGGVERFRDSEVSIATLTLPTGMGKTLTGLSAALALRDEGERVVYALPFTSVIDQVADELADVFDTDARDDLLTIHHHLAETVTKLGDPDEDPDEYARLAEMVAESWRSGMTLTTFVQLFESLVGPSNTQSMKLPALYDSVIVLDEPQALPMQWWKLVRRIATILTEEYDATIVAMTATQPRATDEETASQALFDDAFELVDDVDRYFGHFERVEYDVHDSVLAFDDTDAIVDYETAGRTILDETGRSESTLAICNTIDSATALTDAIEEREAVVDVGRCLELELDDGADVDALVERVESTLSSNERALVHLSTRLRPRDRLALVEATKRLTERDVPVLAVSTQLIEAGVDISFDRVYRDIAPIDSVVQAAGRCNRSFESDLGTVTVWWLAPPAGTTTTPAQAVYDSEGVSTISLTARTLDAIGADDGTVAEQTMTRDAVEHYYGLVADRNPGDPEYVKWVDEANADALGGLSLIGQRESVDVVVCRTDGDRELADAMVAALDEFDYDAFGDYREAAKDITVSLPIYSRDSTEAETVRNLEPLGDADLRVLRRARGTSYFDETKGLAVDEPCVDDRFL

SEQ ID NO: 11703 - protein, 1120 aa, Atopobium parvulum DSM 20469
MPGIEKSTRWSVLTQDVYLESLFEKELHVTPLVARVLVARGFTDVAEAQEFLSPSLQRDWLDPQCIPGMAEVANRVQKAIVEQQKIAVFGDFDVDGMSSTCLLTLALRRLGADVLPYIPHRFGEGYGLSKEALARVLLDRKPDLIITVDNGIAAAQEVAWLLEQGIDVVITDHHEPADLVPQGVPVTDPKLIEDCPSRELAGAGVALKLVQVLGQLQNQPQLWLDYIDVAMLGTLSDMMMLNKENRALVSEGVKRLQKGLRPGLVALAAVAGQDIAQISADNLPFSIIPRLNAAGRMGTTDIALDLLLTEDAEEATILAGKLEEINAERRAIEAKLTDEALEQAKEIYDGGHAIVLAKEGWHEGVKGIVASRIVNRYHVPCILFTIQDGVARGSGRSVGSVDLFHAVEQCADLTVRFGGHQGAVGVTVETSKIDAFRKRLSEVMAELPEEEFESSGEVTALVNLDEITINSIDALEALQPFGQGNKKPLFGVKGVVMKNRSRVGAGGAHLCFMASNGISSISSIMFRTPHVEAAAEYDGAVDLIFEAVNETWQGRTKPKLMVRDILYRDFTDEDDGPIEADLLGSAVDLPLVVTKEATETEEASQEQSQQKRHELESLPYEELTQTLVTSMIGSRELLPLQKKTLEVLSQGESCLSVMATGRGKSLIFQVYAACVALLQHKMSVFVYPLRALINDQVQSMKNTFEPLGISVEVLNGETDLTSREDLFARMANNELDIVLTTPEFFSLHADQFAAAHNISFVVFDEAHHVGMNASEGRLAYAQMPQVLKMLGNPQVLATTATATTQVAQRICELLSIDADHVYKDKTARTNLELKDLRSAKDRECALLSLVSDGTKTVVYVNSREQAQALTRMLRHRIPEIGHKVAFYHAGLTPQIRKNVERAFRRGDVCCIIATSAFGEGVNISDIRQVILYHLPFGRVAFNQMSGRAGRDGKPSKIYMLFDAHDMRVNERILSSRAPQREALVAVYRALTALQPKLVAQPTNPALTDEDIAQMALEIDPRSKADEQIVRVALDVFVELGFISIEGFDQTRVISVNSQASHMDLLESARYAEGLKAHTEFESFAQWVFSASLDELADAITKPIVPEIGPIFDGGRESSNE

SEQ ID NO: 11704 - protein, 732 aa, Eggerthella lenta DSM 2243
MHVSHVAEDGRIEEVADHLREVAEMAAEFARPFGAESWAYAAGMAHDIGKYSTEFQNRILCDGHKVDHSTAGAALLDQLGLKLLAYCVAGHHAGLPDGGTTADVEDCPTLRGRLLRAQHGSIPDCAAYAREVELNVPKGPSVLPVSRDREDGAYSLSFLTRMVFSCLVDADFLCTERFMQGEGRDPLSEQSLVDLLGCLKEEVARFYPPTSALNETRCQVLDACIRAASNHPGFFSLTVPTGGGKTYASLLFALEHAVKRDARRVVYAVPYTSIIEQNARVFRDVLGERSVLEHHANFDFDFDEEVESYKSGDAKKALRRASENWDAPIVVTTNVQFFESLYANRTSRCRKLHNIANSVIVLDEAQMVPTKQLLPCLRALIELVANYGCSVVLCTATQPAFNGMLGRKGFAVREIAPAPSELFKKLKRVSYRFDGVLGDDDLAARLADRDQSLCIVNSRKQARRLHELLDGEDSYHLTTLMHPVHRERVLNEIRQRLREGRTCRVVATSLIEAGVDVDFPVVYRALAGVDSMVQAAGRCNREGRQSAEESIVHVFEPADDYALPSDVAQKVAIARSVISEMEGAACESCDIGALEAIDAYFARLYAVREGALDASGVLRDLEGFSLKSLNIPFKRAADDFRMIEEGSRTVVIPDPEIESDILAVKTGFANRSTIRRLSRYAVGVYDGDIKALLRSGKIETLAEDLFVLVDGTCYSDQRGLDLKNEEGKGIFL

SEQ ID NO: 11705 - protein, 801 aa, Desulfofarcimen acetoxidans DSM 771
MRCAHINPSIAKEQSVKEHLYSVAELAKEFSSKISLAATGELMGMLHDMGKGTRKFDAYIRYCAQNPQDKSLKGQVNHSTAGAKLIYDSFYNTADRLQKFTAQLISLAVCSHHGGLIDCLDLRGRDKYTERMKPDEDILYDEALNYFRSECLETNQLKDLFAKAAEEIKAVITHINQLNSSAGQCWFAYGVLEKYLFSCLIDADRYDTYLFMENKARKEKVNKYALWAELAGILEAKLSSYPQESKINGLRAEISLACRNFARNGSGVYQLAVPTGSGKTLSSLRYALNHAQECDKDRIFYIIPYTTIIDQNAREIKNILGHEEMILEHHSNLIVADDEEEVVNYKLLTERWDSPIILTTMVQFLNTLFNGGTQDVRRLHHLANSVIIFDEIQAIPIKCISMFNSALSFLAGVCQATIILCTATQPLLETTEIPLKLSENPNIISDVYEKFRQFKRVDVIPKLVTGGYSAAALKDFILDRMDQFNSLLVVLNTKNSAREVFNELKAANQGLPEEKQCQVFHLSTNMCPAHRLKALQAMKEQLGCGKVICVSTQLIEAGVNISFECLVRSLAGLDSIAQAAGRCNRHGEKERGDVYIVNLEREDVSKLVDIKKGQECTERVLRDFEDNPESFDRDLLSPQAMARYYKYYFYERRTQMNYNLKGDNRGKSLYEVLAGNKEAAEAFHSRNGRPADLMLKQAFKTAGQEFQAIDENTTGILAPYEEGRDLITLINGECSLGELKRYLKKAQHYSVNLYETDRRKLEQMKGLVWLKDKTILALREGFYDEQMGVNLDRKPLDFCGV

SEQ ID NO: 11706 - protein, 762 aa, Desulfofarcimen acetoxidans DSM 771
MFDLLAKKAPGRNTYQTLTGHTIDDIKVLACYINENKSSLQRFARDFTIDYEELCNIIFLALFFHDLGKATQEYQKNIITGQVNLNVSHPFFAMPFTQTNLPKESELLLRCLVLSHHNQLYDYIYRRVPIKPRVNYHFEQITAFIESYAEIYRQYLENMFKLRYHPISEYPAYIYSNNQRDHIFSLITSTRYDIDNLEDKVKFKAIYCYLLSIMKYCDQQSSKAFSQNCLQPETIYDQVFDPGNLAGSAQILKNTLPPVVSLKACCDELTTGQFNLFLAPINRNRRELVVQQALMLANREHRSRIIYVLPYQLASEPIFEWLKDIFGSANVGLIHTMSYYVKEQLIPNELKQKGDQGRDTARNLRYGDRIFDKQVTVTTIDHLVYTMVHGYKQSDFALGKLLNSVIIFEGFNPNSCSSQRYLLDCIKLLWKMKIPCLGATSFVPGQFQNYIYQNHNCRIFDLHNSDQKFQCKITEKTLEGNKDEYIRLYHQGKKQLIFCDNIFQAQRLFLKLKKLLFNSNVYLCHSVYSSHDRYYSPTSKHKQISKLDKLPGPWVIVATQAILAYTFDINCDTVHTGTKSLECLLHRINTLYQPGRGTDQTAYIYPGQQGINQETDWDELHDRCFSFSQITQLYYQNKFSTESSSATNLAKVFNYCTLFGYSPQEVRQAAGNRKQIQMWNEKQYKMDVIPECVWDPYLHKNPEMADSLYIKLPYYWYIKYPQYFYHDDGFFKSFMICKLSYNSEMGLDLRKIQKEDNDALWV

SEQ ID NO: 11707 - protein, 836 aa, Desulfofarcimen acetoxidans DSM 771
MPYWAHYDQEKEIKQTLKEHLSSVAAMARDRVSPGVQFKDIPSSIVKELAYWMGYFHDLGKYTDYFQDYLTKNKKSKFKEHAHISACCVYSFLLDRVIDFSDDWQKKITAFLIYLCSRKHHGTLSLEGLFSISREKEIWKLLQAAEYNLLEKLPVILQDAGLSDRISGVELKKYLSVDVLIKSKSLARTGQYLNSGRGEDERWFFLAIYLFSLLIDSDKLDSGGLKPGEVKSCPSDQVSKYLNKKLEQLKDKRNVSLWERRNNARKTMLGIIEGLSDEEIKGTGFFTITAPTGIGKTLSSLQCALCLQERIKVLEKYTPRIIAAIPFINIIEQNKKEYEQVFGKELKLIVHHRLGDFSVQASSREEISVDQALLEVESWEGDVILTTFVQLFQSIITGNNRLLKKFNKLACSIVILDEAQAVPEYYMPLIGAVLQKMTEFLGTRFILMTATQPKILEFGNLLLGSSGGKAKAVPLLPDFEGYFEKLTRTKFVSLLKKNRLDTGAFLELFQEKWDGKKSVLIVVNTIKRSIEVYREIKKLLKDQACNIPVCYLSTNIMPRQRREVIKNVKDKLENKETVILVSTQTIEAGVDLDFDMAFRDFAPIDSLIQTAGRVNREGRKGEYLPVYIVQLESDNHYVYELTHRHSTMKLLQAADEIKEPQYGRLADEYYTLALARGISDRSKELWQEGIMKLNFEKLKEFQLIQNTGEVVDVFVEDCLKATQLANAYEELLRYKEYDLSCESGALSKVIDKGVIPNCNGKLSVFERKAILRLILAKVSDFIIQVRVSRLKENRPVEFRVRGDVESSMYWIPPGQKKEYYDDETGFISETGEAFIL

SEQ ID NO: 11708 - protein, 746 aa, Zymomonas mobilis subsp. mobilis NCIMB 11163
MTIYYAHSGDRLDKSDWQTMLDHAFSTARLAAKMADPFGLQKAAFVAGLFHDIGKYSTKFQQRLEGKNIAVDHSTAGAIQLLNITNGHDKGMAELISYAILGHHTGLPDRSNETNACYNRRILQPSQLDTVWEKDISPEISGLSPEMVKQFSGGLKEIAFSYAFMGRMIFSCLVDADFKDTEAFYARIGQISPDREWPQLNEVIDLFITRFEKYMAGLPKKGEINQLRANILSYVRQGAKRGAGLFTLTVPTGGGKTLASLGFALDHAKQHGHRRIIYAIPFTSIIDQTSAIFRSVLGDEYVLEHHAAMDAEISGAANTEQKNKLKLATEDWIAPVVVTTTVQLFESLFSARSSRARKLHHIAGSIIILDEAQTLPRHLLLPIMRVIDELASHYGCTIVLCTATQPMLGRRIGFEKGLLIEGRELAPDPLHLAGKLARTQIKYGGIMDNAALVEALRINSQILIVVNSRRHALELYNLAKEAGISGLVHLTTRHYAVDRRRILTDIRNRLETGEHCRLISTSLIEAGVDVDFPVGFRAEAGLDQIIQTAGRVNREGKRKKEDSLVTVFSCPDYAPPREIKDLIGDMGRIIGNHDNIASPMAVEDYFREVYWRLADGLDEKKILDRFILSKNTTDFAYRKVSTDFRMIENGMAPVIIAIEDRAKKAVEMLRVKDIPSSKIARELQGYIVQIPPKDRDALIRNGQARFEEPELRGDQFAVLQKNDFYQDDVGLIWENYDHLSVDDMII

SEQ ID NO: 11709 - protein, 821 aa, Ammonifex degensii KC4
MAFFAHCDREGERIKRRYRLDAHLALVAAESYTSLARLPRYQNLLPLAATVGLAHDFGKYTSYFQDYLLTQRINPYKEHAFISGLWATYLAARQGAGPLEQLAAFMAVLWHHRDLDNLDRYLASRREMEDITSLDPDKYRRLEVVEKQVEDLRQNIEKVGASLASAARHLARLLTRRGLTPPPFLTQDWCQCLEEFLGSWQEVYISLYRHWRKFERQEPSLSPYFNVVLLFSALIDADKRHSARVREVKRPELPSNLVYIYKERKFAGGVPFGINALRGKIFRHAAERMACAPLSQRFFTLTAPTGSGKTLTVINAALILRRRLQEAYGFSPRIIYALPFTSIIDQTYQVLYELMEETLPGFASAPSVYLLKHHHLAEISYKDPEDEDPRRFDEAMLLIESWQSEVVVTTFVQLLHTFIGYRNRMLKKFCHLGRSIIIMDEVQNIPVEYWPLVTEVLKRAAEELDLRLILMTATRPEWFEPGEALELAGEPEDIERYFKMLDRVRLLVEPGQYRVAEAAELFARRYDPSRSHLVVLNTIRNSVDFYHYLKDLLPEGTPLYYLSTNIVPAEREKRIEALRTALHRGEKPVLVSTQVVEAGVDLDFDVAWRDIGPVDAVVQVAGRCNRNFKRDKGDVYLLNLVDEQGHFPAVRVYGAIHIKGAREFFSGRPEFPEAEFHSLVENFFSFVRARKDPSASGTILKAMKELRFKGDGEEKGVAGFQLIKDLPNHIEVFVALDSKAEEVWEAYQQEVVNAPDRRSRWEAFYRIKRDFSRYIISVPVRSLAGKVDTSKALPYIPPYLVEELYDPETGFKRVDEGAVII

SEQ ID NO: 11710 - protein, 768 aa, Aggregatibacter actinomycetemcomitans D11S-1
MSEVIAHARQDSKWHFHPLQNHLKKVAKLARRFAGRYGALFAEYAGLLHDLGKFQEAFQEYIRRVTGFERENAHLEDIESSKPHKIPHSTAGAKYATQNLDPFLGHLLAYLIAGHHAGLADWYDKGSLKYRLAQADDELAESLAGLEKSGLVEDFLSLSGDALEEDLLNVWESGINLEELHIWMRFLFSCLVDADFLDTEAFMNGFVDADAAQQAGFRPNFPDLEDMHSRYEKHMLDLAEKSDKHSVLNQERSAILAQCFSAAESDRTLFSLTVPTGGGKTLASLGFALKHALKFGKKRIIYAIPFTSIIEQNADVFRKALGDDAVLEHHSNLEVKEDKETAKTRLAAENWDAPLIVTTNVQLFESLFAARTSRCRKIHNIADSVIILDEVQQLPRDFQKPITDMMRILACDYGVTFVLCTATQPELGKNIDAFGRTVLEGLPDVREIVADKIALSERLRRVRIKMPPPNDETQSWQEIADEIAERPCVLAVVNTRKHARRLFAALPSNGIKLHLSANMCATHRSEVIALVRRYLELYREGRLKKPLWVVSTQLIEAGVDLDFPCVYRAMAGLDSIAQAAGRCNREGKLPDLGEVIVFRAEQGAPSGSLKQGQDITEEMLKAGLLADPLSPLAFAEYFRRFNSKGDLDKHKITELLTAEFSNDNPLAIKFRTAAERFRLIDNQGVALIVPFIPLIHENGDKSPKIVQANELDDFFRRHLDGVVESDWQKTLDDYRYPSPPDNHFGQTDKPSSAFSSSLKWQGNSRQPK

SEQ ID NO: 11711 - protein, 548 aa, Saccharolobus solfataricus 98/2
MRKGIQKVLDILNCRDNSIYYECEDVNFILTFPTGYGKTTLSLEIVRMIDLKPTQNFSRLIHVVPTRSLAKDIQNSACERGLGFAVQYSFTPSHIKSPLFLAKFIITTYDSFLLNLYKASIGEPFSYHGHYDLPRFGIYTSLVHFDEFHLMNEGNSWTSLLGAVRHLSKVGVNMILSSATPSKSVEEELIRMMENRKVVRLAVVNEYGESVKNRNCVKVSEGYYECEVGSVKYTSVEVEDKINAPDININFLDKEDDVLGVVRRNKDKKIMVIVNTVDKAITLYEKLRDLSPCLIHSRFKIGDRDEKLRKECNIIIATQVIEVGVNISSEVMITEQAPITSIVQRVGRLLRDNKKDKGELYIWKSGNYYPYDKDEVENTIKELESKKNDISLKVPSSYGEIVDRVIKPPRGDPDLLRELDNIAENLFATREDLEKLLDKYCTLTNSYVINVAYDTPASERDLIPLDGDLALKIAIKGNDCVYAYVEEYKPERKVAVDKVNVRETCVEIAKPCRDYRKVFYDGDKRYIIYALKIDKELYDEETGLRLRK

SEQ ID NO: 11712 - protein, 753 aa, Halothiobacillus neapolitanus c2
MEKIQHIAHAKQDLDGNWNAPHDLVDHLNCVAMRAADHARPFGGQEWAHLAGLWHDLGKFRPRFQQYIRKASGFDFNADASIKGEAGKAPHSTAGALLACDRFKESGRVLAYLIAGHHAGLYDWHSESSSLEYRLQQVDSREELDQALAENPPAEIIKHRTFTPDMRTIPGGKDGFALWVRMLFSCLVDADFLDTESYMDMDKSAQRGDWQGMQKLLEQFDKFMARKTFAAEPTPVNQLRTDILRQCREKSHEPPGLFSLTVPTGGGKTLSSMAFALEHAKRNNKRRIIYVIPYTSIIEQTADIFRDIFGEAVIEHHSNAEVDANKENSRSRLACENWDASIVVTTNVQFFESLFAAKTSRCRKLHNIVDSVVVMDEAQLIPAEFLQPILDVLNLLTLHYGVTVVLSTATQPALATREYFDAKNNMRGLENVREIMDDPDALYAQLERVNVRLPTDWNTPTSWDTLANEIKQHNSVLTIVNRRNDAHELWDLMPEGTLHLSALMCGEHRSQVIKQIRARLKERVPTRVISTQLVEAGVDVDFPVVYRALAGLDSIAQAAGRCNREGKLERGEVVVFVPPKPAPPGLLRKGEDACRSVLHNRTGKPLERDLFARYFEKLYHACDLDAQNITKLLEVDGQTLAVNFRTAADKFKLIKDEDSAPVIVRYRGVDGNDDKVDELLNTLRKHGSERWLMRKLQRYTVTIHRREIIKLLSQGDVEEILPGLYIQISDWLYHPILGLNPNGAPAKLTNFIV

SEQ ID NO: 11713 - protein, 791 aa, Rhodothermus marinus DSM 4252
MEAEGLLAKSAARGGESLPAHTRQVVARLRQLRERMPDLEEKLELPGLWDALFAAAWVHDFGKAARGFQEMLQSGEKWNYRHEVLSLAFLDWLLPADDPRYPLAVAAVAAHHRDYPVLARQYIEVEDPADSGIDERWQEMDQKRLEALAHWTAEEWPGIVSAERLNVQAPSLHVLLNDVPVLLGDGPDRIRKALACYRRYFGSQRQPARRERRYAWQRRRQALFVRGLMLQADRLASAQAPPLKAPDLDGVEKALPSDRSYWYPHQQKATEHVGSLLLAAPTGSGKTEAALLWARRQLQEGRRGAVCYLLPYQASLNAMYRRFVDKYGLNRKDVALLHSRAVQAVYRELVRGEVTEHAVAYQQAQRFKALGRLHQQPVLLATPYQLLRAAFRLPGYEGQWAMLQGAHLIVDEIHGYEPFRLGLLLGLFSMLQQHFDVRLAVMTATMPSWLRGLLERELKVVWRSADSQLYERFCRHRLFLKEGKLENERVLEEIVQRVHQGEAVLVVTNLVAAAQQLAEALAVRLNSPWPQRCDPEHDPVLLVHSRFTAEDRLQREAVLQARVHRQLRQGGFVVVATQVVEVSLDVDFDTIYTDPAPLEALVQRFGRVNRRRCFKERPVFVMTEAMDWTWPYRQEALMRRTVEHLTRFDGQMIDEAMIGVWLDAVYEPEVPSLQQEVARGRSSYETVAGPEHLVAFESDPNLEDQFDALFDGYEVLPLQLQQEFLRRAERGEYVEAYGLLVPISQGRFHALRQQNALTRLQEYRVWVADCKYDPCLGLQPDIRNETASFML

SEQ ID NO: 11714 - protein, 933 aa, Thermomonospora curvata DSM 43183
MWGKRDGLPGPYPVVCHLIDTAAIAGALWDVWTAGLGVLRADVLGERVAAHMRSLVCFWAGLHDIGKVSPSFQVLVGDLYQKLVTEASEYEQDEAISGLRHNEVTQWVLVEIFRALGYPAADSARRDVGHQIAQLLGGHHGRFCAAMRRPELRAPRSRPGVGRGVWEEQCRAHAAVLRELTGAREVLRERLPVPVAVVVLGIVIVADWLASQESFIVARMPGEGWEASPEELRAHWERAVADAPQVVRDAGLGRGLLEDRTFRELFGFDEPNPLQASVMKELPELVNGPGLVLCTAPPGDGKTEAALYAAGVLARACGANGLGFCLPTMATTDAMHKRVSRFARRALREDAALTKVHSMAWLSSDAAGDAAAGAAGGDAVITDAEASTEAAQWLHAGRRGLLAPLTTFTIDQGLTGVLPVKYNVLRLMAMAGKVVVIDEAHSYDAWMHALLLRWLEWLGALRAPVILLSATLTGAAARSLVEAYLRGAGHTVPQELRPCYPGWLFADAVTGTVHPPREVTSERERAVAFEMVPVRRGKDPSRPGHRLAVIKDLLAQVVNGDRGCVLVCCTTVPEAQDTYRYLADWFRRVAEEGGRPPELRLLHSRYRARDRAAITEACERDFGKEGGRPRTVLVATQIVEQSLDLDFDLLITDLAPMALLLQRSGRCQRHRDGRIDLHRERRPDWAGAAPRVIVLNPVDDQGEFAVPEEWGGVYDESLLHRTSRLLHARGAEPVQIPGDVQALVDAVYAEDFTSVVALDEANARRIVRADGERLGGEAAQRQTADLVMICSPRDGKLRDLRNLSEAQAKVSSAWLTTRLGADSERLVCVYEQSPGVWTLDETGRIPVPGMEGRSRVTRDQARLIAEYMIPVPGRYCGEEAELLEPPPSWDKNAVLRDWKLLPMRRASDGGWYGRLRPGQVTYQANVGLQMLYP

SEQ ID NO: 11715 - protein, 694 aa, Thermomonospora curvata DSM 43183
MTKLHPTLAYHLSATLGWQQLRPLQEEFLKSFSPDCDALLVAPTAGGKTEAALFPLLTVMAEQGWQGLSVLYICPLKALLNNLEPRIAQYAGWLGRTVRLWHGDTSVTRRQAILRNPPDILLTTPESLESMLISASVDHRRLLSGVRSVVIDEVHAFAKDDRGWHLLCVLERIARLTGRPLQRIGLSATVGDPSGLLAWLQGAGRRPAQVVEPAIESAVGPPEIELDRVGNLANAAKIISMLHHGEKRLVFCDSRQTVEELGEALRKLGVTVFLSHASLSANERRRAEEAFSQARDCVIVATSTLELGIDVGDLDRVIQINSPWSVSSFLQRLGRTGRRPGQVRNCLLLTLSEEDTLTAAGLLLLWSTGYVEPSLPPPNPRHIVAQQVLALALQEGAIGDALWRDWWNGHWLFDPAATQPIMQHLLAKGYLRRDGHNLLIGEKAEQDFGRRHFMELMASFTAPPEFTVLQGGKEIGRCDPMLLTRAVQGPRLLLLAGRTWQVDWIDWKRRRCHVLPIEGTGGIARWSTTSSFAMSFALARAIRQVVLGEDPPVRLTHRAARALATARAELADVAAPDRTIVVRSGHDVLWWTWAGTRVNATLKASLGSLADPCARPDDLYIRLRNDLDAVTWREVGRSLHRLADPEVDSRAVHGLKFSAALPSDLAASTLAARLADRDNAWKVLNEPCIFSQSA

SEQ ID NO: 11716 - protein, 965 aa, Thermomonospora curvata DSM 43183
MIEGEEPGRLGEGLSAVARAVWAKHDRAAEGWLPLWRHMADSGAVAGLLWDEWIPHQVRRLISAELPGGAEDARRLVVWLATTHDIGKATPAFACQVEALAAAMRDAGLGMPGHREMIDRGLAPHGLAGQFLLQEWLIERHGWNRSAALQLAVIAGGHHGVPPAYQNVHDLNARRYLLRTPDRESAWRSVQEELLDACAAACGVRDRLDDWRRVKLSQPAQVLLTGLVIVADWIASNPDLFPYFPEAAHISDRERIEAAWRGLALPAPWRAVEPDEDTDELFAARFALPLGARVRPVQEQAVKLARGMAAPGLMIIEAPMGEGKTEAALAVAEIFAARSGAGGCYVALPTMATGNAMFPRLLEWLRRLPAGGSGETHSVYLAHSKAALNEKYVELMRTGRRTVSAVELDGPGDERRHHGDRRVHSAELVAHHWLRGRKKAMLASFGVGTIDQLLFMGLKSRHVALRHLALAGKVVIIDEAHAYDTYMNTYLDRVLSWLGAYRVPVIVLSATLPAGRRRELLEAYAGTSGSGLTEVERAEGYPLLTAAAPGRSPVLQPVAPSGRCTAVHMERLEDDLDVLADRLEEELSDGGCALVVRNTVDRVLQTAAHLRKRFGNVTVAHARFLDLDRMAKDAELLKLFGPPGKDTKRPKEAHIVVASQVAEQSLDIDFDLLVTDLCPIDLLLQRMGRVHRHLRGEGQSERPPRLRTARCLVTGADWAAVPVEPVSGSRRIYRPYPLLRAAAVLEPYLSGSAETGHIVRLPEDISPLVQKAYGHDPAGPAEWQKALEEARRDQELHQEKQRKEAESFQLGKVGKDGRALIGWLDAGVGDADDTRAGRAQVRDGEESLEVLVVQRLADGTVRTVPWLTEGRGGLELPTETAPEPRLARIVAACGLRLPFQFSTPEVLDRAIEELEAECIPAWQSKECHWLAGELILFLDENCRTRLAGYDLHYTPTDGLEVTRAE

SEQ ID NO: 11717 - protein, 737 aa, Sulfurospirillum deleyianum DSM 6946
MEIVAKKSNERYQTLEEHTQWVVEEALNQIDPQILHKVSTCTGWSEQKIRDLIFFSAYFHDIGKATVEFQETINNGKKSYHPLYGASLLLHIKDFVYKDIGENNLLFSIVLSHHSLFPKQYDSANYNFTFLPQYSVLLKNYSSLYEKTFNEVCPYLFEFKEIKRELYQKYVDISEKRLADIQSCFKFRVLYSYVSGILNLADWLASARFTQTKPTTTFLTLPTKENFVTHLTFDELRPFQEELSSLDKSVLVEIPTGEGKTEGSLLWAIYNLYNQNTKIIYTLPTQTTSNKLYDRIQNFFDKEECGLIHSTAKIFLEKAYEKENGIVDDVFQSDFLISKSFNKPITVSTIDSLLKYFINIGRFNIATKNFLNSVIIIDEVHAYDFKLMGFLKRFLELCQEYDVRVCLMSASIPNQLKKLLGIDTYPLVTQKDLFAKKANEIIKKEMFLDDDLESMMQKFHEKKNVLIIRNTVKSAFQIYNELQTLGIKSDDMILYHSTFKKRDRATKEDLIFEKLNSKKPFILIATQIVEISLDIDFDVMFTDNAPIDALIQRFGRVNRKKSIERKGEIFIYQNKNIRPYTNESLLDLTFQTIQNGYYELGQYVEWLNIVYDKLFEDDTQLKNVKIRLFDPACLKYDATIKQLHGIEKSSDNYDLRDIEQPKNDYLLYDDYMNEEIKAKDYFEYSISLPLYYEGKNKENIHPIDDEKLYYKVLKLDYTLDEGITLDVDNQGMKELGA

SEQ ID NO: 11718 - protein, 858 aa, Thermobaculum terrenum ATCC BAA-798
MKFIARPAETRGGREYPEELLADHLRVVAEAARGYLVGPWPDSERLSELAWVAGATHDFGKYTTFFQEKLPPLEKPPPKPEYTHHAPVSALLGAYVCRQRWHSDREAALLVFLAIWRHHGALVCPSMILPGKQQLRDSPFYKRMIGGIKAEYEAIAAQIANMQGEHKGQIISEMSALGVPEVEGFLSGDVVPGLMRDLYEAYMDLFFASEDPGAMRTYWHALLLFSALIDADKHISSRVGTRDAPRYDIPYELVERYVQRMQREHQSVARAELLEIRDGVFQESTRFFEETPVEELFPGLFSLTAPTGSGKTLAALGAALKLRERVRNTKGWTPRIIYALPFTNIIDQNHDVIQKVLSELPGYSSDPLGYLIKHHHLATIQGSKGSEEDVPTEEQLLMVESWDSEVVVTTFVQLFESMVTNSNRRLKKLHNVAGSIIILDEIQSIPYEQWSLVHETITTLAQHLGCTVIQMTATRPRILPEAREVLPQPDKYFGLLDRTQIVPRADVRSLEDLQDLVLELGERYHSVLVILNTIPSAVSFYQQLTSLDGIEGYREPSELDRSKDDWDRYWDDYSPKGRMLVHLSTNVVPWQRRHRVVGLARILRRRKEELRPIVVSTQVVEAGVDLDFDVVVRDHAPLDSIVQAAGRCNRSWAADDQRPVYVVGLRDERERHLAERIYGKVLTRKMEEVLSSPKDEPELYADIEQYFALLPDLLTDDEYRAYIWAMRKLNFRGKEGEVSISQYRHIEEAGEAYPVIVELGEIGRRALKRLLEAREAYARVSAASVDEKFRARTQLRNAYSCLGEFIITPYSYRLLANRPPRHSELEDHFYISTDDLAEYYDLETGFRLDKMGDEAVML

SEQ ID NO: 11719 - protein, 847 aa, Bifidobacterium dentium Bd1
MYDERILQKLCYTEDSNSVHCRSKEHRMNSKQLLARKDATGAVQTLRDHLHGAGKLARDFEEEFSAISYTAALLHDLGKASEDFQEYLLSAKGHRGSVIHAWQGAFLVDDACALSSEKSAAEQAVQEITREILELAIAKHHGELPDCLDVDGFSTFFDGLATDRKNEIRFSYQEVKDRISYLDLDIAGNYDKSIRDVEHFMQKFNMGGITNSDSFYFYLGLFAKYVYSRLIDADRLDAACFEERRTYRSKSIDWSSLIDRFEKNIRKFDHTSEINKIRNQISEQCRLEGKRSTGIYRLAVPTGGGKTLASLNFALHHAIETNKRRIIYVIPYLSITSQTVKVFREILELDEDDTETLLEHYSSAGGRKDDDTFTNTQSEFDQEEDDEQNAKRKLATERWDSQIIVTTMVRFLETVMSSKSGDLRRFHNMADSIIIFDEIQSLPTNAINLFNEVVSFLSKILGSTIVLCSATQPLLERTSRKNLLLADCPNLIDDSQEYFEKLRRTCVVAATEMKNCDELAEIIYEKAKENGNCLAIVNLKSEARIIYQCLKTLNGDNHFKIIHLSTSMCGQHRTDKLELVRQLTSIDKGKPVICISTQLIEAGVDVSFSCVIRAMAGLDSILQAAGRCNRNGESKSPKKVYVFGIKDEKGLSYLPDIKMGKEITERMVREHPDEDLLSNEMLLEYYQLFFEGIQSGNDNGFGIMDYPIPGKQNLYAYDLLSCNRAARGQYVNSSGTQYLKVYAQAFKTVGNRFRVIPNQNHNVVVPYGRVEKHMERLSRGNLREQFAALRQLQDYSVSLFDNEYRSLDERGAITLENEDFGIYMLNKDYYKEEYGVVTETEMSLLYI

SEQ ID NO: 11720 - protein, 762 aa, Spirosoma linguale DSM 74
MAMLDHLLAKTENRESLGKHTDLVLKAWLQLRDRYATVLGEDEQFWFDSFIAALFHDFGKASVNFQNMLLAILKEPIAEKGYDPMRHEFLSGLLLAAHTILVTRSRKDLSANPAQLFAVFTHHKDFTPDLFCQDAIKQWKIKPNDAGAFFAYARQRIQEHYPDKGDFLNGIEAAWEFMANKPASLLLSVKDRAITEPTLARLKEQREYSYRKTYLLHKALLVIADWTASGHRNLEEPLRYDEELIRRKVAERVQKAGGTFTGFREFQDKSGQIAGNVLAIAPTGSGKTEASLLWASQREGFEKIVYLLPTRVTANSLYLRLGEYFGKASDGVDDYTAVVHSSAKLFRLELDETYSNFNYLREAAFFKAVTVATVDQMLTQGFNLGWWEMKTFHLFRAKVIIDEVHAYAPYTLGLIVASIRYLRQNFQTQFYIMTATMPQKLQALLTRELGNDVTVLRDQELLDKKRNVFHVEDRTIDQLRPDIEQDLKAGKKVLVVVNTVDEAIRLYDQYADYKPICYHSRFIVKHRTEKEQAILNNEKEKPKEGFLLIATQVVEVSLDIDYQSLYTENAPIDAIIQRAGRINRKRRDEPGKVVVFPHSEVAEKHVYDYPAGILNTTLDVLKQHQGVAVSEQDLLNMVEEVYKDWNVENEELYKDELSKYERLVRDKCSYLYDFSEDMEQVFTREGLDTVSIIPDCFKPELVSASVLEKSKHEVAIRNHRFKSGKHTSDKDHSWFKYFDCDYDFERGLRFKKKADIPHTYNH

SEQ ID NO: 11721 - protein, 728 aa, Acidaminococcus fermentans DSM 20731
MTNSLAKTIYLAHLDPEGKRAPQLLLDHLRQVSRLAEEFAPTPEMKEAARQCGLLHDVGKYSADFQNYLLGKKHGRVDHSTAGAQLLAGNGNLISSMEAFCIAGHHAGLSDLGSPTDLPGENTFSARVKKKVPDCSAWKQELEAPKPVQRIEQAISDFQSQGQMDFIGCGLWLRMLYSCLVDGDFLDTEAYMQGGAVQRGGFASLEQLHERFFSALEEKGFFHPQNALNRKRCEILQRCIQKGKDKEDRIYTLTVPTGGGKTISAFAWALEKARTCGKRHIIYVIPYTSIIEQTADILRSYLGEENVIEHHSQVEYEDKDEKMDPRRLATENWDAPVIVTTNVQFFESLFANRSSRCRKLHNVANSILLFDEAQMFPVEYMIPVLRSLEALVRHFSCSALLCSATQPRLDQFLQGKPQELMEDIPGLYDFFKRTQLVNEGLLSYDQVAEALDAQPQSLCICLTKGEAREIASRIRGEYLYLSTNLCPAHRQQVIHAMKEKLKRGEPCRVVSTSIISVGVDIDFPVVYVEENGVDALIQGAGRCNREGKRKAEDSLVHIFATENSRKSHFLEQERQSTHMVEQKFPDLAAPEAIAKYFDWLYHAKDAILDKKKIVELSGNGKYATIGQQFKLIEDHTKNVLIPWNKEAQEIIQQLQYGIRTRQLLRKAGRYMVSVWSQNGPQPGLYEQMLADGVTEALDEQMAVLRDLSVYKEATGLTYQAEEGRGLFS

SEQ ID NO: 11722 - protein, 507 aa, Sulfolobus islandicus L.D.8.5
MRLVENMLSLADFYNDFITRHGFEERKGIEETLLNLENGHSVILKAPTGYGKTTLTMILANAVSSDIDLGSRVIHVLPYRAIVQDLYLKLKNYADKGVISTKNIGAQDMDYQDSPFFMKKVNVTTLDTFILNLFKLPTIDFKLIFKNHGSHYEFPRALIYSSIVIFDEFHLLGEDGKSLGAGLAALEVLKDAGVPIVVTSATIDKGLERVLMNKLGKNVKVVNADDFKIDRKVYVNVLENDEISITEEKVKEGKRVLLVYNTRMGAIEAYKKLKGMGLSPILIHSKFSKKDRIDKVNKINEAKLVVSTQVIEAGIDTSFDVLITEASPSHNLIQRAGRVARYGKGGRGKLEGEVYIFPFSGKVYDEREVKETVERIRELKTIDENLLIERNYTEVIDSILAKDLSVIDNSVFVDSKKMKSMYEEICSITRNASIILGFPPNSNDVNDAIPLTEKEAIEIIENKGSSAFVGNGNVKLYNKKCLQLEMLKNDILGVRIQDYNSEIGGVY

SEQ ID NO: 11723 - protein, 941 aa, Methanobrevibacter ruminantium M1
MVISHLNFNENESVIEINSDYFKVYAHKNELFNEHISKTLNIFKTIKSENILINFYDWFKDQGYIHLTFEEFNFLIEECVRFHDVGKLSFNFQLKRLNKNNPAKKKEQINVLKKFGLDSILNQFEGNHSLSGALSFLSKYYDVLPKNELFFLILAYVIIGHHTNLKDIVSQDDFFYKEFEENQALSTTLKFFALFFGLNQSTINQKFFQEINDIGFDFLENTINHYDSSFSFFYSYIYSLLISADSLATSEYKNSTDQIDYSKFNHRISDKLFAHMYKSFYNVKHNRNLLNETFNLNDICPEDINVLRKAMLLESSETLNNALMDDDKKIFFLNMPTGGGKTNTSMKLALDMVKNTDANRIIYAMPFINIIEQNFDVICKSFGLNEEEGNIRQIYSASETIFNKSDEETLEIILSDDFFNYPVICTTFVSLFNPIIKNNKKYKYRLNALSNSVIILDEIQSLPLRNWVSLYFIINELSEKYNIYFLIMSATLPSFDKLKLENIRDDDNFLNYNNVSLINNPEKYFNHDLFSRTNINGGIKKLGINDDCSIDYFLEIIRENFSQDYNKGLIVLNTIKSSRLIYDKLKDFSQEYNFDIDLLNSSILPNRRKNIIHKINQEDLSNYILISTQSIEAGVDVSFDFVIRDFSILDSIEQVRGRCNRSRELNDKFHDSNIKGNVYLINLEDDNSNLYKYIYKDVELKTRIKETINLFNEGFELNDDLNYQYSNILTYYDNVSLDINDVHDSMDQSFLRNDRRNIVFWNKMKYSKIQKKKGIHIILNDLKQYSIFIPLDIKIYDDSLNLDKTIEDMDLNELREIYDEFGKHFIFSLNEILFMKENSDFLIEGDYVIGEEVLNHFQTMVARVKDDYNQKLLVEKVFSSILSNFIMNISFNNSDLEEQIKELDKESYFYILEKNMIGDSEEHFYSEEYGFNFKPTITNIL

SEQ ID NO: 11724 - protein, 542 aa, Ferroglobus placidus DSM 10642
MDVRDFYRNLGFEPYDHQKEAFEKIYSLSEDGGVVVIKAPTASGKTEAAVAPYFAGVYTGEYPFAKLIYVLPTRALANAQKDRLEELARKLGLKLKIVVDHGNVYDKPMLNGDVVVCTLDTFIYGYASLRTFGYRLHYPTSSIATSLVIFDEVQMFQDEEYYTPKIIGRIFKYLYNSRVPFVVMTATLPEKLEKILFEDNRVKVDEENVIVCYRSKRGSVNVGWLDKILLESLNSFVDEIANTKKVGIILNTVPRVQKTYELLKEHLKNEKEIILLHSRMTAQEREKREKMLQELDEFIVVATQVIEAGLDVSLNLMLTELAPADALIQRIGRVARRENEEGNAIIFDVGESFEPYSDKIIKQTRDVVEEIGECLNNLNKTQEIVNRVYENVEIQYNPLLIQAELYFDELRLFALPPEFELRVRPELYATLFVPTRELVDLIKDEAKKNWNEKTDVRRLDLRIKDNSFNVSISWLRSKLDQNKELLLGENNYYCYLEERFVKERSAKVFGIDKIRSIEPYRVYFLNPDYYDKELGLKVIENE

SEQ ID NO: 11725 - protein, 787 aa, Methanocaldococcus sp. FS406-22
MILAKREGKAFQTLKGHTYDALKIYKEYLERNFDVVDDFCNRWGIPTEKFIRNIFFTIYLHDIGKITEEFQNNIKKGKRSNKHPHPLYALPIINSIEFDYLLDIPIEVFAILSHHTQLYDNLYSDYQQYKKGTFLTKDIEKFLKDAKDAYNSLGFSKFFEFEELKIVEIPKEAKPLELHKLRRKYWIETNNYIESLSFDEKIKLKSIFSFMFAILQLCDDFASLNFSEYAKDKEGTFDDVLENPEIYVPTLDIENPISFILKDYEPYKFQKELYSSKNKFIMLFAPCGRGKTEGALLWALNALKNFKRNKIILAMPTQVTSNAMYDRLIKIFGEENVGLFHGKSFIKLKDSKEIEDEEDLEEIKDENFKGNVFFKPITITTIDHVIYSFVHGFSQADFALGNIQNSVIIFDEVHYYEKYTLEHLLTLFEILKKMDIPHLLMSGTLPNVLMNNLEGYEIIVDEEGLNYKPFKLECSENHLIWKENDEWKVNESIINEIIDNYKKGLSQAIILNTVERAKEFYKAIRNKVPAILYHSQFAYKDRVKKEEEIFNLEEMRKSLNKPYVIVATQVIEISLDMSVDVMYSELSPPDALGQRAGRLHRKGRDWKENGKEYKLKIFLPYKHLPYSKELIEKTIDHIKFYEKPLNYRDIKDFVDNVYKDYNLNIPSDLKLFFDEAILFGRHWTDIATMDEEGKFFKVRDDKFMKIEVVPQVYFDELREDALRAEYMAKIPVYLILNEIKNEEGLIHFYPYDKRVGRRTRRYWICSFKYTYEIGFDYKEEEEFEDIL

SEQ ID NO: 11726 - protein, 549 aa, Methanocaldococcus sp. FS406-22
MIKYYDSILKRLGEIKGFQPKRRPLIERILEDIKNSEKPFFIVKAPTGYGKTTISYTLALYSLYNADRFDKVIHILPMRSIVEDLSMSAKELFDFSRAKMMGVSEEVFHLFPLNFTTIDTFIWDVLKLNTKKFSRIKDRKEFGYDFFTQASILNSMLIFDEAHFILEDDKLKSIFLCVLRFLLENDVPILILTATLSKGYEELFKRYAIPKKYDFRVYELSDENEKSSKFHIFVEDKEFLERERKKDFKISVYDENSVEDYLKYVEEGKRNIIVVNSPKKCIKIYDMALEDGRFENISIIHGKMTYNHRKRIVEKIRKMKNEKEFLIISTQVIEAGVDISSDLMVTEIAPPNSLIQRFGRVARYDEKEGKIVILKSEGKPYSKEKIEKTWKYLKSHIDIHPRIFKTYQEWIDEVHGKRLSDAEAKIGKYKKITNTLIEKLRDFRTRSFEIHEIITEHISKGNAFLRDFLIPVEVENDVVLVSPRELFKLYELEKVEVIRIKKLENNIIEEKLEIKNEDEAFKIAIDIACGEHIIIKLLDGYNKERGLVL

SEQ ID NO: 11727 - protein, 892 aa, Dehalococcoides mccartyi GT
MTNDPNLKLWAKTGRGGDLYYHPLLYHMLDVAAVATHMWELLSEDQRKRIGYTLGNEARAITLFLAGGHDIGKASPGFQQQVPQLSELTDLQVSVNDQNRPHGFVSACVLNRFFTTVLGQIAGGHHGIFPRSLDLRMGRDILGNREWEIARNGLLQELAKVLKIDISDDTKCKPKIIDPFIIPLLAGLISVADWIGSNQDFFPCLTKPGQLPELVGDKYFEVAKDRADKALHELGWMPGVIFAKEAPFTHVFSGFIPNSLQNSIEDIAIKQTSPYLMIIEAPTGQGKTEAALYAADLALCRGFARGIYIAMPTQATSNAMFKRVQVDYLKNRRHKGKLNLQLVHGNALLAGMGEVREGEISDFKIADTDTGDTNTDMEAQSWFTAKKRPLLSPFGVGTIDQSLLSVLQTRHWFVRLFGLAGKVVIFDEIHAYDAYMITILERLLQWLAEIDCTVILLSATLPEARRKALIYAYSGQNSSENKCYPRITLAQSRHYINQETNELIVCKEVSVEDSHCIYLNFSRNDLEILAGELTRKLEHGGCAAVICDTVDRSIEVFRYLQANMHETECLLFHARTLQVWRREREDEVLRKFGKGTKQHDGSYTNPDRPFRAVLVATQVIEQSLDLDFDLMFSEIAPVDLLLQRIGRLHRHSRTRPEGLEMPQFTILCDGNRGGAPPDTFGKNIEHIYDRYILLRTWLVVRGKAMIEVPAETEKLIEKVYGTDEEICGPDWIEALEKAKRNLVHEQEESQKAASRLLICPPCDSEDIVRQFNCELFDDDDPEVHTAIRAATREGDPSIMLVMVNAGAVLAAEPALDEVRDLLGHSTMLSYKGLYHELASNCETPKGWEKNTHLNHARLMRLDENNRAKIGGYILTVNEKLGIVIEKESKDNG

SEQ ID NO: 11728 - protein, 568 aa, Thermocrinis albus DSM 14484
MEEKLRKLWAKSDGTTIREHTDKLLENLKKLKEEYGDIIEERIPDSMRGIFWQTLELACEYHDYGKVHYHFQRKLGNKNVKPPKGNLPEVRHNLLSPAFLPEDKNPVVRKLAALAIIHHHKHDAGKEEVEKVREVLEKEFGKELNYKNLIKYREDEILKKLAKDKNLEEESVRKFYIMLKGCLLRIDHASSNRYSPYVETYRKKEPEGKVREFLQGKGSDFNDLQRFVLENREDNLLVCASTGYGKTEAGFIFLKDKGFFTLPVRVSANAIYERAKGVFGEELVGLLHSSSLLEMALSEDEANIYWENIVLDHHLTSNFAKPIIVSTPDQIVPFVFKYPGYEKIASLLAYSRVVFDEPQLFEPHTMGFLVKGIEKITHLGGKVMVMSATLPPFVEEDLSFLDFKRGKFLTEKVRHNLKVVRRSIKDFTEDIRRLAEEGKVLVVVNTVKRAIELKEILPEAQLLHSQFILKDRKEKEKQIKDFFDNADRGVWITTQLAEVSLDLDADFLVTELSTVDSLLQRMGRVNRRGEKPVDNPNVFILTEECSGIGSVYREAIHEETKKFLEMDQ

SEQ ID NO: 11729 - protein, 937 aa, Haloferax volcanii DS2
MTYPLISHPEANDGERTYPDEQLTDDGSLRLTAHNTVVSEYATRLFRGPETQRRFLCVAASLHDFGKATPQFQAYVRDEYEGPEKEKNHARLGALATWFVLDQRDAPARDKLAATLAVARHHQALPDAAQYTAESLADAFETSNSVLTAQLEAISERWPQKATELLQRSGETDSTWDEFRTWVQSGTVVGELHEVSARRELTGPKATSDKLPRKLYDRTLHYWAAITLADKSHAMAVPESHVFDVETLDRETLEEYISGLRAEPPDDELERALNDERERARRQAIDGVHEWLGGDAQTPPIATLTLPTGLGKTFTGLSAAFEARGILESDGGPTRPIVYALPYTSIIEQTRSIFERPELWGADPTKSALTVHHYLSETVVYRNERESEDVASTDQEEHASFLGEAWRDGTVLTTFVQLFESLVGPSNRQGLKLSALDDGLVILDEPQALPKEWWDGITRLIELLTTEYQTRVIAMTATQPTLLRDVETTSLLDVGREHDKTGCLRCEVGPDYPVRLEPARKETYFENAERVRYRIDESALSFHLSADERYLSHETAAARVVAATAAGEGGSTLAICNTINSSATLTQELCGHDGVTHLGEAIDSVLGANDVDATKQENNVSAIVDAILRRSGLRGVDGELSVPAGTDIVVATLNSRYRPFDRRLLIEIADTLSGSEIPFVLISTQAIEAGVDLSFKRVFRDIAPLDSIVQAGGRCNRSYEWGRNGGQVVVWTLADPDEENPGDPTKSPPAHWVYERGSSDAGIQTHLQLISSILAQFEDEEVPDAEISHHAVNEYFDALREKSLSSTKIRTLIDDAKAGKLARESLIGGYQTVDVLVATTQAERKRLNELTELFTSDDPTDRSTGYKKLEQAAGIRVSLPLNSIEQLPDVSRVDGKERNEDGVQVFRYTGTESLEYDLQTGGLRGKEDTVAGRFTTF

SEQ ID NO: 11730 - protein, 730 aa, Nitrosococcus halophilus Nc 4
MRETQAGHWGEHVLEEHLQAVAQLANQFATPFGSGDWAYLAGLWHDLGKYRLAFQHYIRSASGYDPDAHIEVPGRVDHSTVGALYACKQLGPEGRILAYLIAGHHAGLPDWQSVEAGRKALAHRLRPEQQSFLDEALSQPIPEAILQVASPISRPRGRDIALWIRMLFSCLVDADFLDTESFMDGDKTAARSGYPSLSELLSSFECYIEGLQKGARSTPVNRLRAEILNRCRGQAIQPPGLFSLTVPTGGGKTLSSLAFALHHARAYDKRRIIYVIPYTSIIEQTANVFRQIFGDAVLEHHSNLDSDHEDARSRLACENWDAPIVVTTSVQFFESLFAARTSRVRKLHNIINSVVVLDEVQLLPPDFLKPILHAIRELAKNYQVSFMLCTATQPALESRQGFDSSFEGLEGVQEIMDGPQALHEALRRVEVTVPDDLHDSTAWEELAEELHGYDSVLCIVDRRDDCRTLHRLMPRGTLHLSGLMCGQHRSEVIAEIKQRLKAGEPVRVVSTQLVEAGVDVDFPVVYRALAGLDSIAQAAGRCNREGLLEGKGKVVVFIPPKQAPVGHLRQAQDCGRQILQQRPPDPLAPEHFITYFQQLYWKKGTEGLDRKGILKDLKHNGQLRFLFSSAAAKFRLIDETQQAPVIVRYGKGVDLIEQLRHLGPKRWLLRKLQRYVVNLPRYRHQQLLNQGDIQEIHPGLFIQAHDGLYHQDLGLLGDDPAYYDPDQLIV

SEQ ID NO: 11731 - protein, 760 aa, Aminobacterium colombiense DSM 12261
MTILAKKGIAVGNVTIQKTLLEHTQDVLNASFSLFGKEHEPKHLGEKWLSFFKIHETEFFNFSQNLKAAIVFHDIGKSNDQFQKALQGNAPQSLRHEFLGGWILSQELCRKFIESQGIDFHIIRASVMGHHLKLKKGILNSSDYDNPLIKILANGVQDILDLFSSEFNSKESCLLNHAIPQRINIKEEKIALDFDSIEKELRRSFPAQEPQKLRLLRAVRTALILADAAGSGLAREMNQSVDVPMTRWIDNAFDKNNLLSKEKIEYDVIAPRCTQIETTGEKKPFLFSEFQLASSTLPDRTCLLAPCGSGKTLAAWKWGSGVASRHPISRFIFLYPTRATATEGFRDYVSWAPETDGTLLHGTSNYELQGMFDNPDPRSEKEFLTNDRLFAVGLWQKRLFSATVDQFLGFMRHDYRSSCLLPLLADSAVVFDEIHSFDQTLFSALLGFLREFNVPALCMTASLPINRLDQLREAGLKIFPESIASFPDLKEKASAMRYRVKQCKKEEALEEALKAYKNGEKVLWVVNTVKRCQEIAMELQESFAENLLCYHSRFRLKDRQKWHKKLIEKFRDPEPMIAITTQVCEMSLDLSASLLISEFAPVTSLIQRMGRCNRYLEICEGGRILLYPPAKNLPYSKEDIEIAEAFVRNINNKTINQEDLQSLLEEFSPQNREMEKLLPFLNSDAFAFTFGGGIRDGDVYTVSAILESNINNYWNLRKQFQPIDGLILPAPQNCVERGNGLPSYLYIAKGRYVESLGLLV

SEQ ID NO: 11732 - protein, 754 aa, Rhodobacter capsulatus SB 1003
MTHYAHSGTQADRSDWQTLLDHLRMVALLAQDRGAAFGLGAAAELAGRLHDLGKYDPAFDRVLCGEPGPVVDHSTAGGRVLLDPASGCPKPVAEALAQTILGHHAGLPDTNSPEDGGCLVARIARPGAALAAQASADMPEDFNAVSDEFRRKLRKDKAGFDFSVATRMVFSCLVDADYRDTEAFYDALEGRSRDRDWPALQSLLPAFRARFDAHMAAFDPGTDLNRLRAEILAQVRAKAALPPGLITLSVPTGGGKTLASLGFALDHAACHGHRRIIYAIPFTSIIDQTVQVFADLLGAENVLEHHSAIEIETPGPGRREAADTKDRSRDKVRQAMEDWAAPVVVTTNVQLFESLFAARPSRCRKLHNIAGSVIVLDEAQCLPRKVLLPTLAMLDTLCAHYGCTVVLCTATQPAFDSAQLQPGGLALAGRELAPDPGTLAGRLRRARIVQGGAMDDAGLVAALAATPQGFVIVNSRRHALALYRAAEAAGLEGLLHLTTRQYPAHRREIIEQIRARLKAGQPCRLIATSLIEAGVDLDFPCGWRAEAGLDSVIQAAGRVNREGKRPLDASVLTVFSAPDNAPPGDVAQLAGAMQSVARGCDDLLDPAAIRRWFEEVYWRAGPKRLDAEGLMDRFTFDGSATNFAFRTVAERYRMIDSPMVPVIVARDETAADWVARLSNEWEKSGPLARALQPFTVQIPQRARETLRANDKGDFEAAPLRGDAFFVLSDGGLYRDDFGLWWEQADYLSADQSVI

SEQ ID NO: 11733 - protein, 853 aa, Kyrpidia tusciae DSM 2912
MADYYAHYDKASGVFQRLSEHLRSVATSSANAVPVSVSFPSVPNEVVRELVWWVGYLHDLGKFTDFFQDYLVNGEASPYRSSPLKQHAHISALYVHGLAAEQLLKKIPEPHRAAVAFLAYVAVRRHHGHLTLKGLFAEPSWKRRWKSIVTLAEHLNRKALEILDQAELTGLLDERTFLRMGDPGSREADERHFIYAPQYLSGRWKDAQWYFLLVYLFSSLIDADKLDSAGVSARPVAVLLPAWVQRYLERKHAGHQTRLAQRRESARKTILARLDALSDDEIRDRRFFAITAPTGIGKTLAALQCAFRLQERIRKVEGYTPRIITAIPFINIIEQTRRDYERVVAEQEHRSTRLVVHHSLSDLRRKEALGDSVPLDRALLEVESWEGDIILTTFVQLFHSMLTGNNRMLKKIHKLAGAVVILDEVQAIPDKYQPLIGALLWKLGEMYGTRFILMTATQPRILEFGDLLLGTEASSASEGRGKAIELLEDHARYFSEQRRTKLVPKLAEPLETESFVSLVGRVREPCRSVLVVVNTIRRSIEVYRVLKKWMDGEPDKPKVLYLSTNIIPRQRRRVIRLARRLLRQGYPVLMVSTQTIEAGVDLDFDLGFRDMAPLESIIQTAGRVNRDGKKGEFCPVYVVRLQEDGKEDGQRVYALHHMDRTRRLIEAKAEILEPAYGELVKEYYDRALADGVADESRELWEEGVKKLNFDVLDKFQLIANSGEVVDVFVETEPDVDRGSMATALADAYEMVRRADRDWDCGRLVGIVEPEDIARFAEPPNSFERKALIRTIRAKMSDYIIQLRAHRAAKNPPQAFSNRGGIQSDLYWVPPGNLKELYDPDTGFKDDSGVQYIY

SEQ ID NO: 11734 - protein, 806 aa, Kyrpidia tusciae DSM 2912
MVRPFGECVARPAEGERQFPLPRHLETVASGVGNFQGQPAERLDYLAGWMHDIGKSNEKWQWYIESPRSRKGPPHSVYGAILYAYYAERLLNIWKMPRREKTELRRRVQWWCRDLLDHHGRLGDIEETEVPWRSFPPQWEHFDLPGIHDAVSRLFPEVAGSAPTVGSLKAWHKGFVDTWAKWYMDWTGQAVLARYEEAEAPVSCLRLSTASLIRADRFDAAQIEPRRLQREELEGALAHLEKFLEDKGRQAAGSTLAGGGLTGVTALRQRVHQQAVERYRQNPEGDLYVLKLPTGLGKTLTALRVALEIAGDRGKERIVYVAPYLTILSQAAGEIAKASGLEVMEHHSLSMTEDREWDDKAILLLESWQSPVVATTFNQMFRAFFAQRAQETLRLAGLENSVVIVDEPQIVDDSVWQPFLAMIQGAAREMNATFLFVTATLPPLRPGLKESPIHLAPPDIRYPDRYRARVVAEPWDEKQLADHLVGRERDTRHLAVILNTIGDAARVYRELSERLKDAGPADSEPRLLHLHGLMTPLHKRLRIEEMKERLGAGQRLWAVTTQIIEAGVDVSFQKVYRARPIYSSVIQAAGRVNRHGTGGEPGEIVVFSFLRGGEQDSRVWVYQNAIVREETDRSLSKAAEWLEHELYEEVDQYFSRCSARSSGAAKMKALVQAAQGRWSAVSGWSPFEQDPRRVSIFVPWGEGHLERRIFQDIRKRMNEFGIREVREIYERYLDRAWMGGLSFVARKRFMALTQQFIVSMPPKMALQVAANLADDVEIKLAADLVEYREDRGYADLAAGVVETGIL

SEQ ID NO: 11735 - protein, 750 aa, Methanocaldococcus infernus ME
MLLSHPNYPLKDHLTNTMKRALKKYVPPKLKYFNEKLVKGTLKIIALTHDFGKATSYFQRYIRGEKVKSSLKRHSAISFLLTNWVIRETIENNYYQLFSLCVKNHHSFLSNPIHDFNIDKEILEKQFNELNIDFINKVLDENKFPVIKCDFDDLWDSFRELEDVYDEIEYEENNLKYEFYFLYIYLFSLLISSDKEDVIFRGKFLSSNLNVPDSIECYIKTFLKKNKIDYLRTKMFFEVAKRVDELNLNHKIYSLNAPTGMGKTLTVFNFALKLANRIKKEKKTDMRIIYCLPFLSIIDQNYEVLKKALSYILKNLDSDMLLKHHHLSEIYYKVDEEVLDEDKALHLIETWNSKIIVTTFMQLFYSIFSNKNKNLKKFQSLSNSIIILDEIQAIPYKYWFAINKVFSFLAEEYNIYFVLCTATLPMIFKNNIEILKNKEEYFKEMNRIKMRIHKNEMNLKEFIDLVSEDIQKNPHKDFLIVLNTIRSSKEVYQSLKEMGLDGDFYYLSTNIYPKERLRRIKKINKNKNRKIIVSTQLIEAGVDISVDIVYRDIAPLDCLNQTAGRCNRHNEGKKGIVNIVKLIDDNGKRFSSYIYENHLITKTEELLNDYEIIEEKEFLRLNNLYFKKLSIYKDKSKEILKTIENFRYEDVENKFKLIENIPSLDLFVCVEDEAKRIWKKYEEIKEIKDVFKRRKEFLKIKKDFYDYVISVPEYALKGKEIPLENLDKIDEKYYDRETGFRVIEDKTIIL

SEQ ID NO: 11736 - protein, 992 aa, Legionella pneumophila 2300/99 Alcoy
MMVVFISQCEKKALARTRRVLDAFADRIGDKTWQTVITQEGLLAVKKLLRKTASKNTAVCCHWIRTRSKTELVWVVGRRQAFNHLGVVPVNFTSKEVIMDKLPIETGHLIANTKAQLLSHHLFSVGYVAYYLLEKMGVDDYKLRQSAFISGILHDIGKIDPAFQSWVCKKNNKLSENIVPEDGVHIDSPKRFSFESYPRHHELSWLLSEALLVESCSLSKHQRIQIAHGIYWHHTKPFRRDDKFIDAEKIFTIFNASLGNMTINDIYFQAKVVLKDVSVFVSKFNISSLMPDFAKIFVLTENNLPKFKKYDNILDDLERYKNDIRHNALNNLIRSAVISADRLVSSCSAEDLEEYLAEGSLKELVDNLEQGDGQLLNGIRSCLEGFEKRFPSSDQNRVQSEVAKKLSNLQKIAKINGLPNISVLEGPAGCGKTKISLEWALLTEAKKIIWICPRVQVCLGLLNDLTGSDYLPDCHIEIFTGEYKKILSGGIAFDDAPETNEDAYFSGDIVITTIDQAVNTVITHHKVVALTDLMQAHVVFDEFHELIHMPAFNLLFAELLEAKKKRVSQANTLLVSATPHYFFLKEFLDIPSEDIVAIESFNRSRYLIEFKTYNEKEVLSPLITEDQQSNTFIISNTAQDAQLGYLKHYSTENSVLLHSKYTKQDKAYWFNQVYESFKRNGNRRFDVLRSGPIIQASLNISCDRMLTELTCAENWLQRLGRLDRFGVNTEVNHYITVLPESIGREGKQTSHCARFLNQLCIWQSTKAWLKFLKDKLTDNGEVNINQLYKYYREFYSNPASQKALKEDFLKALKKSVDLINDKVIDPISIPQKTKRTDEIIKISANSLRSDSRFVQMAICRVTETLRYEFINDYAYSEDLDSSLLQTYLTASVESMRGYGEDNNNLVQYMRKKHHNIKYGSGYKQARNEWDLIKEARSPETPIYLSYTPNDLEHIGGMDVAHPQAIYYVISDKQPVGAMSIDKLKQHFQKTET

SEQ ID NO: 11737 - protein, 764 aa, Brachyspira murdochii DSM 12563
MIKKEDFLAKSNKYNNYYNTESIEKHTKNLIRLFEDFKTLYKKYFTEKELELIKISLETHDLGKMNSRFQKKIYKSIDKNFEFDEYNNELEKLYKELNIDEVPHGILSCAFLNINELEEKFSENEIKALVSSVYNHHTRKALNNNGLEISASDIKKIIEKDVSFYKQYYDDKLKCKYIGVSMNVIKENYNTSYDIWKNYIIIKGMLNKIDYAASAYDDYIEIGSDDASKKVLSRFEPNECQKYMLENKDKNIIVIASTGIGKTEGALLWAKKSKTFYTLPLKVSINAIYERIKNNYYDKEKITFLHSDSINDMLDNDLSIDDVIDKYNKSKKLSFPFTVCTIDQLFYFVFKSLGTEIFPAALKYSKLIIDEIQSYTPEITAFIIYGLKVINDIGGKFCIITATFPPIVKKLMEENNINFEMPSKAFLKKDKNNESIKRHFIKFIDEDIFNYDNIIKSAENKKVLVICNTVKHSQEVYNILKEYNIKNINLLHSRFLMKDRKKKEDDIKNFAPNDISKREETYGIWISTQIVEASLDIDFDELHTDMSSADSLLQRMGRVYRDRAYNKNEPNIFIYNTKDGYGSVYDKEIYDNSKMFLKYYDNKIFTEEDKQDFINKVYDEEILKESNYLKQIKNTLKQIKDLPPASVDKGDCERLFRKIDNVTVMPSIIYNDLINEENNIIDEYRKLLNMDKLSKENYEKLLKKKNELLKFTVPIKTYKKIKNYSGIEINLNKNINKNKIFIVELEYDKELGLLDKKDNSILMD

SEQ ID NO: 11738 - protein, 735 aa, Thermincola potens JR
MNYYAHSDSQKNKKEWHLLKRHLEDTAQLASVFAGSFGAEKLGYLAGLLHDIGKYSKEFQRRLEGDKIRVDHSTAGAIESDKRYGVYGKILAYVIAGHHCGLPDWGSVADETSLESRLKKESLPDYSAYMNEINLMEPEELVFPIKKAPVGCGFSAQFFIRFLYSSLVDADFLDTERALDPGKSVQRINRASLAEMLSILDTFLDNKCRSAPVTPVNRHRAEILANCREKAVNSPGLFTLTVPTGGGKTLSSMAFALKHAVTHGMDRVIYVIPYTSIIEQNAAVFREIFGEEKVLEHHSNFDYPENDIRETDSENFTRLAEKLKLAAENWDMPIVATTNVQFFESLFAARSSRCRKLHNIANSVVIIDEAQMIPTGYLKPCINALVELITNYHTTVVLCTATQPAIKKFLPSEIKPLEIIDDSKKLYNAFQRVNVNYLGDLPLSDDLLAKKLLSHNQVLCIVNSKKHARLIFEKIQGEGVFHLSTRMCPAHRSETLKNIRERLTKGEICRVVSTQLIEAGVDVDFPVVYRSLAGIDSIAQSAGRCNREGLKEKGEVYVFRPEKHGLPAGWLSRTASVGGSIVMQHEDPLSLDAVRDYFLMLYDLEGEELDREMIMAEIKEQERMLKFPFRRIADKFILIDKNTTAVVIPWDEACRKLLQELRWRHFPGQYGRKLQKYTVDVYEEEFREMLRLGILENVADMFYVLREDVYRSYYNKEMGLLPCTESMFLNDTLIV

SEQ ID NO: 11739 - protein, 746 aa, Thermincola potens JR
MSRISEMNVLLGSLLGNKCSHPGKLLIDHLKNVAVFAKTVADKHGLDVDEELLTAIALTHDIGKAHPKFQNYLDGKGKGVNHAKPSAWFTYSILGDFWAAEVVCRHHTHLRNAIDMITDWQEDSVSIPADEMKNFLPHWPWLIGERERQELDDYLYLQIDDDISIETWLSVRSLYSLLVAADRMEAIGIGFLPEKGIPEFSAPCLPRRFPEIDAWRAEVKEVCVQRAKTISTPGVYTLTLPTGAGKTLTGLTIAYEWANRFGCQSIIYGLPFISIVEQTATVARSVFGEANVQEDHSLAYSKENEETDQTSDKSAWSKMSILFRYWREPIVLTTLVHFWDALFNPKANRTMNFHRLKKAVVILDEPQTISPRYWDGLGNTLAYLSKKWDTFFLLMTATQPHIPASGELAPPNICFPYPRHQFQVLPEKNLQLINLPEILEENLPIRDGSGLVVVNRKKAALTAYRALERLNLDGPMLLLSGWVTPWRRRIILRYLKWLERKKRRRYLVATQVVEAGVDLDFEWVFRDLGPLDSIIQVAGRCNRHSRINFLGKVLVAELVGENGQPLWRNVYDEILIDKTREVLTKNLFFTEENIRSIVDEYYKKILEGLKIEKIFDSLATGQWGEFPKLIEEDNYDSITVFVEENKNVIPMLKKLQETHWTLENRDEQKRLLQQVRQYAIEIPASMVSACRQYCANICCADEEPVFRPIFEGRAWFLGKEAIKTKNGLYDPRIGFIPPEGDWDNIL

SEQ ID NO: 11740 - protein, 968 aa, Thermobispora bispora DSM 43833
MPDEEPSFHVHAERLSAAARTVWAKYDRSTDGWLPLWRHMADSGAVARLLWDRWLPPQVHRVIAECLPGGEEEARRLAIWLAATHDIGKATPAFACQVEPLAARMRDAGLDMPPARMQDRKQAPHALAGQVLLQQWLEERYCWPRRAPIQFAIMVGGHHGVPPAATDIHHLAMREHLLRTPDCAALWKRVQWEILDFCADACGVRGHLSHWHEVKLSQPAQVLLTALVIVADWIASNSDLFPYFPDAARQDERERVAAAWRGLNLPEPWRAREPTEEPARFFTSRFRLPPQARVRPVQARALEAARSMSSPGLMIIEAPMGEGKTEAALAVAEVFAARSGAGGCFVALPTMATGNAMFSRVLRWLRRLFTGRDGAHSVFLAHSKAVLNEEFTGLVRAGRRAVRGVDADGGAGEWRHREDLRRPSAELVAHQWLLGRKKGVLASFVVGTIDQLLFMGLKSRHLALRHLALAGKVVVIDEAHAYDAYMNSYLDRVLSWLGAYRVPVVVLSATLPAARRRELAAAYAGARPDDAALAHVAQAAGYPLITTVEPGGPVKTEPVAASGREVEVRLERLADDLIVLGDRLEAELAEGGCALVVRNTVDRVLETAAYLRKRFGSENVTVAHSRFLDLDRAAKDADLLRRFGPPGESAGRPAGPHIVVASQVAEQSLDIDFDLLVSDLCPVDLLLQRMGRLHRHERGAGQSERPPRLRTARCLITGADWSAAPPEPVPGSVRVYRRYALLRSAAVLEPYLSGTAETGHTVRLPHDISPLIQRAYGPDEVGPAEWQEAIAAAHREEDAHRESQRRNAAAFQIAPVGRPGSPLLGWVEAGVGDADDTRSGRAQVRDGRESLEVLVVQRRADGTLATVPWLGEGRGGLELPTETAPEPRLARIVSACALRLPHHFSYPETLARAIDELEALCIPAWQSAECHWLAGELILMLDENCRSRLAGYELHYTPDDGLEVIRVE

SEQ ID NO: 11741 - protein, 604 aa, Thermosphaera aggregans DSM 11486
MRKGISVFLQLFQEHGKAILIAPTGYGKTLASLEILRRMMEKGVSAGLIHTVPLKSLVEKIYVEKFEGKGFRTGYQSQGRLPGAVKSPFFLRELVVTTLDSFVMNLYKAPVAEFNKVMGDVSPGHYYVPLSSILTSTVVFDEAHMYLGDVDESLSLPMIHAAINALVRLKTPVAVETATMNTNVVGEVAGKMAGEGRVPLVYVSCAGNRQLEKLRSNPRVELHEVCDEEYEEANSIKWATEIVKADKMEGVVDEALKTVDEGGVVLVVRNTVEKAVETFYKLERRLGGRDRLLLIHGRLSTADRERAVQRMNDIMSEGGVIVSTQVIEAGVETNASILITDAAPVENLAQRAGRLCREGSRIFEKCRENGARVYVIEPESGSKDRVDVYSAERVVKTLEGLNQFLKAGKAVDWRLLGTDEEEGRVSFTEILESAVPPPAATSFKEKTYEEMLKSYLESDTSFEVFKKIQNLFGEEGFFRKTVQVRLAVPLNGDYDYVDVDFEWLVRKERELVRNNKPCLEYYPDGRAKVLGFDYDNEKWVEKPSEKISLKMLSREGFPGKHFLDHPGDLYKVAQGNSEEVARYFALLLRKECYEPGIGLVIKHE

SEQ ID NO: 11742 - protein, 738 aa, Arcobacter nitrofigilis DSM 7299
MKILAKKIVEDEQIKTQTLQEHTNWVMEEALKLIDDKSLSKVSIVSGWKKEKILDLIFFSCYFHDIGKATIEFQNTINNGTNSYHSLYSVSVLNQINEFNISGEEDSTINLLLTLCLTHHTLLPYNSNNAYFTFLDSVENIFFNYKDSYKNYLNKECLYDFDFEIEEDIEDILFDIEDDLKYIKENHKLRTLYTYCSGILNFADWLASARFNKSLPKTYFEKIPTKEIFLEQLSENNPSFKKLRDFQDDLSILGKSVLVEIPTGEGKTEGSLLWAIKNLYDKNSKVIYTLPTQVTSNKLYERVTSLFDKNECGLIHSSSKLYLEKEYEKEHGLVDDFFKSEITFNKNFSKPVTVSTIDSLLKFFINIGRFNIATKNYLNSVVIIDEVHCYDFKLMGFLKKFLELCNEFDVKVCLMSASIPKKIKELLGIENYPIITEKKLFKKKANEIIKIDEELDENFDLIIKKFKENKNILIIRNSVKSATDTYKKLRDDYGIDEDDLILYHSTFKKRDKNQKEKDIFDKLDGNKPFILIATQIVEISLDIDFDIMFTDNAPIDSLIQRFGRVNRKKDEIKKGVIYIFKYEKEFPYKSKYLIQITFDTIENGYFELGEYVKWLNIVYDKVFKNDIKINNEIDILFKQGYKKYDDVLKELDGIKKSEDNYDLRHIEQSKVDYLLVDDFLDDNIDSKKFHEYTISLPNYYGKKYLYMSQKESFYKVLDLKYNYRQGLLIDDDKSCEFM

SEQ ID NO: 11743 - protein, 777 aa, Thermoanaerobacter mathranii subsp. mathranii str. A3
MKIESYKDIELYAKRFKGDKGSEYQTIYQHTVDLLNNMEKLFEEYEEEIGEGCKKLQIDYQKLKYLLKLAIIYHDLGKANSKFQQKIRERTKVHEVPQVKGLSKEVPHNFLSTAFVDLEDEIEKGNITYEDFQNLLFTIAFSHDRDFDVDFQYFNKYICEDVSKYIENQTLKPLLELLPSVPDRYKMVESSNYTYRVINQLRELMLKDSYDLSDKKVVFRILLKGLLHRLDHSSSAGINAEEAKINDFPEKVEVYLKRKGSFTGFKNFQKKAIELSEKSVVLFAPTGSGKTEFGLNWAFKSKLIYTLPIRVSINAMYERLAKVFGEDKVGILHSDSMIYLLEKHMDLERGNQELEALFDSVDLAKNLSLPIIVTTGDQIFTSALKWPGFEKIYSLFLYSKIIIDEPQSYSPESLAIIIKTLEEIINLNGKFCLMSATINPLILKYLGDYAEYVQAYSDEDLKRRYSHIISIKELSILDCVAEIIEHAKQKNVLVICNTVKRSQEVYQVIKENLKKFEEIPVELLHSRFLEGQKRQKEQIVISDKRKNGIIISTQLVEASLDIDYDILFTELASADSLLQRMGRVYRKRTYNELRPNVIILTKDPSGVGKVYQKEIVDRTEAFLKKFDGNKITEYDKKELNEYVYDIDALSSTNFISKFKKAYELLELGFRADRKIEAQKIFRDVVTISGIPREIFDKNIEEINEALKKINSKSTKSIEKLKLISSIKKYTVTAPAYFFARGGASCYDKDLGLYILDCEYDDQLGLIPPKELEQSDIW

SEQ ID NO: 11744 - protein, 784 aa, Thermoanaerobacter mathranii subsp. mathranii str. A3
MSSFSELYSHPDKFLEDHLINTSKIIRNYVYEKNVEIIDKDTFLKTVTIISLCHDFGKATNYFQKYLFTENEIERNKLKTMEETHHSLLSAVVAFYLIKNEINTQDRKGILLPFIAFLIVKNHHGDLKDIFNEVILDEKELKILKRQLNSIDDEKLQILNKNLKNAGLNKDLTKSLINEYIDNINSELRKVKRELRKLKEEQDISIYLLLNFLFSLLIDADKTEVVVGIDNIKRPEIKFEDQFVKAYKASFCGEENKINLLREEAYKEAVEREINIGQRIMSINLPTGLGKTLTTIAFSMKLWDILYKHTGVKYRIIYSLPFLSILDQNSSVIEELLKYNGIYPSTEIILKHHHLSDVKYTKSNSEFEDEQAKILIEGWNSEIIITTFVQFFHTLVSEKNRTLRKFHRLSNSIIILDEVQSIPFKYWLLIKELLKAVAEELNSYIIFVTATQPLIFKEEEIYPLVDKNKYFAQMERVEIIPKLDCDITLEKLSEMFDLSDGRSYLFILNTIKSAQQFYSILKTKVLNDEIIYISTHITPLERMERIEKIKKGKIKFAVTTQLVEAGVDIDFDVVVRDIAPLDSINQSAGRCNRNWNGKGKVYIVSLIDEKGQRYSRYIYDRILLDITREILSKYDIVREQELLKIIEKYYHEVSERMSSSEAKKLLDAIYALKYDSDDGDMCISKFKLIEDDYYKVDAFIELNEEAKELWQKYVGLKDIKNLFERRNIFNRFKADFYKYVISIPATAENMPPDIWGFKYVNYDSLNEYYDKETGFIAKGVIGIW

SEQ ID NO: 11745 - protein, 1084 aa, Meiothermus silvanus DSM 9946
MEPHDPSLKATHEKALRLIRLLELLKLKPWTAQQLAQALGIKKRAVLYYLQDLQELGSHLGFRLIHDEIRRTYSLNAGVVLSDIEKVVIHTALRMLYYHSPGHNQQYQEALLKLARGLPEPARSVAQKSVEAMAARGPGLEGSNLEKITNAWFRRQLVQFHYQLPGRRELTKFELETYFIEVSRANMAVYVIGRERSYKGQLRTFKLARMQFVTLVGPTEAYEIPASFDPREYLSDAWGIVGGRGDPVRVRLRFSPQAVPRIREGGYPNLQELEEGDDGSLVVEVAVGADEDGFPIELLSWVQSWGPRVEVLEPEGLRQVWLAEAHQLLERYDPQRVAGPKTYWAHTHKDPTRWQTLQEHAAQVARLAAEKAQPFGDSEQADLAGKLHDLGKYGDLFQRRLEGKEKGLDHWSAGAHLALFEYRAPALALAIQGHHIGLQSGAKENLMAMRLREDGQGFPPELRLSETRLEVLKSRMQSDGLELPPPSQAPIRLPQSAAAMLETRMLFSALVDADFLDTEQHMRGPEVRRPEPPPLQAREALERLEARLAQLAADPGIPPQIRALRQTVAQACAEAALEGRLFTLTAPTGSGKTLAMLRFALKRAAQDPRIRRIVVVLPYLSILDQTVQIYRELFADFGSHYILEDHSLAYRPLRKELSDEQDILERERRLLSENWEAPIILTTHVQLLESLHASRPGACRKLHNLAGSVLLFDEVQTLPTPLAVPTLKTLAHLASDRYGSVVVFATATQPAFDTLHAKVQENEPQGWQPREIVPNPAALFGQSQRVAVEWWLKNPTPNPALTTLLAADSQALVVLNLKRQAQALFQQAQERGLEGLYHLSTALCPAHRKEVLREIKARLDRREPCRLIATQVVEAGVELDFPIGYRALGPLEAIAQTAGRVNRHGLRWEGRLVVFLPEDEGYPDRAYAQAAKLTLALQAEGGLELTPATFRRYYQSLYGIQQVSDPEIEGHIKTQNYAELARRYRIIETPAVNVVVPYNEEALALMQEAREHGIAADWLHRARPYTVPFFLPHGGPPAFLEPVFLRYGRQNSEVPDWFLSPDPACYHALLGFTPAEGGPGSLVI

SEQ ID NO: 11746 - protein, 850 aa, Meiothermus silvanus DSM 9946
MDFRTFQTNTANALMRGRSVLLHAPTGIGKSVGSALGFTEALPAGPAAPARDALLGTRLLHVLPMRALANSVAKDIAGLLERQGFGEAYRPAIHHGQQQESEIFAERVGVTTIDQYLAGFAGAPLSFSSRSGHAVAGAIVASYSVFDEVHLLGPERGLPLLYAVLQQRKRWGLLSTVMTATLPKSVRTFLAEQVGLEAVELSPADVQARDGWRRVTLSLEEVERPAERVLEEFKAHGRVIAFVNTVDAAVELYRQLQARLGPEELFLAHSNFAPSHRKAVEERLLEVFGRGSTARAVCVLTQVGEAGINISAPVVLSELAPVDSLIQRAGRCARFDTQPEGRFVVYRPRRERSHIPYGEDLVKRTEAALHNRGDSFRLDWTAENELVDEVLDAYYAHFIRGENVSRRDAEIKKARKGERVELPQPAPKTKSITIADALGLLDQTFHGRSADVLEGTLREINNVQVVVVSEPPRNAAGAEIVGAEGGASLSEFERYLAQQNLLKPYQRDTLESIPVSYGRFARRLEEQDLWELKLVKEERYDKPLYVLQRAERVRPNRTYLLTQADAGYSPTVGLSFGEVDYVEPVHGLITPVVPRLSEQAQPPKHNFQSWREHCSRVYRAVDSMLKSKYSAWIFHIAEQMQARGALESAEQFAQTLESMVRLAALLHDVGKLSRGWQREIGWREGTGEGFWAKSKEGVRVGELPPHAFHALPALRYLFCQLGVVDEQGKVDRLAELIALAASRHHSLGDPDGMLRWPPFELHEGVIEEIRQLLQDELGEDAKPVEDLITPELFDHINDAHTYERKEGQHTYLLDTPSPSEDYYPFYVLANRMIKVGDWEASGGEEVELCR

SEQ ID NO: 11747 - protein, 747 aa, Starkeya novella DSM 506
MLPSAFDRLAMPVRRWIWQQKWATLRDVQEKAIPAVLAGGDIVISARTAAGKTEAAFLPLLSRLVNSEQTADGFAVLYVAPLKALINDQHRRLESLCEACGVLLHKWHGDVDENAKARARKRPSGIVLITPESLEALLVRRGSEVLRLFSRLDAVVIDELHAFIGTERGMQLQSLLTRIEVAVGRPRIDRIGLSATLGDMMLAAESLRPGGGSSVSIVEGTDAGNGLKLQIRGYELHPFEKPEEIADDDPETDPATAEPFDRSEVPGALAEDLFRFLRGRSNLLFAGSRARVEIYTDRLSTMCLKQKLPNEFFAHHGNLAKAVREEVEVRLRDDPRPTTAVATMTLELGIDIGDVATVAQIGPGFSVASLRQRVGRSGRRAGRPAILRIFAPEIVAGPGSHPLDRLYLELIQSIAMVECLRENWCEPPAHAGLHLSTLVHQLLALILQLGGVSPSVAWEVLCGRGPFRLVSKPLFADLLRCMAHSEIQLVEQSPQGLLMLGARGEQIAESYEFYAVFMSEVEYRIVHEGRTLGTYPLGTPLAAGETLIFAGRRWLIIEIDDDGRVILVRPTRAGKPPQFSSGGGEIHDYIVDKMRAILAGNEAFVYLDACASRLLADARIAFGNLGLHQQNILPCGRNTLVFPWVGSKRLTTLLLALMARELKGTAAWHALEIQDVRCDGVARHLQALADEPEPDAMRLAERLSQPQLAKFDYVLSPELMKRVTIQERLDVSAVPWMARRILELDRS

SEQ ID NO: 11748 - protein, 881 aa, Arcanobacterium haemolyticum DSM 20595
MNTHPELWAKQDGFEKTYPLIAHLLDTVTVAGALYDHWLRPGLRELIEENLGKQARSIVIAVMGLHDVGKANPLFQQRPQENGLEWQKIREIIDSSGNYKPIPPRHILLDRTKIDVRRHECSSAYTLQPSPPTEARAASKLWLHLVLGGHHGRFLPVLKRAESTKIQNGYKDYGWEQAQKDLTDLVLKECNITTKDIPEKVDPTIVLLLSGLVILADRIASGALFVDSGFDLLSHEPELLNDPSSWVTRRKAEAEKRVHNTVGIYSPWPNPQAAREAILGKYSPRPIQQRALDAGDGLWSLMATTGSGKTEAALLRHSTRPERLIFLLPTQATSNAIMRRVQHAYQGTCNVAALAHGLASVEDFYTKPISVYDDEAINGQTLNTTDKPDGLYPSSFVRAGAARLFAPVCVGTIDQALAASLPGKWIHFRLLALANAHIVIDEVHTLDPYQSKLLEGILPWLAKTRTRVTFLTATMPSSQREQLLAAYSQGDEPLSPPIFPSIDEVTSTNIMSTPVESLNVTMNIDLRQTTFDSLVSSHIAWHTNIRQQYPTARIGIICNTVRRAQDIARELQLRGEHVLLLHSRMTAEHRRQTATQLLDLVGPKGTGENITVIGTQAIEASLDIDLDFLNSEICPAPSLVQRAGRQWRHPDPHRSERCPNEKEKTLTITWFESDEDGQYLPYLAAELRRTYTWLSNHKQLIIPDHAQDFIDSAHVDFTNAETDSDHDALTQNLLKSMRGDSNRAEISAALEPHAEVSKFSGLTTDNPADESTTRLIDQGSQARLIMGSVSGKIPGSWKGTPEELLALTSQDKEQIRHALRASMPLYLARSQGREEYLAEHDMISLAGSRSLLAGYYFMPQADRWYDELLGFTDRDESDKGL

SEQ ID NO: 11749 - protein, 760 aa, Syntrophothermus lipocalidus DSM 12680
MCANEPFAKSGETSTSLSLHSRQVADYVRSVARAYKCHWQQLLGEKNAEQLARALVIAALAHDLGKAACGFQRSLQERNFRWEFRHEVLSAALLSCGNLDDSTKMLALAAVLTHHRDLNDSGLLNDACLVALPEPDILEMVLRKFSEKARELTTWWGWLENFCGKEPELQHIVFPEKPEELVAPDMWVERLKDEIEGIEMFADTRANELLLARGWLMAADHAVSAGVGNFNDVLPRFPKPPAVRPFQQRLASHTGHAFLEAPTGSGKTLAAMLWLENNRKHGERVFYLLPYQASIEAMAQTLEKALGQEYVGVVHSRALDYAFREHFEVSGDYETAARLAKTETELNRLVHKPLKVGTPFQLLKWFFGIPRFEIGLSEMIGGLFVFDEIHAYDAHTAALIAEMVRVLRQIGGRCFFMSATFPPFLKSILEEALGETVREYGITRDEKDPWTRKLLAQARHRLRWHEESLDDLIPDIVKAAKGRNRVLVVANRVAQAQELYRSLKGKIQDVYLLHSRFTRRDRVALEREIIGSLGGLSFTNVRVLVATQVVEVSLDVSFDTIFTELAPVDDLLQRFGRVNRYGEHPGGVEVHVARGYNANKLRWVYDLERLEATLNTAPADEAELSVELARDWVLSVYKNGWTEKELDRFRSAQSAFRNVLKALRPLNNSPETGEQFYDMFQGVEILPRALFEEYDQYRSHKQYLLAAQLLVPIPIGTFWKLNKAGRLTRLNDGTLVADVAYDRGLGLLPEEIDLDVQFIA

SEQ ID NO: 11750 - protein, 724 aa, Syntrophothermus lipocalidus DSM 12680
MCVYYAHTRNSEGAMHRLDEHLLAVAELAGKYSERFYGGILEPLAWLAGAFHDIGKVSPGFQSYLEAIEAGQPKRKVPHSPLGAVFIRSVLSRFEVKDDLALIVAGHHSGLEEIGTLTSKLVGYSTDQDLVQEMTDMLQKLLKRTASGGIKIPSLNELQRELLIRMLFSVLIDADRLDTELHFFPERARLRDQGPTLAELAIRFRKDQEELLRQSEDRLSVVNEVRRDVYRACVDAAKSPQGWYSLTAPTGAGKTRSALAFALEHALANGHERIIFALPYTSIIDQNAEVYRSILGPDSVLEHHSQVKTSDEEDEEQRVLRMRLAEENWDVPLVVTTTVQLLESLFSNRPSSCRKIHRIAKSVLIFDEAQTLPPELLRPTMQVLKDLAENYGTTVVLSTATQPALKDEFLPELEGIEIREIIPDYPRHFKMLKRVEYTRLEEPVSIAELAGEVSRYRQVMVVMNTRRNALLLVDELGEKDCLHLSTLLCSAHRRKVLEEVRRRLREGKPVNLVATQVVEAGVDLDFPVVYRAVGPLDRIVQAAGRCNREGRLPGFGEVVIFELEDEKVPRGPYKAGLEQAKLILAECGSPDVLNEPNIFEDYFSRLFSVLGKNLDQYGIQKSRSRLNFPKVAEDYRIIGEDTVPVVVKYGQSEEALQRWQADPSRDSWRDLQAYMVNIYEREAREYFRDGLLSKITDGLYLWEGAYDDVRGLSGVWRDPADLIV

SEQ ID NO: 11751 - protein, 772 aa, Truepera radiovictrix DSM 17093
MTRYMAHSPSEENPRWQTLKAHAEGVSARLEHHLRYLFESVPELRPYAKLTAYLHDLGKYRDGFQEHRLGWNPHTQRPEAFPRRALEHSDAGAKFVQALLEMDRETASEVPFVIASHHGRLHDVDALLRRLQGTDLAEVETLMERAIAELPELEALLDEPLPDLPLDKTARAFLIRFLLSALVDADRLDTEAHGNPSKAELRNQHAAEQDEMRQLLERVRADQDEKAAEDGKDPQPINALRREMYASALGNAALPPGFFRLTMPTGGGKTLTSLAFALEHARQHGLRRVIYAVPFTTIIDQTAKVFREVLERCDFKVLEHHSNLEVKEPKEGEENQTTAPDLATENWDAPVIVTTTVRLFQETLFGTRTAQLRRLHNVSGSVIVLDEAQTLPANLLQPTLDALSFLVKYARCSVVLCTATQPALDERLGFPALKGIRELVPDAARYFNALKRVEYAFRIAEPTPWVELADELKKKEQVLCIVNTRQHASDLYTLLGEDEANFHLSTHLCPAHRQRELAVIKQRLGLGKPCRVVSTQLIEAGINVDFPTVYRALGPLEAIVQAAGRCNREGLLKDENDNPTLGQVIVFLPEDHRTPPGDYEVRTTLTQNELTGTDLHDPTVFTTYFREVYSRISQAPEVEVAGGRRPFQKAHAELYFAQVAKAYRMIEGETLPVIIRGYDPVRVTALLGTLRDSQNREERQRAWRALQQYTVNLQVYQAKGLEPFLGKVAELEERARWRKVEPPYLREWPASSRYHDKLGIVPEFNTDLLTSF

SEQ ID NO: 11752 - protein, 725 aa, Geobacillus sp. C56-T3
MFYAKSETRETIREHTDRLLDNWRLLKDSYGDRLIRVNERMWELLRLAIEYHDIGKANTVFQNKIRRAIQEELLETDCDANVPHNYLSVGLVPFEQLNLTKEEIRLLTHAIGYHHERDKLPDKEAIRHVLQSDLYLQKEAIAQHMRLPLAEKLSFRFVDRLLRRYTIHDGESFWDYVLIKGLLQRIDHAASAHLDVETGVDQNVGVYVRRYMENQSFYPNDLQRFTESHTDKNVIVIAQTGMGKTESALLWIDRDKAFFTLPLRVSINAIYERVRHQMGYGAAGLLHSTSAFYLAERGEENWEAIKQQSQQLSMKLLFTTVDQILKFPFYYRGFEKELASMANAKVVIDEIQAYDPKIAAMLIKSLEMIKKVGGRFMIMTATLPTLYLDELKRRSIIDEEDTVFGEFIDSEHHRHRIQLHDQEITKGIEDFVRMARSSQVLVIVNTVRRAMELYERLSEMASDVPVHLLHSQFTQEDRQWLERQIKEFNEAKTNGVWITTQLVEASIDIDFDYLFTEMSPLDSLFQRLGRCYRRRVIQGEQCNIHIFTQNVSGVPSVYDGHLVCESTELLRPFDGQILDERTKIELVGKLYERERLKGTSFLQEFEDALAMFDHLDPYEMSKKEAQRKLRDIQTVPIIPRRIYDEIAHVIDECRRCRDWRERIRLRMEIEKKTISVHRFLAEKCVSERLSKPFDHIYIADVEYDFDREMGRGKGIQIDTPLSAFY

SEQ ID NO: 11753 - protein, 881 aa, Methanococcus voltae A3
MSTSLNNGKSECKNIAYTIKSHPSKLLKDHLEGVLQICDFFTNNYYGVYFQNNEEYSILKKITYIIALCHDFGKITPYFQEYIQNIIDEKSTLKNSKYKNHSLISAYFTYYVVSKYLKSINKLDEVDNENFKNLPYFSYLIVKRHHGNIKNAKEERVLVDDDLINLQKDSIVNGKKEYVEEINLIYNELFKKYGIFEDEIDILEFFGNLMVPGTKSINYIVKKSYKTCKKSIDKNTDFANSEDIEQLQYMYSILLTADKMDAGNINLQKNSPMYSKELIEPYIQSLNQKNTIEPNVKNIKNINKNINDIRNDIFNDLKNRLNNINLKENHVLSLNLPTGTGKTLLSYYTAFHIANELNKKNIFPKIIYSLPFTTVIDQNYEVLEKLLHMNNENTSIHNNGLIKYHSLAEIPDNLENEAEEEFYNNSNICDKNSKYLDYNIKFSYDNWQGKVIVTTFVQLFNTFFKLGLNKINHRYYNLRNSIIILDEIQAINPSYYKIINKYLNMLCEKYGIYIILATATMTPLFDDSMELVSSKKYFEKLNRITLYNKSKEEINIEDFKELVLNDILDNENNNTNNTNKSKDKFLIVMNTVNSARQVYEFMSNKLLDKNNNYDGEVIYLSTEVAPKKRMEIIDKIKDKENRNKNRKYVVVSTQLVEAGVDIDMDVIYRDFAPIDSITQTSGRANRNGANDEKGIIYIYKVTNEKDKCYSKFIYPAWCIQLTKDILNKQKNREISENEFQVINETYQHELHGNRISYIDSNKMEENLKELNIKSFRDSFNLIDNNYRIYDIYLNYDNEFNEIIGEIEKELLKSKKNNIKIKNLFKKLNKYKISISKDKYYNIKDNLKELSNLEIEIVNKEYCEGGYLRYDRIEDAPIQIFY

SEQ ID NO: 11754 - protein, 759 aa, Amycolatopsis mediterranei U32
MLDTAAVAERLAPLLLRGRVRSELAAAFGVLGDAWGWTAFLCAVHDLGKYSPTFQALNFPLSSARLGSWAVRDLELVAKLHGVPRRVDTPHGLLTALHLQELLVSWGASRRTAVMIAAALGGHHGHFPAGEVVAQARREINAHGERVWAEQRTTLVAELARLRGLPDPRTLDWAQVDLSVPAAVGLAALTTVSDWIASDTSNFAFAEDEVDLAAYAKDAAVQAEAAVDRLKMSSWSPPGGARFDELFGQSPRSVQEVIERVTADLEGSALVVVEAPTGEGKTKAALQATATMVSQFGLAGSYLGMPTQATSNQMFAVMQAMLTRLGDPTTVSLVHSAAREVLAEPAEVGVDEPGTLDAEAQAWFTRKRSLLSVLGCGTIDQALKGAFRSGHVFVRLAGLANKVVVFDEVHAYDTYMSTLLQRLLMWLGALGAPVVLLSATLPSSRRAELIAAWQAGYRGCYPQEINVPPASKPYPRVTVADTAEVVDHPVEISELNRDRVVHLEHVPDERVVDWLLVAAQGRCVAVVHNLVRRATETYAELERRIKELPEEDRPVLLAINGTLPTGARRRVEQELQGFFGENGMRPRRAIVVGTQAIEQSLDLDFDALITDLAPIDLVFQRAGRVHRHRRDAARGRLTVAITGVVDTPAGPQFPAYLRTVYAPIVLMRTWAALKDLDRIESWTTMAQLVDEVYGDQVACPRGWEAAWRRESDRLAVAQHNDREAAAESYLPQPHMVEVLSELTERPRALRTRKSTGRKR

SEQ ID NO: 11755 - protein, 375 aa, archaeon enrichment culture clone 1(2010)
MATLELRDYQKEAIEKWKQRGQKGILVLPTGTGKTYIALAVIKEELEQSGKIAVIVPTIVLAHQWQAKIYQYIGIKPTLYYTHEKGIGKITIFVVNSAYMNRHLLQYFTLIIVDEIHHLSAPTWKQIVDTIKDNKKILGLTATPENAILPIVYYMGIGLAREKKAVVNVEIKPVYAELTFSERMQYEQVDQAIRDIARKLDSAKAYGYKAEMEKLDRMLKIMANKRKQLMSEIQDKAFKVLQIAKAHPNEKILVFTESIRGAEKIAKLLNDNNIKTVTIHSQKSKAIRNTLLAEWGKSYRILIAVRSLDEGVDIPDVSIGIIVATGKTIRQLTQRLGRILRPAPNKEKAIMYVVLARNTYETSILWKLNKVAFSR

SEQ ID NO: 11756 - protein, 741 aa, Sediminispirochaeta smaragdinae DSM 11293
MGKELLAHVKQNDDKEWQIHTLEDHLKGVAVLSAKFTSCFGLEKLAFIQGLTHDAGKASDDFQQKIAGKSGYDSDAHVSTAVDHSTAGAQYVIEKYGEGAIPLAYSIMGHHGGLPNGYDENDSCLEKRLEKEVSEYKTNLPDENLPDTILPSDYLPKKSLKPPKVHFLIRMLYSALTDADFLDTERFMSPEKESLRNDGSVNFIQLKELLDNDLSAYTDRSGINGTRADILDWCRKAANLPQGIYSLTVPTGGGKTKSSVSFAIEHCIRHELKRIIYVIPYTSIISQNAGVFRGIFGVDNVLEHHSNLEPEHENARNRLLCENWDAPIVVTTNIQFFESFYSSRSSSCRKLHNVADSVIIFDEAQMLPSEFLKPCLEIISELVDNYGCTAVLCTATQPTLNKERFLKDSALKNVTEIIPEPETLYQSLKRVEIEYLNEPLSNEDISTRVLPLRQVLIIVNTRRDARKIFEFMLQNHQDDGSIFHLSTFMCPKHREQTLKIIRERLSQNMPCKVVSTQLIEAGVDIDFSVVYRAIAGLDSIAQAAGRCNREGKLEYGKVFVFKGENPPPPGHLRQSAESGEKTLQSFQKDPLCLDAIASYFDDFFWKRAGAHGMDKKNIASRLNVHPNEIDKIPFKDVAKDFSIINQPTKAIIIPFEQEGELLVERLQNKYYFPNRDDYKKAQRLSVQVMDKVLDLLVGLGAVVDARGDGQFYILSNTDIYSKHTGLSTDDPQFIESEKLVF

SEQ ID NO: 11757 - protein, 811 aa, Thermosediminibacter oceani DSM 16646
MVIPFRECVARPKSGDGNPNLLTDHLFAVAKFMGDPKGGDESRLRFLAGLCHDVGKATKRWQMYILSKEEGRVVASGGSHSPLGSMIFFVCSEQLVTKDLPRRFREYLITQLTLDIAGHHGSIKNIDPAWPPWEEALLSAEGVYPYETVDLDGFFDFVREYFPEITLTSRSFADRLQGIDRRWAVVADKALGYAKRYIDNSADRDSAAAGLIMRDRTSAMISADRFHAAGLNFAFFHPEEARVAINNLAEECSRLQKNAAPETLRIVKLRNDHQKEALETYRTFPDRLIYSLELATGLGKTLTALRIALEAVASGKCSRVIYVAPYISILSQATNVIREATGISDIIEHHHLSFLDIDYEHLRSEEDGAFLIDSWQSKIVTTTFNQFFLALFPTKAQHTVRIQALNNAFVIIDEPQIIEPKAWAAFLKTLEAAAKRLHFQSILCTATLPHASDYLNEEYMCLSRGDSLIPRYIIKTLEGKWDAQTLAELAVKKLMEKGSVAVILNTVADAARVYMAVKDLILRGYFENITGIDIFNLTGCMTPLHKSAWISRIKDSLRRGKKCIVVCTQILEAGVDLSFRCVIRARPVIPSVIQAAGRGNRHGEGDPAEVLVVDFVRDDGEDSRKYVYKNPIFREVTDEQLEICKEFSEKDSREIIENFYREAFKRNPPTRKMQLIYEAAMGQWSRLKEIEPFEGDYPKVMVFVPRVFKGSGGPDIPEIIQRAMKYFGISGVSDIYQRYLEKGFWKSLSFRDKKLFMALIEQFCVCVSVKRADSIVRIPEGAFIGSLVDDRIYSEDTGMALAEDSTEFRMF

SEQ ID NO: 11758 - protein, 777 aa, Caldicellulosiruptor obsidiansis OB47
MKIDIYKDIELYAKRFKSNKGNKYQTIYQHTMDLLNNMEKLFEEYNEEIEESCIKLQINYQKLKYLLKLAIIYHDLGKANSKFQQKIRDKTRVKEVPQVKGLSKEVPHNFISIAFVDLEDEITAGNITVEDLENLLFAIAFSHDRDFDFNCQYFEKYICEDVSKYIENKTLKPLLELLPSVLDRDLIINNSNYTYRVINQLRELMLKDSYNFSNKNTIFRTFLKGLLHRLDHSSSAGISTEEPKIKNFPEKVEVYLKSKGSFSGFKDFQKKAVELSGRNIILFAPTGSGKTEFGINWAFKSKLIYTLPIRVSINAMYERLAKIFGEDKVGILHSDSMIYLLERYMEIYRENQELETLFDSVDLAKNMSLPIIVTTGDQIFTSALKWPGFEKIYSLFLYTKIIIDEPQSYSPESLAIIIKALQEIISLNGKFCLMSATVNPLILKYLGNYADYIQAYSDEELKKKYSHIIKIRQLSILDCIDEIIECGRRKNVLVICNTVKRAQEVYKVIHENLRGFEKIHVELLHSRFLEGQKTQKEKIIISNQMRNGIVISTQLVEASLDIDYDILFTELASADSLLQRMGRIYRKRQYEEAVPNVIILTKEPSGIGKVYQKEIVERTETFLKKFHENKITEYDKKELNEYVYDIDALSATNFINKFNKAYEILKLGFRSEKKIEAQKIFRDVVTISGIPREVFNKNIDEIEEIVDKINSKDLNSIEKLKLISHIRKYTVTAPLYFFEKGGISCYDKKLGLYLLDCEYDEQLGLKPPKDIEKSDIW

SEQ ID NO: 11759 - protein, 823 aa, Caldicellulosiruptor obsidiansis OB47
MERTFSCFDNQNLSGLFSHPGKDGGIEGAKPLEVHLANTSILANFFASEKKLALCSTKFLSQIAKITALLHDIGKATSFFQKYLFDKKKIKRRLTRHSLISAICVWGTLNRLIEEKKIQEDKVFEGFTAILAFFATLKHHGDLEAASDMLLLSEDDIELCYEQIENIEKEKFDTLISNISCVCPEIGFLTTDTLKEFVEHAKDSIKVFKRGFRKLFDTEMKFFFMLNLLYSILLDADKTEAIFGTLVDIPELNLSYTDVDSFRRRIFKPENFENSIKTLRDRAFEEAINCEIDENRRIYTLCLPTGLGKTIISFAFALKLRELAQNKFGSKFRIIYSLPFLSIIEQNYNAISQILSFCGFDITSDIILKHHHLSDIVYKTKDSCQDNQEEIFDTDVAKLLIEGWNSNIIVTTFVQFLESILTNKNSNMRKFHRIANSIIILDEVQAINSEYWFLCKNLFEALCTSLNCYIILSTATMPFIVDKSKTISIVKPENYFDKLCRTELYFDTNFSKIGLEEFVANFEFEKEQTYLFVTNTVSSAKNLYKLINQRLPDMQHKITILTTHIIPKERLRRIEQIKNKKYKIVISTQLIEAGVDVDFDHVIRDIAPLDSIIQAAGRANREGKNAKSKVTVVELVSEERGRLFTTEVYDSLLIDVTRKILSQFQKVDESKFAELILEYYKELVRRGVIETTSDDRETSQKFLEAIYRLLYTSSDCETAAIGSFKLIQDEPYKVDVFVEADEEAKIIWQRFAKICEIKDIFERKKRFLEIRKSFYDYVISVPKTDNIPINFENIILYVPYSQLTDFYDPMTGFKTKGESYLSF

SEQ ID NO: 11760 - protein, 722 aa, Clostridium cellulovorans 743B
MSQNAFERYAPFIQEYIYQKNWTDLREVQVEACNEILDTDDHVIIASGTASGKTEAAFFPILTTLYNQPSNSVGVMYIGPLKALINDQFERLSELLEESYIPVWPWHGDISQSIKKRALKEAKGILQITPESLEALLMRHPGDAKRLFSDLRFVVIDEIHAFMGTDRGLQVLCLLSRLEKITDCYPRRIGLSATLNDYEPAQHFLASGTRRGVKVVGIKRHARTISLCVESFQLPKEPLKAENIVKEYNEFLYQNSHKKKCLIFTNSRGGAEKVITDLKNIAYARQETDVFFVHHGSISAALRREAETALRDAEGATVTAATLTLELGIDIGDLDSTIQIGAPYSCSSFVQRLGRSGRRTGKSQMLFVNIFEESDKNLFERLPWELLRAIAIIQLYLEERWVEPFYMKEKPFSLVAHQTLSVLMSYGELSPPELARNVLLLPAFRNSISQDEYREILQYMLENDYLQKVENGGIIVGIKGERIVNHYSFYAVFQDEQVFHVHSQEGEIGTLDNCPAIGEAFVLAGNMWRVLELDENRKIIYVRSIKNSRIPIWNGSGGHIHTKVVHRIRRILTENVRYSYLSPNASEVLEEARKTAKNSGMLENNVIPYSANSFYLCPWVGSKEMKTIKRLLSYGLKDFLQIYSVSGGSHYLQITSGLSVVEVVNKLHELSVDCDNDNMVLTEKQAPKIDKYDGMVPDNLLRKAFLHNELNVESAVKILREL

SEQ ID NO: 11761 - protein, 705 aa, Clostridium cellulovorans 743B
MFENYYDIIGFKKPREIQKEIKNVLKNKKENVLVISGCGSGKTEVGHYALLNWNGIRSIFVEPMKTLATSIQERLNEYNKILNINEKWTIQHSGIEEDKYLENKFCVTTIDQVLSGWLGIGRQSFIRGKNIVQSNFVFDEVQLFQPDKALLTTINFLDSINSQGNKFLIMTATMPKYLIDFLLERYNMKLIEAYEETIADREIYVNYSSKVDYLQINSRTESQIVICNTQAQQEEVYNNIEDKSRCIILNSKLLKYDRSKIESKNLLEDDVSEKSLYKYFGKYAKKNNKILIATSIVEAGVDISANYLYSYACPIDNFIQRCGRCARWGGIGQVVIINSNDIVYDSKIVKKTIEFFADRPSLKFTWEIQKAVVTNILNPFYMDVINEINVRKNKYNLIDGSRGKLIRDIQNVNIIVDKDISFNSFKKQSISINISVLEKLSKNNALYVIDYGKNRNSPVQKKINDDIIGQTIVIQGNDCIYDELGFRYKEGSVCNTFQYDSNATDKYDKFNFDYKEESWINHATSVRALVKQKMLNDRFSSYVLENIDDISNVCGLHDIGKLDEQWQGPKWAGAKSILLAHFPFKKANTLIFKNRNHRAIGYIVLKNNLEDRILLNVVLQHHGRIISNNHDIIIDKFGLHKNSMLCLYEYGFYGGVVKEGNDNISYEEILTPKDTEWNNFLYIVGTLMESDIESINLFHNTKFLG

SEQ ID NO: 11762 - protein, 788 aa, Thermoanaerobacterium thermosaccharolyticum DSM 571
MMNTSCFSSLYSHPNKYLEDHLSGSAHLIEKFSDESSTNLLDDKLISRLTKVIALCHDLGKSTRYFQDYLSADDSEKKNMKSMKETHHSLISAVIAFFVIKEEINKHAAYNDVKTLLPFIAYIVIKKHHGNLNDVVTEASLDDSDIDTMKSQLQSIDEEKFSILSDNLVKAGLDVKLDKNTINHYIENIKNELRNVKRYIRRINEKSDLSYYILINYIFSLLIDSDKSEVVIGRNFSRSYVELPSDLVDKYKSQMSYKENKINSLREDAYREVNSSEINFDDRILSINLPTGLGKTLASISFALRLREKLYKTFNKNYRIIYSLPFLSIIEQNFQEFEKILKGNNINTSTNVLLKHHHLSEMKYTDDDTEFDTDSSKIMIEGWNSEIIVTTFIQLFHTLLSNKNKSLRKFHRIANSIIILDEIQSIPFYYWKLVKEILQAVAFKLNSYVIFVTATQPMIFGNDEIRQLTDKRKYFNQMDRVVIKPVLDRNIHLSELVDMFDLKDGRSYLFILNTIASAKQFYELLKQKLPDEEIVYMSTHIVPFERLERIELIKSKKVKYAVTTQLVEAGVDIDFDVVVRDIAPLDSINQSAGRCNRNWQKSGEVYVVSLIDENDKKYSSRIYDKVMINITEKILSQYDEIGEKDFLNIIDRYYTAISENLSSDAAINILNAVYKLKYDSDDGTPSISKFKLIDDGYYKVDAYIEYNDEAIELWQRYLELKNVKNLFKRRNIFNEFKADFYKYVISIPEKTENMPADVEGFKYVNSDSINEYYDKETGFITKGVLSIW

SEQ ID NO: 11763 - protein, 803 aa, Thermoanaerobacterium thermosaccharolyticum DSM 571
MVLNEFEYVKFFKDVTGFEPYDFQIDLAKKVFAGKNVIMQAPTGSGKTWASIMPFLFAYYEGINFPRKLIYSLPLRVLTNSLYNDVREKVDKKFNGNIQVTIQTGENSNDPYFLDGDIIFTTIDQSLSSLLSIPFSLSNKQSNINTGAIISSYLIFDEFHLLDVKRSLSTLLNIISKLDGITPFCFMSATLSSKLLDNYCKKLNGSQISIKESEVAKIKSQRDKVKRVFVKETTISAEEIIKNHVKKTIAICNTVETCQNLFLELKNKIDREKSLNNVRLLCIHSRFSSNDRKDKEELIKKFFNKYSDENVILISTQVIEVGLDITCDVMHLEISPINSFLQRIGRCARYEGENGKIFVYDVNKDDKTKPYLPYDEELCVRTLNKLKSIGNGVNIDYQKSEVLINDILTDKELRDFERIEEGKHTRFTEIVDCWINNEKGNASRLIRDIDTINVLVVQNVSLLKNPYTYDAIPVNRYTLISRLKKVVKEDEEDWLVRAIEESFLDDEDLFGKFNYPQIALDDIRLKVENRVILNSKYVFYDDDIGLNFLNAGQREILKIDKLQQKQDYIITKDTYEEHIRYMMVAFDDLFKGKYKYIFLKLKERLDLKYDVEELIRFIIIMHDYGKLNAVWQASASKYQNKKGNYNKEELLAHTDYNPNVDENNRPKLPNHAGIGGVVAASLAGDILDYGVCIAILNAIAKHHSVKTESSAKYRIMKEGKEKTLKLIKIYCPNLYKDIDKSKEFLSEGDEQSFNDYAVNFNKFGIDFDVLLYFLFVRILRICDQKSFAYKQIMMEGGEYRDDR

SEQ ID NO: 11764 - protein, 706 aa, Parvularcula bermudensis HTCC2503
MQGWSELRPVQSEAIEALLGGNDDAIIAAATAGGKTEAAFLPLLSEILNLEVSRDAGFDLVYIAPLKALINDQQRRLESLCLETELAVTPWHGDVAVSVKAKAIKRPRGVLLITPESLEALFIRRGQTIPQLFGGVRAVVIDELHTLLDTERGVHLRSLLARLELAVGRSIRRVGLSATLGDMNLARAYLRPGAEEGVTVVKADGGNAELQLQLRGYLKGGSEDDAAEKAVAAHLFEKLRGRDNLVFAGSRGSVEVYADRLRRMTEEMHLPQEFYPHHASLSKEHREFVEQRLKDDRLPTTAVCTSTLELGIDIGDVACVAQIGPPFTVAALRQRLGRSGRRAGHPAILRQYAIEEATDHQSALVDRLKLSLVRSVAMIELLLEGWCEPPKAQSLHLSTLVHQILSVIAERGGASARRLFVTLCEKGPFSAVTPDLFARVLRQLGHPDVSLIEQSEDGSILLGKVGEKLVEHYSFYAVFMTPEEYRILAEGRDLGTLPVDDVLAPGMTIIFSGRRWEVIEVDDLEKVISVRQSHAGVAPLFGGDPGDIHDEVIDRMRVLFTDDQLPIYLDDTAGELLTDARTAFARSELGKKRIIDTGDNSALLATWCGTAKTWSLGLAFGAEGFKWSVYDGFLEIDGRDTKREVRDVLDFLGAGGTIDLSDQATALSFEKFHPYLSRDLLLADAKSSRLNLGALPPLAGEILNSI

SEQ ID NO: 11765 - protein, 782 aa, Parvularcula bermudensis HTCC2503
MDRFAHSLPDQPKEQWEPLSDHLLAVGQAAAQFADEFGASPMAQVMGQLHDIGKVSAAYQRYIRTGHDDGSAQRGPDHSTAGAKEAITLYGNKLGRLLAYGIAGHHGGLMDFADLDRRRQKFIEDYTGWQEHAGELLSCKTLASAPLSQKENSIDKNFSKSFLGRMLFSCLVDADFLETERFYAVSSDAPNPTRGGTFTPSHLDSVRTYLMRIRNNNSELNTLRSTILDHATQKAALTPGLFTLTVPTGGGKTLTSLSFAGEHVIRHNLRRIIYVIPFTSIIEQTADVFRKEVELGDAILEHHSSFDWDKMPPFDDRDDENEGEDGRAKLRRDTENWDAPIVVTTAVQFFESLFTSRPSRARKLHNIVRSVIILDEVQSLPVHLLRPCMAALDELAKNYGCSIVLCTATQPALRVQDKALALKNKGDPHWGLDIPDERELAPRPKELYQKLRRVDVHWKREVVTDEEIAARFDEQAQMLCIVNSRAHARELFLQLRERGQEGAVHLSTLMCAQHRRHVLEKIRDDLKNKRPVRLVSTSLIEAGVDIDFPEVWRAATGHSSIAQAAGRCNREGKLEGLGQTVVFEPSDREPPKAIGPFLKAAADSFQKYSDDVLSLEAIREFYAGLYWRQGFEALDNARVPNGESDERFEIIKALRERAGTWEFPYKSVSKAFRLIDDVMVPVIIPYDDNCRNAIDALTHAPVPPKGIQQTLQQYTVPIPPSSRDTLLRDGAVAFIRPEAYGDRFATLVVTKPAEQPELYDEDLGLRIDADPVARNSESNIIS

SEQ ID NO: 11766 - protein, 608 aa, Encephalitozoon intestinalis ATCC 50506
MSPYLYRLPIEVHKDKILDTVGKFKVCVIKGPTGCGKSTYIPYLLSSFFPSSRIAIVEPRRIAVMSLYKTLSSVIGRVGYKMRFNKSIGKDSKTIVYTDGSFLNDMDEGRFDYIIIDEVHERSIRTDIILGLLRRNIRDIRGKVILMSATVDTEKISRYFGAGVLEIPGDSYPVRIEYLPECTSDYIVESYCIIKKIALSKESTWDGFESKNRDILVFLPGEEDINDLYVLLRKLPVVKVYKVFSALTDKDQSKIYEPCKLRKVILSTNICETSLTIPGIGYVIDSGLHKVKIYDQMNYLGIQAISKESADQRLGRCNRTGPGTCYRLYTEDIYNELSPQKSPEICRSDLSQAFLQLLKHRRNPLKFEFLDYPTRTNAIATLDFLMEKGCINIIDTRKQSSDRRLDAISMHQECNADSKKMSLEDLQLKITSYGKVVLRHPFDIHLSHFYQQSLDKGVGYLASILVSLVSQDNCSFLKYKSKSQKTDIEFLISLFEGYLESEDKKQYCIKHEIGIKYMEIAKRIFSALNRKKDGDIEMIEKVFSFAYQHNLCERMKDGSYRHLKGGSVVWIHPTSCFFKRKDRFVVFVDVFYTTKAYANIVGRYFKTF

SEQ ID NO: 11767 - protein, 769 aa, Spirochaeta thermophila DSM 6192
MFYAHSRPDLPKDKWQTLEEHLAEVGSLAGMFARKWDAEVLGVIAGRYHDLGKAQDDFLKRLEGSSTPVDHSTPGALFVKEQFSQRGKDFEPLGMFLAYPIAGHHTGLPNGRDASDHNLFTRLQKTSPLPPHNLQQVAHLLDISEDALAHQIERLKRDLGRYLSKTPPDLTRAGMYLYLFVKMIYSALVDADFLDTERFMDPERSRLRGAYPPIERLHARFFDSMERFLEERTSHPSPVDAIRGEIYRACLDAAREPQGFFSLTVPTGGGKTLSSFAFALTHALTHHLERVIYVLPYTSIIEQNADVLRRFVGDDAIIEHHSNYESKEEVHGGVASSDTYSEAELKRQLATENWDAPVIVTTSVQFFESLFSHRTSKNKKLHNIARSVVIFDEAQTIPREHLLPILRALEVLVHHFGVTVVFCTATQPALNKRNDFDGIEGVREIIPDPHDLARRMERVHPQYVGLLSYETLVDSLAEESQVLCIVDTRKKARNLFSCLASRISEGRFHLSAAMCPTHRSEVLRRIRETLSQGKSCRVVTTQLIEAGVDVDFPVVYRSIAGIDSLAQAAGRCNREGKLEKGRLLVFELEGEDVPNIGDFRPRAEVAREVIRKVLRNGREDDHFLSLRSVREFFEHFLWRMSHALDKRGITEKLKGVLRDIDIPYEDIGKGFHIIDEPVISLYIPYDERATSLLRTLRTEGPSSRVMRSLQRYVVQVHDKAFQKYGEMGVVEEVYEGFFALTEWGREHFYDAEMGLLPPTDTLRAEDLIV

SEQ ID NO: 11768 - protein, 572 aa, Vulcanisaeta distributa DSM 14429
MRELVNEAINGLVNEYPHISTVIVEAPTGYGKTFNSHIPFLKFKDMGLARGFIYVAPTRALVRQQARDFLIKLQGQGFSITYQSMDVNLKVEVPNIRSVSLTKNPLLSSDVNVTTIDSFMFNLMRMPVESLNKPVKWRYATYRSYIFTSYVFLDEIHLMVEGSGLQLSSILLGIHELTASFTPSIIASATLGSGRIKCIATGKCGDTSLETYREVANRVRVYRLGKENSKDGVFVTIRDKDWEDKTCEQNFNFKELNNIDEIIKIIKEQYSRVLILTNTVKKAVDIYNLVSGIFGSNNVVLLHGKLDEYDRDINARNIDNARIIVGTDAIGVGINPPNVNVLITDIPSSIDTFIQRIGRICRNVEQDRDCHVYLLREGEEEEIPKYYTEVRDKLHEFNWRLPYDCVKKRGYDSLINSYVEFQSPDISSYQDLYAKLSFIVIDQEDLKRSYRRYCNLIRDSVLIRGITNVDEPLTYSMALSMRDAEVLAKEYGKDIDIVAYALHEDGNLQKISINNDVKESVLKELADERKNECNRYFEINNEINKLGSSYKALIIWGIDVSRIYRRGLGLVI

SEQ ID NO: 11769 - protein, 778 aa, Thermoanaerobacter sp. X513; identical to SEQ ID NO: 11626

SEQ ID NO: 11770 - protein, 768 aa, Hydrogenobacter thermophilus TK-6
METKSGIYSHPGIFIEDHINRCLELLSFYLQRELPLISDEFVLSATLSVALHDFGKCTKYFQDYITGKGRRSEFSKHSLLSAVYTYYCAKKLISDPKLLSFSFVACKSHHTDPESFTSEFTFDKDEIERLKIQIESIDQEKTNIFISNLNLPENVKKSLFLNKEEFKNKLTEIEKEIKSFRKSFHKCESKIEDFVKFQYLFSLLLDSDKTETGAKSFRPKRVSCIPLHVVSRYKANNLPKSREIDHLREEAYKEILSKEVDLSKRIYSITLPTGMGKTLTGFAFALKLRELIKNEKGTTPRIIYSLPFVSIIDQNAEVLIKVLKTEFHEIEGRILIKHHHLSEPRFEEYEFSEARLLTEGWNSEIVITTFVQLFHTLISARNSEFRRFNKLANSILLIDEVQALPTKYWHLIREVLREVSKNLDVYIILMTATQPYLLEEAVELADPHVFRKRLDRIRVFINLEGVSLGQFVNSLEFKKDKTYLFITNTISSSKELYRLLKERMNEKICYLSTSVLPYERLRRIEEIKKGKYRFVVSTQLVEAGVDIDFDEVYRDFAPFDSLNQSAGRCNRNMERGKGNFYVIKLTDSEGKPFYSRIYDSVLCNITEEMLKGVKELSEPELTNLIEEYFCKVWEKTTPDKSKKILEAVKCFSFSSGDISIRNFELMEDDRYKKDVFVEINDEASEVWSRAKSIIEDLKKKKIDIFKAKEEFEKLKPDFYKFVVTVNIKENEPSYDQELKTFFVSQDMLERYYNSETGFIEKGEAFFEV

SEQ ID NO: 11771 - protein, 810 aa, Gardnerella vaginalis ATCC 14019
MSCNHVVNTELWGKKREVNGVMQWLPLAQHLEDTGNVIGQLWDHWLSDGQRRLIESSLSKRVDAKKLSQFLGCIHDIGKATPVFQFRKSYSNSKDLDIALKNKLATVGFTNINDFIIKAEDWSSSHHTITGQAILSNTGVPEGVCAIVGAHHGKPLDNDSVYKSNESAYTDHYYQSETESENSKLWQKLQNDILDWALERNDFSNVDDLPEISEPAQVLLCGLVIMADWIASNEQYFPLIPIEKDLIENQEERYRKGWEKWLQHGSKDVWESLNCCSNISQIYKHRFGFLPNSIQTALYNVISHCKEPGIFILESSMGSGKTEASLIAAEQLANLTGRSGVFFGLPTQATSNGMFRRVEDWLKSVNSDFQGEIGLRLVHGKAELNADYAHLLHGMQNMNDGCESTSSSNDVNNNGVILNDWFTGRKTAMLDDFVVGTVDQFLLASLKQKHLMLRHLGLSKKVVIIDEVHAYDAYMNKYLEESLVWMAAYGVPVVLLSATLPAKRRKELIKAYMCGLFGFNWRECDKSNVDFETNNYPLITYSDKNCVKQKFIENDASDNKSVSVRKITDDSLHESLVNELKSLLNNGGIAGIIVNTVKRAQEIYNACVGEFTDEEVIVIHSQFIATDRVRKEQQICNMIGKNAHRPVRAIIIGTQVLEQSLDVDFDVLFTDLAPIDLLLQRAGRLHRHMIERPDSFKEPILYVLGTSERYEFEKASESIYSKYLLIRTQYYLPDVINMPQDISRLVQIVYGDNLLELQEDLKDAYAAAKREHDSVRNSNESAAKTYRIENPKSEIGKKSIVGLLKKFNYK

SEQ ID NO: 11772 - protein, 743 aa, Rhodomicrobium vannielii ATCC 17100
MFFAHSSKDASKCDWQSLAQHLSEVAALAAQFSAPWGGDRAARIAGLLHDLGKYHPDFQRRLEGSDIRVEHSIAGAAYILTNAASGDKAMAELIAHAVAGHHAGLPDRIGDGSSLNQRVQDADPSRLNPAWRGELAIDLGNLNPAFSFKSKEATEFGLSFLGRMLFSCLVDADFKDTEAFYNRIEGRKADRDWPALRDVLSALSERLDAELSRKAAVGSDTHVNHLRQQVLTHVRGKANEAPSLFTLTVPTGGGKTLTSLAFALDHARAHGMRRIIYAIPFTSVIDQTADIFRKLFGDDIVLEHHSAIDEEKVRNLSSRDKLRLAMEDWAAPVVVTTTVQLFESLFSARPSRCRKLHNIAGSVIVLDEAQTLPRHLLIPIMRAIEELAANYGCTVVLCTATQPALGAREGFPGLPLDGRELAPDPAGLARELRRTRLDFAGPKDNAALVDALGRERQTLVIVNSRAHALDLYRDAVKAGLDGVLHLTTRQYAVNRREILKYVRARLENDLSCRLIATSLVEAGVDVDFPRVFRAEAGLDQIAQAAGRCNREGRRDPDASVVTVFEAVGYSVPSEIKGLIGDFGRIRHKHADLFAPAAIQDYFEEVFWRMGDKLDGKNILKQFIVDRTGTHFQYRTVGEKFRMIESGLLPVIVPHDDDAAKRAVADLGNAAIPSGKLARQLQGYIVQVPPDARALLMANRHVALKAEDIRGDQFAVLQAPHLYTKETGLLWEDGSLLGNDQTFI

SEQ ID NO: 11773 - protein, 726 aa, Geobacillus sp. Y4.1MC1
MTFYAKSETKETIREHTDRLLDNLQLLKDSYGRKFVRMDERMWELLRLAAEYHDVGKANTVFQNKIRRAIRDEMLETDCDADVPHNYLSVGLIPFSQLDLTKEESRLLIHAVGYHHERDKPPDKEMIRHILEADMKKQRNAISEHMQLPLAEKLSFRFVDRLLKRYTIHDGEQFWNYVLLKGLLHRIDHAASAHLPVEIDIDRSVGASVRTYMKKQGFRKNALQQFTEANQDKNVVVIAQTGMGKTEAALLWIGDDKAFFTLPLRVSINAIYERIRDKMGYDAVGLLHSTSVHYLAEKGEENWEAMKQQSQQLSTKLLMTTIDQILKFPFYYRGFEKELATMANAKIVIDEIQAYDPKIAAMLIKALEMIHNVGGKFMIMTATLPTLYLDELKKRNIIDEEHSAFGEFIDTSKHRHRIQLHAKEITEGLEDIVRKAQTSQVLVIVNTVRRAIELYQNLLERELHIPVYLLHSQFTQEDRQLLERKIKEFNDEKINGIWITTQLVEASIDIDFDYLFTEMSTLDSLFQRLGRCYRKRILNEERCNVHIFTKNISGVPRVYNEHLINESIKLLQPYDGHILDERTKVEMVKQLYERKRLIGTEFLQDFEDALYMFDNLDPYGMNKKEAQRKLRDIQNIQVIPRRIYDGIIDLLEMYAACRDVKKRLHLRMEIEKKTVSVSRFIAEKYVSERLPKPFEHIYIIDVEYDFQRETWKGKGILLDTPMSTFY

SEQ ID NO: 11774 - protein, 827 aa, Geobacillus sp. Y4.1MC1
MYLSHNNPDKKLTVHLKEVYEYSQDMLKHVPLSDENRDMLEYISKIVAVAHDFGKYLSYFQDYLRTGETNGDLHHHSFISAVFAAHLLRHPANLNASWSEFAPLLGYFVVMHHHGNLRDISLDVTKSRHIAENTVQDSLYYRVNTLKQQIDDIKNHASAIVEDLSPLWDELSIPLSLSAELHSFLQNYEKAFDEVYRQYYLIDKRRKQELTRELYYYVLLLYSVLIDADKLSAANIERKPRVHIPAHLVDQYREANFDVNVTEGTNGWRNRMYNVVMERIEELFKTKPEQRLFTLTAPTGAGKTLLSLSVALKWREQTERQHGYTPKIIYALPFTSVIDQNEKVIRDLLSQLADFHANEQRYLVKHHHLSTFQYRTENEELPLRKALLLTESWEAELIVTTFVQLFHTLIGYENRALKKFHQIAGSIIILDEIQNVPMEYWPLLRSVLYKMAELFSCKILLLTATQPLIFPEGETVELLESELVKPIDFFKEMERVELHWLGGDKGAYSPAEWMELFQNRFEDGKTYLAIFNTIKTSIEIYEGIKEWLKERGYDVIYLSTNIVPCERKRRIERIRQLLKEKKKVVVISTQVVEAGVDVDFDVVYRDLGPIDSIVQAAGRCNRNGKLHELGKVYITPMEREGKLESQYVYKGVHTNIAKEVLPKTPVSEHQFFDIIMQYFTEVRGKKSFDASDGIISAMEELKFDAKDKSGSKNKPKYVSEFQLIENAHQAVDVFVEVDDQAMDIWQQYIQKVVEEKDFETRFENYLRLKKDVRQYVISAPIKLVKNLDRDLYEKTRMIHLANDILNQYYNSEYGLIRTSEMVDAWIM

SEQ ID NO: 11775 - protein, 745 aa, Desulfovibrio vulgaris RCH1
MADGGDEHASGHDNTLKNARYYAHSTPNPDKSDWQGLDAHLENVANLAATFAEAFGAREWGKAAGLLHDAGKATAQFTQRLEGRPVRVNHSICGARLAQEQGSTCGLLLSYAIAGHHGGLPDGGLQDGQLHHRLKHERLPADVSPPSVDIRPDVLKPPFTCRPEHPGFSLSFFTRMLFSCLTDADFLDTEAFCTPEKASARNGRSALGLVALRDALNTHLDTVERKALPSRVNDIRKTVLHDCRARASETPGLFSLTVPTGGGKTLSSMAFALDHAVTHGLRRVIYAIPFTSIIEQNAKVFSDVFGQDNVLEHHCNYRSKDEPEEQGYDKWRGLAAENWDAPVVVTTNVQFFESLFSNRPSRCRKLHNIARSVIVLDEAQAIPTEYLEPCLYALKELVGQYGCTVVLCTATQPAVDDASLPERVRLHHVREIIADPQRLYTDLKRTEVTLAGRLTDAALAARLDGHGQVLCIVGTKPQAQAVFSLLQEREGAFHLSTNMYPEHRRRVLGTIRQRLADRLPCRVVSTSLIEAGVDVDFPVVYRAMAGLDSIAQAAGRCNREGRLPEPGQVVVYEPEKPARMPWMQRCASRAQETLRTLPEADPLGLEAIRRYFGLIYDVQELDRKDIFKRLRGQVDRDMVFKFREIANDFRFIDDEGTALVIPTGPEVEDLVRRLRGCEFPRPVLRKLQQYSVTVRHRELEKLRSAGAVEMIGDAYPVLRNLAAYSEDMGLCVDSVEVWQPEGLVS

SEQ ID NO: 11776 - protein, 1070 aa, Bifidobacterium longum subsp. longum BBMN68
MATHFPKGKTALSPEALSIWAKTAFYGRTDDDSYLQLWQHLEDTGEVALHVWDDFVSDNIKELLAEDIGDREVAKELYQFIAAIHDIGKGAPSFIVQSTKFADKVKQTKLSIKAIVGKDPMRSEYRHELVGYAAVIEWFCSQGFPVEPGTFAYGVACVVAGHHGKSLTDDKQALVDPSQRGKSFRRETFMGDKAWTAIRNELLDWVSDTLHAQPILYTLRNRSLRRRTQILLTSMVVMADWIASDSRLFPLNQGPVDEQVFDARRRADKAWRMLRIPGPWTPLATGESPDEMFAERFSIPGARMRPMQREAARLARTMESPGLMIVEANMGEGKTEAALIAAEILAARFHCGGIYYALPSQATVNAMFTRVLDWVGHLPADERGQIGSLFLAHGKNELNDEYEHLREQWFDNGGERLDTEMDLSEPSVGSVDAECDENGRYGKYRAYDDHSTMQAVVNSWLTGRRRGNLSDFVVGTIDQVLMAGLRSKYVVLRHLALAGKVVILDEIHSNTAYMNVYMETVLSWLGAYGVPVIMLSATLPQEKRQAFLDAYRNGASAASKVEAEPVRPSKYALSLPARIPLPSRIPPVSAENIAPPRRIPLRQRKDAVQNNDEVSVEPDLRYPLISVATANGVPITAAPEPSGRATDIEVSLIDDGDETLVSLLRKNLRDGGCAVIIRDTVSRAQATYQMLLETMGDDMDIMLDHSRFLAVDRARIDRELIDRYGKHGSVEGRSGIVVATQVVEQSLDVDFDLMITDIAPIDLILQRAGRLHRHHRGDGENLRPEPLRQARLVITGVSQWNPDVPPQFSAGVDKVYQPYLLMRSLAVLNMEPGAVRKLNIPSDIPRLVQTVYGRKMVCPESWQDGNHGECAAKERLESDRHSSETMAESFRFFNPQRMQDAFDINNWLKVAMTDPDTPGKANERKGRAGVRESEDSFEVIVLQQRNGELMLPSWCGFDESERMLPTGFGVPTRQQVRDILSCTISLSRTSLSYMNLDDVIAAFERATPDRWFDYMQLERGLAGQLMIALDENGTAVYQIPEWDANGARIGTRTLTVRYSTRKGWQTDASK

SEQ ID NO: 11777 - protein, 914 aa, Caldicellulosiruptor owensensis OL
MNKIWAKSNYDDKDKEVITLSKHVSDVLKTFENIQKKYSFQSPLIEATRIAIFLHDLGKVLPYFQIQVLKNQEYQPWDIIYEVPHSLFSIFWVDINKLKEKLNNEDYFNFVISAIAYHHWRENFDEFISRENEIFIKLCKKVINEWGESLQNNLVEEYKKISNFDEYKDLIALNEKWLKSIINGRSFLNLAIPPYKFDYEPLRREIKKEWILIAGFLQRCDHFASWCEEEGEEKELNKVEIDQKDENKIKSIISAKIGDNAWQFKTLDNKMDKNIILIAPTGYGKTEFAFLWSNGSKFFYTLPLRSAVNNTYERTKEVYGEDNTGILHSDADIYLLNKVSDEIGTVRVYELAKQLSHPAIISTGDQFFPYALRPPGFEKIFATLSYSKLIIDEIQAYDPKACAIITKFIEWLYKMGGRFLLMTATIPKFIENSIKTSIPNFNEDVEIVNIYEEEKKAYEKFFKHKLRFDLIKFTKESSTSDFRLPEEKINEILKKAESGKRALVILNTVAFAQKVYEELTKKASENLKNNIFLLHSRFTLKDREKKENKYIKEFSNPKPVDEKIGKILVATQVVEASLDIDADVLFTEICPLDALVQRMGRILRRYFYRDNKVINKSNNKRYDLSAGFKAFEEESNDEPNVYVLVFEEKLQSGESRVYDKELIKLSLAWLWNEYQGKDLEILLSEVSQLNPNAEDYDTRIGEKIFQKEFIDLLESISQESGKKGKKGKQKKDVYDIIVENNDWLSKIDKMEIELTEYKKYVLVSLFYSTLRRSGSYLKKFFDTLTILEAGWMSEKKSEAENLFREIYSIQVIPQDKVEKFKEDILSFIEEEKKSPGEKKLLYTRFKKEILSKYVVSQPPEKELVSIVKKLNVRLDKSWENRLKRWLFDIYICSHKYDENLGLLKNENEIENGIL

SEQ ID NO: 11778 - protein, 777 aa, Caldicellulosiruptor hydrothermalis 108
MKIDSYKGIELYAKRFKNDKGSEYQTIYQHTMDLLNNMEKLFEEYKEEIEEGCKRLQIDYQKLKYLLRLAIIYHDLGKANSKFQQKIRDKTKVHEVPQVKGLSKEVPHNFISIAFVDLEDEIEKGNITCDDFQNLLFAIAFSHDRSFDFSSQYFEKYMNDDVSKYIENQSLKPLLELLPSVPDRDKVVESSNYTYRVINQLRELMFKDSYDLSDKKVIFRIFLKGLLHRLDHSSSAGISAEEAKINNFPEKVEVYLKSKCSFTGFKDFQRKAMEFSEKNVILFAPTGSGKTEFGLNWAFKSKLIYTLPIRVSINAMYERLAKIFGEDKVGILHSDSMIYLLEKYLNLERENQELEALFDSVDLAKNLSLPIIVTTGDQIFTSALKWPGFEKVYSLFLYSKIIIDEPQSYSPESLAIIIKTLEEIINLNGKFCLMSATINPLILKHLGDCAKYVQAYSDEELKKRYSHIISIKELSILDCIEEIVEYAKQKNVLVICNTVKRSQEVYQVIKENLKRFEEIPVELLHSRFLEGQKRQKEEIVISNQRKNGIVISTQLVEASLDIDYDILFTELASADSLLQRMGRVYRKRPYNELRPNVIILSKGPSGVGKIYQKEIVDRTEVFLKKFDGNKITEYDKKELNEYVYDIGALSGTNFISKFKKAYELLELGFRADRKIEAQKIFRDVVTISGIPREIFDKNIEKINEALKKINSRSIKSIEKLELISSIRKYTVTAPAYFFAKGGASCYDKDLGLYILDCEYDDQLGLIPPKGLEQSDIW

SEQ ID NO: 11779 - protein, 819 aa, Halanaerobium hydrogeniformans
MLYSHPEKFLIDHLNNVYMLGKEIFARKKLNFANLAEIEKALSIILLTHDFGKATDYFQIKLEKSSFGNKLSNKEGEFNQELSKHSHISSLLAYQFADQILEDDILVWIVFITVYRHHSNFKDLDNMLKFDESDWPKLRKQFEALDFNELDSISVEISDFDFKPSSIDFDDLKNKFTNWRFRKNLRTFKNKPNKDFNYYLISNLLFSILIFADKAEAIFYSKGYSFKDLKEVALNRSDLPDDLVNNYRNLKGWNQPDSKINIKRNQIYDEVVNQIENINIENERILSINVPTGAGKTLSVFSAALKLRNKISQDFRIIYALPFTSIIDQNYDVFLDVLNHSDMKVDSTKIIKHHYLNAKNYYLNEEDKESQKLDYDISKHLIESWQSEIVVTTFVQLLHSIFSNRNRSLIKFNNICNSIIILDEVQNIPHKYWKLIKEFLSDMAKKLNCYFIFLTATMPLIYNEKEQEIKELATSKRDYFKFFDRINLDTTMFKQPLTLEQFKDFIEEEFIEFYDRSFLIILNTIKSSIHIFNYIEKLINEEIINGELIYLSSNIIPKERQKRIKKIGKKKRQIIVSTQMVEAGVDIDLDRVYRDFAPLDSINQSCGRCNRNFDPENRGTVKLFRLVNENHNNKDYASYIYDNFLLKITSDIITELPEIVRENDFFEMNQKYFNKINELKSNDNSETLISKIKNLKYEKSFFKDEKEEIFRLITDDYNTVNLFMAVDEDAEELWEEYKEISGLESYNIEEFMLKKAKFENIKKEFLSYVITIPKFTAEKHLGDEQLKNNFNYISPFQIEDVYNLNTGFKRREIETETFF

SEQ ID NO: 11780 - protein, 777 aa, Caldicellulosiruptor kristjanssonii I77R1B
MKIDSYKNIELYAKRFKNDKGSKYQTIYQHTMDLLNNMEKLFEEYKEEIKEGCKRLQIDYQKLKYLLRLAIIYHDLGKANSKFQQKIRDKTKVHEVPQVKGLSKEVPHNFISIVFVNLEDEIEKGNITCEDFQNLLFAIAFSHDRDFDVNFQYFNKYICEDVSKYIENQTLKPLLELLPSVPDRDKVVESSNYTYRVINQLRELMFKDSYDLSDKKVIFRIFLKGLLHRIDHSSSAGISAEEAKINNFPEKVEVYLKSKCSFTGFKDFQRKAMELSEKNVILFAPTGSGKTEFGLNWAFKSKLIYTLPIRVSINAMYERLAKIFGEDKVGILHSDSMIYLLEKYLNLECENQELEALFDSVDLAKNLSLPIIVTTGDQIFTSALKWPGFEKIYSLFLYSKIIIDEPQSYSPESLAIIIKTLEEIINLNGKFCLMSATINPLILKHLGEWAEYLQAYSDEELKKRYSHIISIKELSILDCVDEIVEHAKQKNVLVICNTVKRSQEVYQVIKENLKRFGEIPVELLHSRFLEGQKRQKEQVVISNHRKNGIVISTQLVEASLDIDYDILFTELASADSLLQRMGRVYRKRPYNELCPNVIILTKDPSGIGKVYQKEIVDRTEEFLKKFDENKITEYDKKELNEYVYDIDALSSTNFISKFKKAYELLELGFRADRKIEAQKIFRDVVTISGIPREIFNKNIEEISEALKKINSRSKRSIEKLKLISSIRKYTVTAPAYFFAKGGASCYNKDLGIYILDCEYDDQLGLIPPKGLEQSDIW

SEQ ID NO: 11781 - protein, 822 aa, Caldicellulosiruptor kristjanssonii I77R1B
MEKTSFCFDSKNLSGLFSHPGKDGGIEGAKPLEVHLANTSILANSFASEKNIALCSTKFLSQIAKITALLHDIGKATSFFQKYLFDKKKTKSRHTRHSLISAICVWGTLNRLIEEKKIQEDKTFEGFTAILAFFATLKHHGDLEATSDMLLLSEDDIELCYEQIENIDKEKFNTLILNISCLCPEIGFLTIDSLREFVDHAKVSIKLFKRAFRKLFDTEMKFFFMLNLLYSILLDADKTEAIFGTLVDIPELNLSYTDVDSFRRRIFKPENFENSIKALRDSAFEEAINCEIDENRRIYTLCLPTGLGKTIISFAFALKLRELAQKRFGSKFRIIYSLPFLSIIEQNYDVISKILSFCGLDITSDILLKHHHLSDIVYKTKDGLQNNQEEIFDTDIAKLLIEGWNSNIIVTTFVQFLESIMTNKNSNMRKFHRIANSIIILDEVQAINSEYWFLCKNLFEKMCSSLNCFIILSTATMPFIVDKKTAVEIVKPEKYFDKLCRTVLHFDNNFSKIGLEEFVAKFEFEKEKTYLFVMNTVSSAKKLYELINQRFPDMQDEITILTTHIIPKERLRRIEQIKNKKYKIVVSTQLVEAGVDVDFDHVVRDIAPLDSIIQAAGRANREGKKGKSKVTVIELVSDRGRLFATEVYDSLLIDATKKILSQFQKVDESKFAELIFEYYKELARRGVIETSSDDKGTSQKFLEAIYRLLYTSSDSETDAIGSFKLIEDEPYKVDVFVEADEEAKIIWQRFEEICEIKDFFERKKKFLEIRKSFYDYIISVPKTTNLPVNFENLIFRIPHSQLSDFYDPITGFKTKGESYLSF

SEQ ID NO: 11782 - protein, 912 aa, Caldicellulosiruptor kronotskyensis 2002
MSEIWAKSVDEKNNKIVTLSDHVSDVLKVFNFFKKKFSDNQFILNATEVAIFLHDLGKVLPSFQIKALGNIEYYPRDVIYEIPHSLFSVFWINIDKLKEKFDSEEYLNYIISAIAYHHWRDNFDEIISLENKQLKQVCEKVIHEWKDELKENLAKEFGKLSNYDGYKELINVNMTWLKAILNHRLFVNLVVPPYKFDYHPLRGEVKKEWIFISGILQRCDHFASWCEEEGAEEELENVEIDAPEKEYVAKTISSKIGDNAWQFKELEKCSEKNVILIAPTGYGKTEFAFLWSSGEKLFYTLPLRASVNNTFERAKNVFGCDKTGLLHSDADIYLLDKNSDETGSIKLYELSKQLSYPVIISTGDQFFPYALRPPGFEKIFVSLSYSRIAVDEIQAYSPKACAIIAKFMEWVYKMGGKFLLMTATMPKFVMDYLKDVIPDFYDNVNTINIYEEEKDAFSKLYKHKIKLNLIKIENEQFDIPDEIIREILQKANNNKRVLIILNTVGFAQSVYDKLKNSADGQLKERIFLIHSRFTLKDRESKEFDYINNEFKNPKTENIGKILVATQVVEASLDIDADFLYTEICPLDCLVQRMGRILRRYIYQNNEVVNKSNDEKLKLDYPFRAFEKEYHNEPNVNVLIFDSNNLQSGGQRVYTKELINLSLAWLWKARYNQSNLGSLLDKTFQQEFDDDGIEEFFREEFADLILVQKNNKNKGKKDKGKNKESVYNSLLFSHDWLAKLDQLEIELSEYDKYILVTLFYSTMKKKGRYLKDFYNTLIVLDSGLMSDKKSEAEEIFREIYSVQIIPKNKFEEFKKDIQEFIKTIEQGKENKRMLFTQFKRGVLSKYIVMHFCSKDLESVYNKLTIEIEMDSKWKRRLKRWLSGVYLNNDFVYNNEKGLIKAEEEKSIEDSFIL

SEQ ID NO: 11783 - protein, 768 aa, Calditerrivibrio nitroreducens DSM 19672
MCGLIKEDEIEKCLAKSDKTTIETHNKSIYENLNILKERISINDDALLENLKKVIKYHDYGKANLKFQQKLEKRKSEEILFHHLISPLFYLISNSNSTLKDEDKINIYAIIRHHNRQLELIESLKLDFIDNSLRKALKAVFEDIKDLINIPKNDYDKYINAYLTALISSDYLKQKYFKNLVLTTGFLIRLDHAASGGLEVEEKPITEDRKELLKRALGITDFRPFQKKFGIERKQNYQAIVADTGMGKTGLSVLWSNRKKFYILPNRASVNAMYETLKHIYGENKVGLLHSTSLFNLLENYEDDMSVLKQFDQTRVLSKPVTVCTADQLFTAAFNMPGYEKIYATLSYSDVVIDEIQGFQPQQIIPMLKQIKETKELGTRYLIITATLPDIIAKRLNEYGFCVIDNDIDTVDNIKRHKIRIENKKIEDLSDEILQKFKTNKKILIVTNTVKKAQELYQSLLTNMLLTEKEKHRINILHSRFIWKDRQEKEKNVLDETKQDGDGVYINKDGCIWVCTQLVEASLDIDFDYLFTEAATADSLIQRMGRVWRHRKKDYKGDENIIIATDVEYKVYEKILVEKSVELIQEAIIENSNYLYSKNKREIVKILYSEEKLTEWGSKYLDEWKKFENAINSGWNFILEENAQKAFRDVMTIELIPSNFKDEVIDIYNSFKDFINQINSDANISDRGKKTQKRLEKLKKLKSIQEYKVPVPIYLVNPNVSSKKINCSKPIEWLDKDYAIGFLHENYEYNKVLGLTGKSLALEEDNIL

SEQ ID NO: 11784 - protein, 758 aa, Thermococcus barophilus MP
MSEIERRFRQVTGFTPYDFQKEAIEYLLDGYSLIVRAPTGAGKSEMVLIPFISELNESLPSQLIYSLPNRTLVESLGNRAKRYASFKKLRVAVHHGKRVESRLFEEDIIITTIDQTAGAYLSVPLSMPKKWGNIFVGGVASSMLVFDEVHTLHPEKGLLTSVAMSIESSKLGFPFVMMSATLPESFMEKVKKMAEKKGGKVNIISVDDENEIASRKARKIYLDTSPLYSKTSLTAEEVLKHLEDSKNLLIVVNTVSKAQKLYLDLKDKIDVPLLLLHSRFLEEDRQAKERTVLEIFGKKQREGILITTQVIEVGMDISSSKLLTEISPIDSLIQRAGRVARWGGEGEVIVYDVEKKPGKPYAPYSEELVEPTIQALKGVELLNWQAEVMLVDKVLSKPFENYLDPYKFYERLGGLVRAVYEGKRAYVEENVREAYSVEIALYENVEELKGEPEKAFALKRLRVDFRVLAGKFNYLQEIGAKIYRVEENPLIDEYESKYELVEVQSKEDIMPFEFYIISGISYSPEVGLLFDKSGEIKSFEFEEKEHLFKLELKELRRETWVEHSLKTLDFLRTYMLPRYAYPIKTFAKYFGISKKDLISWIELSVALHDLGKLNYYWQKAAGWQKGEEPIAHGFERIKKLPPHATVSAKALEPYLMEQFDEEGLFKAFYLAIAHHHSPWSSKYQKFKLIEDAQEYIFSIYPIPDDLILRKSPSGSFPFKLNIDDENEYYRLYGLVSKLLRISDRLATGGESYESIFSS

SEQ ID NO: 11785 - protein, 782 aa, Ruminococcus albus 7 = DSM 20455
MYTAHIRENDKVIQTVSEHSQNTALLAERFLTSSNIGSVGYLCGLLHDAGKLLKDFDDYINKRNKMTRGSIDHAYAGAKYLISIASKDKANIAAISMAHTIVSHHGIHDWIDNDNYDYFSKRISYDKGYDEILNNLNEIIGDININDLFEKATKEWFDVAKMIRGFSKTKEEKEEKIDNTKFYFYLGMLERLIQSALIDADRTDTADFMSGVESAEETDTSLLWEQMDSRMNEKLKSFENKTDAISLQRRSISDRCAAFADHKVGVCRLIVPTGGGKTLSSLRFAIKQCKNYGMKKIFYIAPFMSILEQNSDIIGELSGEEDFLEHHSNIISDIDNENELEKYLLYSERWTKPVIATTMVQFLNTLFSAKTSSVRRMHCLCNSVIIIDEVQSVPLKCTHLFSLAVNFLTKICGCSVVLCSATQPTFERNEHSLMRDERADMIENYAEDFEVFKRTEMIPAMQKYGYDIEEATLLCEQKFEENGNLLLIVNTKKQAREMYTRLKDKLGEKAHIIHLSTNMCPAHRKESIDDLKEKLEHGVPVVCVTTQLIEAGVDISFSCVVRALAGLDNAAQAAGRCNRNGEKGRICPVYLINFKNEPLGNLTEIKTAQDISQHVIRNNENADLLSVDIQSSYFEQLFSQNKEKLDYPANGTTLLELLSTNKGKAEAHDLKPDMLLQAFKTAGNIFEVIDSHTENVIVPYNDEAESFISRLNDDLTPQEAAEILRKAQKYTVSVYMGTKKALEEKGAIHITKNNNIIVLDKRFYNSEFGITTEGAERETLMY

SEQ ID NO: 11786 - protein, 814 aa, Ethanoligenens harbinense YUAN-3
MEILARRDPKTGRTQTLRAHTLAVADACETACAKIGLGALGRLTGLLHDSGKGADAFQTYLAEADPSKRGTVNHAACGARYAFEHFLTDDVPANIAAEWVIAAVCGHHGGLPDCTGSAGEDILRQRAYPQKECACGQALARFFKTCTLPEELSALFMRAVQETAQICGKTQAFCADLPGTSGYVQLWFMLGMIQRYLMSSLVDADRYDAYGFEAGAAPAKESDPTPLWETLAARLEAHLADLAEKAAEHPETAHINRKRREIADACLAFSEHSAGIFRLVVPTGGGKTYSSLRYALHCAAKAGKRRIFYVAPYKTILEQNAADIRDVLQQDDAVLEHHSDVVLDRNGSSSSREELERYELLTERWDAPVVLTTTVQFLNTLFDGRLSSVRRMHSLAGSVIILDEVQAMPVRCLHLFNAAANFLSCVMDCAVILCTATQPALENTTHPIRLRAQSDMVPDMDAVFAAFRRVRVEDKTRQGALGADQLADFAFSRAKQDGSLLAVLNTKSAAAKLCAALRARMNTLPDGEQIPVYFLSTSLCPAHRKDVIDEIRTRLKKHERLICVSTQLIEAGVDLSFACVIRSLAGLDSIAQAAGRCNRHGEAALRTVYIMQCADEDLRHLPDILAGQSAAKLVLEGFARAPQRYGGDLLSPDAIRQYYAFYFEMQKSQLDYPVALDRPTSLFDLLSVHTLARSACEENGRALPQHPLHQAYATAGSRFQVIDRQGIAVVAPYGDGEALIARLCGKPDLAALPALLRRTQRYAVNLFEQERRALETQGAIIYLPDCGVAVLREHFYDKTLGVQTRRHAMDTLIV

SEQ ID NO: 11787 - protein, 772 aa, Rhodopseudomonas palustris DX-1
MHFAHSTPTSEDDWEPLPRHLHEVAKLARQFGAKFGGGNAAEIAGRLHDLGKYSAAFQHYLRGQRPRGVDHATAGAQEVVKLGTGINGLIARLLACGIAGHHGGLPDPLGAGSLDDRLKKSVEPLDPIWRSEVACEASPLMPAPFELYKGAQQPGPPRQAFQFAFLGRMLFSCLVDADFLCTEAFYAAVEGRPVDRDWPRLPQIVDGLIARFDGYMADKQQRARHGQLNTLRRDILAHVRSKAELPRGVFTLNVPTGGGKTLASLAFALNHAKRHQMDRIIYAIPFTAIIEQTAGVFRDAIGDETLLEHHSAIELDALDIKADNGEARGIDDGARDGKLRLAAENWAAPVIVTTNVQLFESLFANRTSRCRKLHNLANAVIVLDEAQTIPRNVLLPCIAALDELARNYGCTVVLCTATQPALGADRFTGGLQLSPDSELAPNPEQLHTALRRTTQRLAGEWSDDQLLDDIAQSGSAQALVIVNSRRHARALYEAGKRRAVEGLLHLTTRQIPADRRAILAEIRQRLANDAPCVVIATSLVEAGVDLDFPRVWRAEAGLDQLAQAAGRCNREGRAPADVSIVTIFKPAAAEPPPEIHGLVGDTYRILENHEGDLFSPEAMEAYFNEVYWRLQDGLDRIHIPDADGRKVPAKTMDQFTVSAGQPHFAYRTVGEAFRLIESGMAPVIVPTDAEALDTLAALRGGLPPVVAARRLRHYLVQVPPRERERMIANGHVRYFTAERFGEQFAVLETASLYSAEIGLRWEDADEFTWAIV

SEQ ID NO: 11788 - protein, 1037 aa, Thermaerobacter marianensis DSM 12885
MGDPWTGGGRGWIPLEQCVARPPEGGRRYPLIDHLLEVARRAGDPRGTPEEQLLYLAGLLHDAGKARRTWQERLLAPGRQGPVGPHAFVGAALFAGLAFQWLRRRGPGRPSLRSLAGRPFPSLLPAGLRAGVPASGPEPISPAPPASPVPGRPEPVLSERQVLVVSRDIADHHGTLGDLETEPPWFGYWTPAILAEMDVNGLLRLVRSTDLAVAGGLWPADAADWGRWVDAARSAWGRAVVRLQGRLEAGQADPARIDAGELLRSTTARLIQADRFAVAGLQPEALTPAQAEAAIGRMERSLGAQVPVDEHRAEDGGGIGAGPADCGSGGANGEAMREGRADSRTGSQAVTATQPPGTGVAEAGVSSAGSHAGRHPFDVSGERQRLQAEVLRRYRSVPDAPVYTLVLPTGSGKTLTAMRVALEACLRNGRQRIVYVGPYLTVVEQAAAQFEQHTGLAVLQHHHLATPEAAPRRTAGGRPGVHQGAGESDREAATGPSATPATGAPSPADPLPSEEDRAFLVMESWQAPVVAVTFNQFFRALFPVRAQHALRIPALGRAFVILDEPQIIDPTSWALLTEMMVAACQWWDMQVLVMTATMPPWPPRRVRPHNLSVPVRLPSRYVLEVVDHRTAGERDGPERPGWDAEALAARLVDDALAGYRVAAILNTIADAQVVYDAVQQRLATLRGLSGADREFEPGVVRDGNPPEASDEAGRGRWDRAGRTVRAGPSEPARWDRGEAGSDSVLLVHGLMTPAHKAIQIRKLRQWLDPALGGSTGRPAAGAAPIAVATQALEAGVDLDFDRLYRARPVLPSVVQAAGRANRHGRRSAARVIVFDYVRPDGKDSRPWIYRDAIARDETDRFLTPGGTWTERELDRAVEDFYRRWWERKPGHDAAGPLAAAAAGAWSAVAGLMPFDEGPPRIPVFVPIDELLLEEDRAALAVWQAATLEDLYRLYLRPGWLAGRSQGERRRFLGLLERYVVPVPFELARQVAESHPGRRILRLVDLDAYDRTCGFGPWRQAATTRAGDGEVTALVDIW

SEQ ID NO: 11789 - protein, 750 aa, Hungateiclostridium thermocellum DSM 1313; identical to SEQ ID NO: 11589

SEQ ID NO: 11790 - protein, 747 aa, Thermovibrio ammonificans HB-1
MFLAKKFPDGTEQTISEHTEELIERLKSLRKLYGKKIGADEEFWEALLLAAAFHDIGKASSQFQLKIKEGKRVGKPGEIPHNYLSAALFAGKLTKNRLKEAVFYSVAFHHHHRPFNFRPEEFKEALLKDLKKKEEKLKAILSELLEKGGRKEPPPLRVPKEREIEVIFTKLDSYRKRRRNFRELMKRFRGREAQVILLKGLLHRLDHSASAGIPVEIEPHTDRIEKLERYLKERSKARGVEFKGFKPFQLEGRKLKEESVILEAPTGSGKTEFALNWLSDDKGFYTLPVKTAVNAMFNRLKGAFKTVGLLHGERAVYYLLEGVEEKEELSFSLTQLSLSTHLSFPLTVSTADQLFSSVFKYPGFEKVYATLAYSKTVIDEPQGYTPKTLAAMVKGIEEVSELGGKFCVMSATLYPFVKDRLKRLGFKEVNTEELYRESPEKHRVKLLEEFSLQTLLEAQNNKRSVLIVVNTVKRAVRLYLELKEEGLPVRLLHSQFIQLDRKKLEAQIEKEARKGLPVVWITTQVAEASLDVDFDVLITEIAPLDALVQRMGRVNRRAKAAPPEFTNVFILRENSDKSGRVYSRALVELALEGVERWSGELVGEPAKRELVGELYTRKNLELRAPKFLREFEENLSLLDVGLQADSRSQAQEFFREVTTVPVIPEELFTEKEEEILSLIETLKRRNCPLKERLKAQARLKSFTVNLFPYQFRSFLPLGEGVIVAKGVRYSRELGAITDEHGDTGEFV

SEQ ID NO: 11791 - protein, 734 aa, Alicycliphilus denitrificans BC
MASKSSSFHLLDERIQRFIWAEGWEELRDAQEKAIPLIVKGEQDVIISAATAAGKTEAAFFPALTHLLATDGDGLIVYVSPLKALINDQFGRLERLCAQLEIPVWPWHGDVSASVKTRFLAKRRGVLLITPESLEALLCNRGSSVGAVFERVTFFVVDELHAFIGSERGKQLQSLMHRIERALDRKVPRIGLSATLGDMRLAGQFLRPDAEPAQVNSAAAGSELKVLVKGYEEPLAVKSERDDEGESEPVTPGQVAAHLFKVLRGANNLVFPNSRRQVEQFTHLLNKMCERERVPNEFWPHHGSLSKEIRAETEAALKQKELPATALCTNTLELGIDIGAVKSVAQIGPPPSVASLRQRLGRSGRRKGEPAILRGYCIEDALGPRASLRDKLRLDTVQTAAMISLLVDKWFEPPRVQGVHLSTLVQQLLSAIAQRGGVMAGEAYGLLCGPGAPFTGLSKQEFVDLLRHLGHKELLTQDSSGALLHGRVGEKFVNHYSFYAAFASEEEFRVVAGGKTLGTLPVDQMLLPGQRILFAGRTWHVDEVDEQQKAIYVTRAPGGAPPMFSGGVGRTHTRVRQRMRELLEGTSSPPFLDAGAQRFLTQARTAYSHLRLASEFALDQGKELMLMTWLGDAANEAVACLLISRGFVAFPSGPGVEVVKGERSTQGILDALADIAAADMPLLDILLADVKNLAREKWDWALPDALLRKAYASLYLDLDEGLAWVRQVTGGRQS

SEQ ID NO: 11792 - protein, 715 aa, Bacteroides helcogenes P 36-108
MNIMKQSKYKYIAHSENSNGEEQSMKQHSEGVAELMKSFALSDDFAEIYSYCGLLHDIGKYSKGFQNYIRSRGEKEPHAKWGAYMARMNKNVAFSVIGHHAGLPNRDMLFKTLEQCAKDENRYNQIHQAMEEDGVIISICENSSFNKIGDVFQKELFTRLLYSALVDADSLDTERHFHKEQYDARSCKILDVDTLLAALNKRFDSFKQVTSLNELRTNVRLYAQSLANTTQGCFSMTLPTGMGKTLTSLSWALYHAKAHPNIKRIVIVLPFISIIDQTANELKTIFKDYDVILEHHSNVIYEGANEEESYCRDSKYLATENWDYPIVITTAVQFFESLFSNQRSKCRKLHNLQDSIVIFDEIQTLPVNLAECTMKMLNDMLHLCRCSFLFCTATQPNFQTRKDFCGIDHITPLVENPASVFTSTKRVKYISIDDYKAQSFESIANCVVEQNDSALIVCNTKKKAMALFDKLKEKSEIPVLHLSTNMCQIHRMEVINEVRQNLKDGKKLILCSTQLIEAGVDMDFPVVFRELAPLESIIQSAGRCNRESKLKEGQVYLFQLEDEGQPSRQYETFAQYAQLCYRNNENRLTDADFYSDYYSKIIELYAAEDAITPERKKLKFQEVAEKYHIINSNTTTFFIYRYDNESLHLYNEIKDKEYLSRKDYQKIAQYSVQVYDRSKDNNDDKNKRPSNGIKIWFGAYSKEIGINNEDEIYYI

SEQ ID NO: 11793 - protein, 725 aa, Nitratifractor salsuginis DSM 16511
MSISSEVYLSHPDKPYTQHIRNMFDANDIPLERSVKLYHDIAKLKSSFQYYIRHPGESVKDKNHTLLSGYIFLLNNDFETKEMLFGFLSIVSHHSRVIDLFDLREDNRYIGRYCCNSAELQFLDEVIEHAKVTGLYPPLNADVADLEQKSETYRKFLRKASFQTSFVYGDFIAFKKLFASLIYSDKFEAIFSIPKEPKRMIPENVLAEYIRRLPYHEKRDRFRKHVLESFDKERRLFRLTAPTGYGKTLTALQFALQFEKEKIIFALPFTSIIDQTYSVISDIFKDTEIDIFKIHHKTVIDEEHDEDRYSKVKFLMSSFSGEINVTTLYQIIFAMFGNSNKDNVKFNQFKNSVVIIDEAQSIPYRLRKDFIALTRKISETMNTVFIFMSATMPVVGDEFLEISDLSYFHDQNRYRLKWLNLPNGEETLKDMIAHAAQTKHTLCVVNTIQKAQELYLWFRGDFECYALNGYMTDTDKQRVIAAVAKRLEQNEEKILLISTQSIEAGVDLDFDIGFREVAPISSIIQTAGRVNRNFKKEQATLYVFEEISGYTDLIYGDLQLISKTIFSLLQERDIPESDILEVSDLYFQKLHSQLESALIDEEIKRLAFAAINQKIEEVMDGGNYKRLVIVEPYEGYVKKIEQQLLELRSSHLDKFVLKDQVEKVVKELSRFGVNVSLKDIERFTTRLNSIRTLPNMIYLPFGAPEYSKEYGVRKVGMESAENIFD

SEQ ID NO: 11794 - protein, 590 aa, Desulfurococcus mucosus DSM 2162
MRKLISDFLYAFDFNAPGLAVLKLPTGYGKTELFMELAKRTCMGKIARAIYASPLRALNEDLYYKLEERGYCVVHQRARQYMERSESPFFHRKVVVTTIDTLGFSVYKVPTAEMSDIVEGYVMKDERTRGHFSIPRANISDSVVLIDEPHLAFTESGLERLLLGILQYLLASKATVILASATLTDLMLRKIDYIKRRVEDKIGVKLQYEKCIYAKECSFSSNTRDEEFDQVQAKKNVEMEIHTSKQLIDKVLELIASRDATRKLIVLNSPREAIKVYRKIQEQNIEGTGEVFMLHGLLSRNDREETTRKLLENKNKPFTLVATQVVEAGLDVSADLLITDLAPIQSLVQRMGRVSRWDQDESGRIEIVVDEHKMNNSEDYGPYGKDLVDSALKALSEIKGSLKPKIPASMEGFKGYMDLVDYAESILAPRYEEPALSLGKLLSLSSEPQEQIVFDFLSGRIGRNAVTIQGFILDADGSKVVENKNVEPGQLESMDKLMLPVWLLERLLDSDDGKSITVIVEEKGSIVIREKGLDKLRDIIRRSKKGGAGTHKHYDVFKLNYSLINENIKGVLVPRSLYNKIAREGVDYGE

SEQ ID NO: 11795 - protein, 784 aa, Thermoanaerobacter brockii subsp. finnii Ako-1; identical to SEQ ID NO: 11627

SEQ ID NO: 11796 - protein, 738 aa, Desulfobulbus propionicus DSM 2032
MNHHDTLVPVAHSKSPSDWQSLEAHLEKVAELAEQHAMAFGAASWGRLVGLWHDLGKFSPDFQEYIRQASEAHLESKQGRVNHSSAGALLAIERFGKIGRILAYCIMGHHAGLPDWQSEIAPRASLAWRLEQKELLPTAIEAGIPTAILNQALPTEKAKNGTGLSRSLWLRMLFSSLVDADFLDTEAFMDPEKARRRQGYPTPTELAPLFDRYMTEKTAGAPFTKVNRIRAEVLQACREKAADSSGLFTLTVPTGGGKTLSSLAFSLCHATFHGKRRIIYVIPYTSIIEQTADQFRAIFGEAVLEHHSNLDVADVSKEDARSRLACENWDAPLIVTTTVQFFESLFASRTSRCRKLHNIAQSVVILDEAQLLPTDFLKPVLEVMRELQENYGVTFVLSTATQPALGPHKSMDFDFAGLPGLREIIPPSLNLYERLQRTRVKTLEGLTTSLPWDALASRLSSHESVLCIVNRRDDARVLWEKMPVGTFHLSALMCGAHRSERIAEIKANLKAEKPTRVVSTQLVEAGVDLDFPVVYRALAGLDSVAQAAGRCNREGALEQGMVYIFQPESKIPAGYLRQAAEIGRQLLMEQKVDPLAPERFEQYFRMFYWLRGSLLDKENILELLGNDPELRISFRTAAEKFKLIDEGVYVPVLVQYGEKGCQLIDLLRRQGPERWILRQAQRYVVNLPRSVHGQLLIDGAIEEIHPGIFVQGHGNLYDRNLGFCADRSLIYAPDELMI

SEQ ID NO: 11797 - protein, 927 aa, Thermus scotoductus SA-01
MEVQTQALTLWAKSGDPFHPLLAHMLDTAAVAWAILEREPGRTRKLYATDWNLGEKEALPWVAFLAGLHDLGKASPVFQAAWDEGAKQVWDAGLTWDEELVREQWVAHGVFTELYVKDVLKRHGLPLRLADPLAKGLGAHHGFLAQGEELKTARLHVKSEASTWQEVRDHLALRLAQSLGLNLPLVLPVEDAEAPAILRVMALASFADWIASDPRFFPYGRDPEALEYWQDALELARKALEDLPWPRVSPRGVRRFEELFPFSPNPLQSSVPELLEKTPGDSVLLLVEAPMGLGKTEAALYASHLLRERLDHRGLYVALPTQATANGLFNRIREFLERLSGGERWELQLQHGAALLNPQYAELLERARPMEVYDIELERNPGQESGGVAASTWFSAKKRAMLAGHGVGTLDQALLGVLKVKHHFIRLWGLMNRVVVLDEVHAYDTYTSGLLKSLLLWLRALGSSVILMTATLPKKKREELLSAWGVGGVELPPYPRVAAFSGGGLLGARHVPLEEKTLHLQGAPTEVSQVAEALKEQLPGALGALVNTVDRAQALYQALGEGERLTLDELLDSFGAGPNQGAWPGLWEIREEKGRWVVGKRLKDGTLVFLLHARFPAEERALREAVTLALFGKHGPRPEKAILVATQVAEQSLDLDFDLLYSDLAPVDLLFQRAGRLHRHTRKRPEGHQTPVLLVGGLTDEPEFGRELHWNRVYEDYVLLSTWLALQGRETVKVPADLEGLLEEVYERLPEGFPDSLRDRARKSYQNLIDRLQKDASMAGNLSLAELDRLLSQLDASALASDFRLDDEEENASTQRFLTRLGEPSVSVVPLYRRGEEWFLDADGRRPAKMKGDLGKEDVLALWSRAVRLSRFPIPQTLLGEKPPSAWAKSGLLRGLRPLEVERVFAREDSVLKVVVDEELGVVYVDV

SEQ ID NO: 11798 - protein, 835 aa, Acidovorax avenae subsp. avenae ATCC 19860
MTCVREIPQEHRLRMTGTHPLRTMAAEAPHPAWPGRTEPRQAIERELLLKDDTQGSGHASAPADDAAAPHAPPGAPSTTPAFHAHSVEGQPESRWQTLPEHLHAVGRMAGDFAAVFNAQELAQVMGWLHDLGKYTLPFQARLRGSPLRVDHSTWGARIAQQRLGVMGQLMAYGIAGHHAGLANGQGEGERTALSDRIASTDLPALHPAWEKDIPLPARLALPAGLKLYGQDRQQALARQPFQMAFLARMLFSCLVDADFIDTERFYLQARGGPDHRSAGPAWPALPALRAQLDTYLRTLTAECDPAREVNRLRADILRQVRERAECAPGLFSLTVPTGGGKTLASLAFALDHAIRHGLQRVIFVIPFTSIVEQNAAVFRKALGPLGDAAVLEHHSAFTERQPPRDDPEKYQSAEKLRLAMENWDAPIVVTTAVQFFESLFAARPSQCRKLHHIAGSVVVLDEAQTMPLKLLKPCVATIDELARNYRTSVVLCTATQPVLEAPAFDGGLTGVRELAPEPTRLFQQLERVRVRHVGTLDDAALAGHMRAREQVLCIVNNRRHARAVYEAMADLPGARHLTTLMCAKHRSEVLDEVRQMLKAGQPCRVVSTSLIEAGVDVDFPTVLRAEAGLDSIAQAAGRCNREGLRNIDASEVLVFANANEEWAPPPELKQYAQAAREVLRQCADDPLSPEAIARYFALLYWQKGSDQLDVPDLMGLLKTRRPDSLPMETLATKFRMIDSVQMPVIVPYDDAAREALEQLRFAEGSVGLARKLQPYVVQLPRQGFDALYQAGAIAPVRPDRWGEQFMQLVHPDIYSQRSGLRWDDPTFIRSERLHW

SEQ ID NO: 11799 - protein, 844 aa, Lactobacillus helveticus H10
MVGNFIGHTKKLKNNTIETQSLRDHLLNTQKYAEKYASDLSLEHVAGLAGILHDLGKYQSKFQEYIIESTRKGDQSKKGSIDHSSFGAIFLRDFISENFSEKENYYDFLDFGGILENAIFSHHNYLGLKDYINPDLMSPFLNRIEKFKDDEEKKRQLKKCKELFYKDVITEEKFTKYFQLAFDEYEAFISKIRNKVTLKTEQILNENAKNNKQVMLELQAKYFLSEYVYSCLLDADRTDATAFKLSKNPNFSDNTELFEKYYSKLVGKLHKLNKNDNSKINQLRAEISEECDQAAERPSGIYTLSASTGSGKTLTSLRFGLKHAKLYHKKHIIYVLPYITIIEQNSEVIRKFLNDNKDDSQNILEFHSNVSQKVADKSEETTNALDLTEDSWDSPIIVTTMVQFLDSIFASGTKHRRRFHNLCDSIVIFDEVQKVPIKCLDMFNEAVNFLKNFGNTNVLLCTATQPALEEVKQKLDLNIDHEIIPNLIEHEQQFKRVEFIDKTQNDDGIDLVLNSIQAAELIFKKSQNFKSILGIFNTIDVTKKIYSNLKNKFDSISDQIKLEYLSTNMCPADRKERIKNVLNLVKEGKRVICISTPLIEAGVDASFECVFRSLSGLDSLVQAAGRCNRNNELKLGKVYLLNMDPSEEHIAKLNEVKTGKDQVLELLSEGIKADDFLNANVIKKYFEMFYSKLASTMSYPTNGINLENYIDGIKNVHELAYQSKRKDASKFEKLTQFSGSETIAKYFQVIKNNTKSVLAPYGDKGEKLIADLNGNQDINSLIMLVKDAQPYIVNLYDNKFNQLFEEGDIYTLCQVGNEVIYAFRPYAYNKLVLGDRKQIEKSIF

SEQ ID NO: 11800 - protein, 501 aa, Sulfolobus islandicus HVE10/4
MLSLADFYNDFITRHGFEERKGIEETLLNLENGHSVILKAPTGYGKTTLTMILANAVSSDINLGSRVIHVLPYRAIVQDLYLKLKNNADKGVIYTKSIGAQDMDYQDSPFFMKKVNVTTLDTFILNLFKLPTVDFKLIFKNYGSHYEFPRALIYSSIVIFDEFHLLGEDGKSLGAGLAALEVLRDAGVPIVVTSATIDKGLERVLMNKLGKNVKVVNANDFKIDRKIYVNVLENDEISITEVKVKEGKRVLLVYNTRMGAIEAYKKLKGRGLSPILIHSKFSKKDRIDKVNKINEAKLVVSTQVIEAGIDTSFDVLITEASPSHNLIQRAGRVARYGKGGRGKLEGEVYIFPFSGKVYDEREVKETVERVTKLKTIDENLLIERDYTEVIDSILAKDLSVIDNSVFVDSKKVKSIYEEICSITRNASIILGFPPNSNDVNDAIPLTEEEAIKIINSKGSSAFVGNGNVKLYNKKCLQLEMLKNDILGVRIQDYNSEIGGVY

SEQ ID NO: 11801 - protein, 501 aa, Sulfolobus islandicus REY15A
MLSLADFYNDFITRHGFEERKGIEETLLNLENGHSVILKAPTGYGKTTLTMILANAVSSDIDLGSRVIHVLPYRAIVQDLYLKLKNNADKGVIYTKSIGAQDMDYQDSPFFMKKVNVTTLDTFILNLFKLPTVDFKLIFKNYGSHYEFPRALIYSSIVIFDEFHLLGEDGKSLGAGLAALEVLRDAGVPIVVTSATIDKGLERVLMNKLGKNVKVVNANDFKIDRKIYVNVLENDEISITEVKVKEGKGVLLVYNTRMGAIEAYKKLKERGLSPILIHSKFSKKDRIDKVNKINEAKLVVSTQVIEAGIDTSFDVLITEASPSHNLIQRAGRVARYGKGGRGKLEGEVYIFPFSGKVYDEREVKETVEKVTKLKTIDENLLIERDYTEVIDSILAKDLSVIDNSVFVDSKKVKSIYEEICSITRNASIILGFPPNSNDVNDAIPLTEEEAIKIINSKGSSAFVGNGNVKLYNKKCLQLEMLKNDILGVRIQDYNSEIGGVY

SEQ ID NO: 11802 - protein, 930 aa, Vibrio phage ICP1_2005_A
MFIRIKCFSKQPIAKKVSREVSAYLEYTGNNTWEGHISGQGVSNLQTKLINVGKGVKVVCNYQDKVLFAIGNVAMSDTGSVPKYTTKKVYKPDDSIFTLKQGLVGVAALWHDLGKANSYFQRKLRGECNPSDPVRHEWVSGVIVSTFAKGNDWLSDDFIIPEVKHSDNVFGDDQVLNAVLWLINTHHKKGLVEDPIYRATKTMFTETLQCVNVNGGWFNYGDNIDECYKIDTSFITDTYVKQLNRYRKKLLATKHIWFTLGEDQKIAILQECRVALMLGDSNFSSDLIGGDGSHLYANLDECGNLKQTLTQHLLGVTDCALKALFTINHHKPVKANFIPTIAEKGEGKFAWQNGVNMVDSSIDNMFCINMASTGKGKTLANLKLLQHFGNVRCSFGLGMVSLTKQTAKQFLDMGVDYNSAAMVTGFSKSKVNLGSESLDQDEVSVEYWGQTSSLSKVFPNNNAGFKNKKLLSAPILVTTTDHLVKASGVKKGNKQMLPYVRCMHSDLVLDEIDDYGVEDMVVLARLVYLTACYGNKVIISSATITPAISNIFYKAYSSGYKVFCANKQTTYKGVNVVWWDEFGIKVETVNDQFSNLNTRFVNKRITNLLESTPKHKALVVDQDDNMEAVKQSITTLHNAHNSGGVSFGLIRTTTIKDCVAVTQELQNWETDLSIKILCYHSRFVGDTKAQMEEYLSKVLNRKNDEYKKFVDTTTPTAYIVVATPVVEVGRDFDFDWAIIEPSSERSIVQCAGRVLRHRSSIPTTHNIHILKYPFKFYRNSSICYDVAGYESKGYKLKSKNMLDIYKKESIVNSVNRLQGDAAFYTKSLTALEHKVLLDKLTVDIADTNVFVGGWQLTANPHEYCKWRRGTKNEDLVLTDGKWSSNVTTTKPILSKIWRKWQGENGSITVPEYLLEKTICYNDFYGGYESE

SEQ ID NO: 11803 - protein, 930 aa, Vibrio phage ICP1_2004_A
MFIRIKCFSKQPIAKKVSREVSAYLEYTGNNTWEGHISGQGVSNLQTKLINVGKGVKVVCNYQDKVLFAIGNVAMSDTGSVPKYTTKKVYKPDDSIFTLKQGLVGVAALWHDLGKANSYFQRKLRGECNPSDPVRHEWVSGVIVSTFAKGNDWLSDDFIIPEVKHSDNVFGDDQVLNAVLWLINTHHKKGLVEDPIYRATKTMFTETLQCVNVNGGWFNYGDNIDECYKIDTSFITDTYVKQLNRYRKKLLATKHIWFTLGEDQKIAILQECRVALMLGDSNFSSDLIGGDGSHLYANLDECGNLKQTLTQHLLGVTDCALKALFTINHHKPVKANFIPTIAEKGEGKFAWQNGVNMVDSSIDNMFCINMASTGKGKTLANLKLLQHFGNVRCSFGLGMVSLTKQTAKQFLDMGVDYNSAAMVTGFSKSRFNLGSESLDQDEVSVEYWGQTSSLSKVFPNNNAGFKNKKLLSAPILVTTTDHLVKASGVKKGNKQMLPYVRCMHSDLVLDEIDDYGIEDMVVLARLVYLTACYGNKVIISSATITPAISNIFYEAYSSGYKVFCANKQTTYKGVNVVWWDEFGIKVEKVTDQFSNLNTRFVNKRITNLLESTPKHKALVVDQDDNMEAVKQSITTLHNAHNSGGVSFGLIRTTTIKDCVAVTQELQNWETDLSIKILCYHSRFVGDTKAQMEEYLSKVLNRKGDEYKKFVDTTTPTAYIVVATPVVEVGRDFDFDWAIIEPSSERSIVQCAGRVLRHRSSTPTTHNIHILKYPFKFYRNSNICYDVAGYESKGYKLKSKNMLDIYKKESIVNSVNRLQGDAAFYTKSLTALEHRVLLDKLTTDIADTNVFVGGWQLTANPHEYCKWRRGTKNEDLVLTDGKWSGNVTTTKPIQSKIWRKWQGENGSITVPEYLLDKTICYNDFYGGYENE

SEQ ID NO: 11804 - protein, 540 aa, Vulcanisaeta moutnovskia 768-28
MNIRPGINKALELIEGGHNHIILELPTGYGKSTGGLEIYRKLSELGIPEDRVIHVLPLRAVVEDLARRFYGILNDKVAYQAGIHNITIDKGKIIRKSPFFDADYNITTFDSFIHNTFKIPITEVFRELRHYYIPFARIYTSSVIFDEAHILIDPREKKMLTGFLASLELLKNAEDPVIIMSATLTQNVRSAISNVLPDAVFIRLGSKDESNNNNIIIRDVDFEEKIGNTRYSINFMNAKPIDIINKVIKLVNNDEKNVLIVINNIGFVTKLYEELKNRGIPVGLVHGELTRRDRSSVINNLDNDKYKVLVGTSAIEAGIDKSFNVLITTPDDAASLVQRVGRICRYSECNGELYFICEDDGNDNIKYSKKLCDYLMKKGSKINWRLPYSKDGNISYVEMLEEFKPYKEIEVSHDYLLSFKALERPYIPHDLINYLFNKQFNFNLARKELIEVYVRGRDEFARASPDDVVLDSYTTDLDNAPIDCIESLGYVDEEPVLISDSSLVQDFRDPDRIANAYGKFVENYEATPIMIIKPNCYRGA

SEQ ID NO: 11805 - protein, 896 aa, Odoribacter splanchnicus DSM 20712
MELLFGRLKNDSYLAHICPGKSAESLQEHTAKVVERACWLIGKHGLEKVVDRLIPGIAGKYSENVQEELKRMFMAVFVFHDTGKVNDNFQYSRMLNRLFKHRKTEILVPAYGHSFLSAWLFLAFELDRVWQDPCLTEEEKKMLFVYAFFFAYVIRQHHSGGLGCADEEEFFNSFAGGYEELHTYLTVWGYEGDFTCVEAVFEHIVAIRKETDAQREASFALYALIKLNSSVLTAADYLATHAYMTGRQVKEAGIFEDRHRVEEMIGHLRNYKHNRGIYEQLDKFVFEYPQEKSGDHLNRLRTGMAVEVIRTVREHSDDRLFYIEAPTGGGKTNLSMLAVTELMAVHPEIQKVFYVFPYTTLITQTNQTLKNALGLTSTELAELHSKAGFNEKTEEREDGLYADKKQDYIDRLFALFPVCVMSHVKFFDMLKTNRKEANYLLHRLANAVVVIDELQTYNPLLWDKMYYLIEHYARFFQVRFILMSATLPKIGKLRIPLKERTGFVDLLPQAKSYMQNPNFAGRVEFRFELFQEEIDMNDLADFVLGKSVEYRDKPGKNGTVHTIIEFITKKSAAEFYAFIQEKEPFFDEVFLLSGTILEPRRREIINELKNPLSRKKNILLITTQVVEAGVDIDMDLGFKNISLIDSDEQLAGRVNRNACKVGCEVYLFRLDNASVLYGKDKRYQMVREQISVGEYERILREKDFGCLYELVFEKINWMNEQTYVQNFRSGFLRFVEGLDFQQVDRNFQVIEQQNETVFVPIPLPVEVDSMTEGVKERLFSDRELQFLEDFGVVPCEGLLDGKEVWEVYERLVYRDHPAKFDLEEKVGFKIMQRILSCFTFSLVGYSKELQELKGGTGEEKLGYFYLSHWEDEGVNGKLYDYKMGLNNRALKDITFI

SEQ ID NO: 11806 - protein, 798 aa, Syntrophobotulus glycolicus DSM 8271
MDEKKRRKGIDESALAKSQPKEDIQTHTDGLLCNLNILKELYPNLFADWDKLYELLRLACLYHDMGKLYPRFQYCIARRIPYDGIPHGLLSLAFIDWKRLRQEKGLNNDDLKLLYQAVAYHHDRKMPMGNKEIEAEFPKLREGWERFEYSELPWKGEIQKVINQRYFGVGKRIGKRDQDLFPRFIKLEGLLIRLDYAASAHVKVEHPNDFLAQDMEGLIERWRKNGIGTKWNDLQLYMSQNRDKNVIAIAQTGMGKTEAGLLWLGNAKGFFTLPLKSAINAIYQRIIDEIVMEKKDERVGLLHSDTYTQYLQLKEESAKGKETKEEEEDIPADLYYARTRQLSLPLTVCTLDQLFDFVFLYWGFERKLATLAYAKIIIDEVQMYSPELMAYLILGLRYITGMGGRFAILTATLPAFFIDLLREEKIPFAPRRTFTDGRIRHSLKVIAKAISGEDIVELSRQYPGKKILVICNTVKSAVNLYRQLRWDQDLQEVKLVDVNGKEGDPSEDRDGEREASGVNLLHSCFIKRDRREKERLILKMGEKDSNQSGIWIATQIVEASLDIDFDLLFTELSDLNGLFQRMGRCYRKRELKGTPYNCFVFTGGSKPCSGVGVFIDQEIHRLSQAALAETDGILREAQKVEMIEKLYTKENLPEYYEHIKKDLAYADCWSVGEIKASKAKEKFRDIDNVAVIPRQVYETYRQEIAQAQSILQMDYSGMTEEQIRELKESKAKARNAIMDFTVDISRSWYQDIETDQILELNRYERVPIVKGDYNSQVGMIRPALKKNAEFTDFSSRSF

SEQ ID NO: 11807 - protein, 769 aa, Rubinisphaera brasiliensis DSM 5305
MAFYGHSLPDRDPCDWEPLEDHLELVTEYANAFAGRLQAEPWGRLLGYWHDLGKYDARFQDYLLRENGFEAHLEETARINHSTFGGQYACRQFTGQTLPFGYLLAYCILGHHAGLPDYRGADSDPQKASSLALRLTDPTPQVDLGDVPEHIRQTISLNPPQLTPASDRALFQISFWARMLFSCLVDADYLATEQFMTPERHRSRSVIAPQWTGMQARLQQLLDSKSQVDSPLTRIRREILEACLTAADLPAGFFSLTVPTGGGKTLASLAFALKHLLQTGKERIIYAIPFTSIVEQTAAVFRDVLGDLADDSILEHHCNVDPERERLSSRLATENWDAPLVVTTNVQLLESLFAARPSRCRKLHRIANSVIILDEAQTLPVEFLKPCLFALQELVTNYGCTVVLCTATQPAIALRDDFPIGLENVREIIPSPADLATRMKRVEVQSLGPVSQGALVDRLGQHAQFLCIVNYKADASNLFRLLQQQSADDGLFHLSTNLCAEHRFQKLREIRVRLAAGQPCRVISTQLIEAGVDVDFPVVYRALAGLDSIAQAAGRCNREGKRNTADVFVFEPEGENWMKPRGYQGRTAGITRGMLRDQQSQLHQHGWLATETISAYFRENYWSHEDLWDKQNLLTDEMLARSSAGIPEFQFREIAAKFRLIDDYLIPVFVRFDEKANELLDGLRANLLDPDRKAAGLQRRQLLRKLQRYAVGVNERLLKEMLGRDISVLPDMRGEPTDFYELVNDNCYDNHLGFHAGNEGMLSESQTIL

SEQ ID NO: 11808 - protein, 769 aa, Rubinisphaera brasiliensis DSM 5305; identical to SEQ ID NO: 11807

SEQ ID NO: 11809 - protein, 754 aa, Nitrosomonas sp. AL212
MSTQQSNQTVYYAHSGKLEDLSDGQTLLAHLSKVSEMAEQNAHWFGAKELAKYAGLLHDLGKYCPEFQRRLQGGKIRVDHATAGAQVAAARWQLMGKLLAYCIAGHHAGLANGIDEGEQRSNLDVRLKLEPGKDIPHLDPIWQQEIKLPEQLTMPELTYHKIWPGFQLVFFTRMIFSCLVDADRKDTNNYYRRLEGKGNAESNYPPLSALRERFNTKLEKIQQNLATQPPKSINQLRQRILDHSRKQAELRLGLFSLTVPTGGGKTYTSMAFALDHAIAHQLRRIIYVIPFTSIIEQNAKVFREAFDDLADAVVEHHSAFDDTKLPNNDARDTLKLAMESWNAPVIVTTAVQFFESLFGDRPSQCRKLHNIAGSVIILDEAQTLPLKLLRPIMAAISELTLNYQCSIVLCTATQPALKKAEGFINGFEDVHEISPDPLALFTELERVTVKNIGEQTDEQLLTHLQEKEQVLIIVNNRRHARSLYDSMKKLELEGATHLTTLMCAKHRSQILEKVREDLLQGKPCRLVSTSLIEAGVDVDFPCVLRAEAGLDSIAQAAGRCNREGKRERKDSKVLIFQSPDWRAPPELEQLAGNMREVMRNHSRSLLSPGALTSYFNAVYWSKGDELDKKKILETHNNHCRQLSFPFQNIARDFRMIETMLKPVIIEFDDKAERLLRDLEFAENASSIARQLQVYLVQMPEHGFKELLKAGAIKPIKPEKFGDQFWRLTDLDLYDGGAGLSCDNPVFMEAEKTII

SEQ ID NO: 11810 - protein, 732 aa, Archaeoglobus veneficus SNP6
MAKFNPNDFLECHVNDALNVMKSIKTAFPWISEIRKNFWELLFYSILLHDLGKCSVGFQRAGAKGEIWGYRHEILSTAFTQFLDCVEEERNLIALAILTHHRYLNDLPVPTKAEEFVWMSYLERVDELLENSDYVEEVFMPKIPYWEIYVFGKTIGKFKLSDDWKKGIKEYNFDGLLNWYDRNWEKYKEELIFLKGLLNACDHLSSAGENSVRLLPFIAEVIAFRIPREEWRPLQKQANQIKGNLLLRAPTGYGKTESALLWADANSHSTKRGVSNRIFYVLPYKASINAMYDRMLEYFKSPELVGVLHSSSSYYLYASNFEYKRLSSLYQKIFTPLKVTTPFQIMKAFFGVGFFEMTLSELKNALLIFDEIHAYEPNILGIILAMLEILKEHKTKALIMSATLPDFIEELFIELLNPEKLKIPSEDADRFTRHRVKIVKGNIEENLQSFAEKFKERNLTPALIACNTVDRAIEVYKRLKSLGYRVMLLHSRFTYGNREELERKLRRDLDGYDFVVATQVVEVSLDISFQTILTEPAPLDALIQRFGRVNRQGWKEKRIADVYVLTDGSEKDENVYKPYDVVRESIKILKNLDGQELKESLIPNLVSEAYSKIKSQLVKEIEEHRLTALELFEDLQPLKKTESEHQFYRMFQGLEVVPVRFADKAVRLIKSGRGIEVHRYLVPLPYWKFYALQDKFGEIFWYDRDHRIIIANLKYSHETGLMDEVCNEIGII

SEQ ID NO: 11811 - protein, 1046 aa, Coriobacterium glomerans PW2
MSETGGELTCSKRARSLWAKSDRDEGRSWLPLVTHAQDAVSVARRLWDTWVPRSTRGAISSAYCENEALAQRLVCFLAGVHDIGKATPLFQARRVLFDTEAEEAYLTWKPQSAGLPFTSVFDCATRPSHAIAGQVILKAYLEDEHHWEAGIAGSLTCIIGAHHGRPPRQKDLGDAVRTRQRELGWDASCGSAWRDVQRELIEHALRLSEITRADLTLMSGRFVEPQIASLLTGLIIMVDWIVSNQAFFPLVPLHHSDQPSTVALCARHAAQQLSARSAKAWDAARILPAWREDACDLPDMETLYGERFGFTGGTRPRPIQIASDQVARTTEDPGIIILEAPMGEGKTEAALAAAEILASRSGCGGIAVALPTMATTDAMFGRVHAWLKRLPEHNENERSIYLAHGKARLNEEFQGIVTASRSKQRYKVLGEDLEAGELSDSVVASDWMNGRKKGVLSNFLICTVDQVLMGALQMKHLALRHLALANKVVVIDECHAYDIYMQQYLTRVLEWLGSWRTPVVLLSATLPPALRAQLIEAYLKGRRTVGQPHRATGNWRETARRAQSWRRAELVSSAPASIASSKESGKEPSDVAAAYPLITYSEGEKMRSRGIPASSRRWNVTVKIMSDDNDSLIELLRERLSGGGCAGIVCDTVTRAQQTAAALSDQFGSESIMLTHARFVDFDRMANERMLRAMLGPEANVDAGTRPYLKIIVGTQVLEQSLDIDFDVLVSDVAPIDLIMQRLGRVHRHRRGTAESERPGKLRGATCYLRGIEHWGEGEAPSFPQDVERVYDRASLLESLAVLELSEHHPESEFELPDDVARTVRAGYGSDVSSRIPEAWKGIYADAVRKRSDVHDKKKRRARPCLLKSVDFLHSNDATLVDLFASGAVSESNARRGADDDWGPRAVRDTQETVEVLLLWRQHDELRLLPWVGDPKRAVEYGAAVPMDQEPSPALSQFIMQSAVRLPLSMCAIGKIDSLIEKLETLTQSWIGAWQDSPWLAGSLVLILEERGGTELVVDIDNWEVSYSREAGLSENVKRSENHLSS

SEQ ID NO: 11812 - protein, 601 aa, Desulfobacca acetoxidans DSM 11109
MSQHAGRSPGRDLEQHFLDICGFAPTPEQQEIFNFLSAGDFSLNPLLVRLPCGYGKTEAVIAPYLAQVLHNQWLLAPRLIYVLPTRALCNQIRDRIQSYANNIEQKFGKKIVVGIEHGVSSLDPLFFADICVTTFDQFLYGYARAKRVGRHFDLPAGSIANSIVVFDEAHLYSPYTHSLMRALLEILTISRIPTILMTATMPKSLEAGLLKNENIRDYERIEFRGKWPNHMGHRTVKWHQEEWGFLEEEKISSGLNKVLNDNQGKRILIVANRVDVAQRVVTALKDRRDLLTLIHSRFTVSDREKKEREVCRFFGKDKNEQKPGIIVSTQVCEVGLDISCDILITECAAADALVQRIGRVARWGGEGIVYIVKPLGREELIGEDWSIAYPYVDKKNEDESEFAGRKKGEFAGIAWEYLKNAPSNLFIDWTATAEFCNRMEYHTDDVEARNALGQLFEATLFADELAWNLSARGEMYCSLSVVNEEVLLKNEKIIDEQIDRKAKKGKKTKIEKQIDFEKLRGTLVNISYRYLAWIKPENLRKYDFTEGKIGEKIEKGRLQPFQTYVIDRNDYYDSNIGLRLVKKEEREEPDKSEEAASCLIF

SEQ ID NO: 11813 - protein, 758 aa, Marinithermus hydrothermalis DSM 14884
MLEARPGEPLLEHLVRVAELAERWAPPQLKAEARIAGRVHDLFKATPWFQRYLHAPPKEQAQLKAQYGERLHHAWAGAVFGAFVSAQRGHDALAVFLAVACHHGHLKTPTALLPNKRDLLTGRFTRLDALEAQIQAVLGWEEGAKLLEALDLKAAFLEFARTDKPRFLNDLRQRFAVTRGRYWAVTWLFSALIDADKHLAAGTPSPERVPLPERVPEPFLNEVKRGAPIDPLRERLYRAVQQRIREAPLDHLFPAALTLTAPTGAGKTLTLLNAALELRTRVQAERGHTPRIVYALPYINLIEQNHAVFEAAMRHAGIPAEHALLAHHHLSEARDEDDLTETEHRLLLTESWEAELIVTTFVQVIETLYGTHNRTLKKLHRLLNHTILILDEVQALPAEHWPLLRRLLTEFVKHGNTVILATATQPALLQDALELAPHLPDWPTRVHIRRAETPPTTPPNRSRLIVANTVARSLELYAQQKALGGEVHYLSTNLTPHDRAQRIALLKQKLPHTPLTLVATPIVEAGLDLDFREGWRELGPVDAVIQVAGRINRSGNRPPEPLYLLPETNMARVYGRVLAELARSFFNTFTEGSDHALTAHLPPYFAALEARLASAQATGFIEAMTHHRFCRSGYPRRCRDGCGPTNPEGCDVCCFSLIQEEMIRIPIFIEQNDEASEALAELEAALKEPDPTRKRARLRRVRPKLARYTINPIARIAAKNLPSPLFGREDYRLVRREELEAYYDEETGFVWELKDQFL

SEQ ID NO: 11814 - protein, 3174 aa, Cowpea aphid-borne mosaic virus
MASIMIGTITVPFAWNECNYKEVDEYIETETQERVYMDPKPTSARKRNLCFCGEDNDGHYHCHFCDCECDSKNHLEEHERDICEDAYSVRAFGYKLVPKIEIKKITKKVPIVESSEPVHFTVRPVTIEAKHMASQKPSVRGELHRHRMESKKILSEYNRVQAAFADNFSKIAGMDQKLLVDKYSPIRKTKGGAVINRVSLKRAQERHEAQLMADKELAAFLAGEYESAAYIGSVQGLDTARNSESVSFKTPYYRRTPKIQKQKMKPKQVVGSSKVLGQVVQLAKQTGISLEFIEKGQGRTLKLNIVKRYGSALPKIILPHEGGKTVHEEVNCDKYKDTLLSLIKHSTYKPIHQNVFKKGDSGLVYPTGKIKALPAHEKDVFVVRGRLDGTLINALDWCSEPAHVQHYSHQPEVQFFQGWKKVFDKLVPRTQDHECTVDYSNEQCGELAASLSQILYPVKKLSCRQCRFRIKDLSWEEYKEFVATHFGCCAEMLKEQQSVGFKNVQTLVERAVSEDGDMDLSLEIIRLTQNYTSTPMLQIQDINKALMKGSSASKQELDQALKQLLAMTQWWKNHMDLTGEDALKAFRNKRASKAILNPSLLCDNQLDKNGNFIWGERGRHSKRFFSNFFEEIIPSEGYSKYTIRRNPNGQRKLAIGSLVVPLDLNRARVSMQGESVARNPLTKACVSILRKNFVYPCCCVTLDNGQPLYSEYKSPTKRHLVVGSSGDPKYIDLPAADSDRMYIAKEGYCYLNIFLAMLVNVNEEEAKDFTKMVRDVLVPKLGTWPTMMDVATAAYMLSVFHPETKSAELPRILVDHESQTMHVIDSFGSLNTGYHVLKAGTVNQLIQFASNDLDSEMKFYKVGGSVQQRMKCETALITSIFKPKRMVHILETDPYILLMGLISPSLLIHMFRMRHLEKGVQIWINKEQSVAKIFLILEQLTKKLVVTDVLLEQLGLISETAEPLHSLLLNCPKTMHSYNIARELLTIKAEANSANEVLKLNGFFDMNESLDSAREKIYVDRLSKEWHALSLLEKFSVTWRLKRFSDVTENTLTKKAFVDKEKFSRRFVSACFLSAQTHLKESRTYIANRVEQFSLKLVSSVCNMFLKFVRKCYGDLIFLVNVSIVFSLFVQMISTLNSTMRAIKNDKISLAAHKREKDEQTICRMYDLFIKGSKDLPSSGQFLSHVEEVRPDLLLTAQYMIADREHVETQAKTHNQVHLEKVVAFMALLTMCVDAEGSDAIFKILNKLKSVFGTMAEEVRMQSLDDLNDIEECKKLTVDFEVSTSYEPTSTIIDVSFEGWWNRQLQQNRVVPHYRSTGEFMEFTRATAAQVANSVSLSAQNDFLIRGAVGSGKSTGLPHHLAKKGKVLLLEPTRPLAENVSKQLSQEPFFHNVTLRMRGLSRFGSSNITVMTSGLPFHYYVNNPHQLNGFDYIIMDECHVLDSSSIAFNCALKEFSYAGKLIKVSATPPGRECEFTTQYPVKLKIEESLSFQDFVQAQGTGTNADMIQHGSNLLVYVASYNEVDQLATYLLNKNYKVTKVDGRTMQMGRVEIETSGNPSKPHFIVATNIIENGVTLDVDCVIDFGLKVVADLDTDSRCVRYNKKSVNYGERIQRLGRVGRHKPGFALRIGSTERGLTEIPDFIATEAAFLSFAYGLPVTTQNVTTNILSKCTVQQAKSALNFELTPFFTTHLVKYDGSIHPEIHKLLKPFKLRESEMIMNKKAIPYQYVNQWISVREYRRLGIQIGCDERVQLPFYVNGIPDKLFEALWETVSKYRYDAGFGRISSASSTKISYTLSTEPTAIPRTIAIIDHLISEEMMKKNHFDTVASSLTGHSFSLSGIAEGIRKRYLRDYSTQNIETLQQARSQLLEFNSNTVDVNKLHEYEDLGILNTVCLQSKQEVAKYLGLKGKWDGSRLRNDLLLVIFTIIGGGWMMWDYFSRCTQEEVTTQGKKRMLQKLKFRDAHDRKVGREVYADDYTMEHTFGEAYTKKGKEKGSHKTKGMGRKTRNFIHMYGVEPENYATIRFVDPLTGFTMDENPKVDIRLVQDEIGDVRNKFMDEGKLDRQAIMYNPGVQAYFLGRGTEKALKVDLTPHRPTLLCAHSNNIAGYPEREDELRQTGLPQEVDLKDVPAPNEDVGVESKSTYKGPRDYSGISTLVCKIVNASDGCTETIFGIGYGSYIITNGHLFKRNNGTLTVKTWHGEFVVSNTTQLRIHFIEGKDAILIRVPKDFPPFAQRNCFRSPKKEERVCMIGTNFQDKSLRSTVSESSMVIPEGKGSFWVHWISTQDGDCGLPLVSVDDGHIVGFHGLASNTTSRNFFVPFIDGFKEKYLDCAETLEWNRHWLWQPDKIAWGSLNLVNNQPKEEFKIAKLITDLFDDGVATQSKQEAWLRNAMEGNLVACGKAESALVTKHVVKGKCCYFQQYLSSNQSAADFFKPLMGFYQPSRLNKEAFKKDFFKYNKPVVVGEVDFDAFAQAVSGVKMMMIEFGFGECKYVTDSEEIFDSLNMKAAVGAQYKGKKQDYFATMDEFDRERLVYLSCERLFYGKKGLWNGSLKAELRPLEKVEANKTRTFTAAPIDTLLGAKVCVDDFNIHFTNSNLQCPWTVGMTKFYGGWDKLMRSLPEGWVYCHADGSQFDSSLTPLLLNAVLDLRLFFMEDWWVGQEMLENLYAEIVFTPILTPDGTVVKKFRGNNSGQPSTVVDNTLMVVISVYYSCIKAGWNEADIQERLVFFANGDDIILAAQEKDIGILDTFTKSFKELGLNYDFSERTRRREELWFMSHQAKLVGDLYIPKLEQERIVSILEWDRSKEMLHRTEAVCAAMIEAWGYPELLQEIRKFYLWLLQRDEFKELASLGKAPYIAETALKKLYTDEQASEKELQRYLQDILSFYDDCESEDVVLQSDEKQKELDAGKDKDKEKEAKGQSAQQKQAKNKGTKETERDVANSSSGQLVPRLQKISKKMNLPMIAGKVILNLDHLIEYKPAQIDLYNTRASKTQLSKWFEAIKEEYELDDDKMGVIMNGFMVWCIENGTSPDINGVWTMMDGDEQVEFPLKPIVENAKPTLRQIMHHFSDAAEAYIEMRNSEGFYMPRYGLLRNLRDKSLARYAFDFYEVTSKTSERAREAIAQMKAAALANVNTRMFGLDGNVATTSENTERHTAADVNQNMHSLLGMTHGQ

SEQ ID NO: 11815 - protein, 916 aa, Verrucosispora maris AB-18-032
MGWLPLWRHLADTADVAGQLWDHWLGRAARHRIADELPGAEADARTLLVWLAGIHDIGKATPAFAYQAYNLAERMRDHGLGYQRDLIKADRRYAPHATAGHVLLADWLHQQDWTDPHPFAVVVGGHHGVPPTDMGLRDVRVRPHLLGGPAWQHVQHELLTWMTQRSRAGDRLADWNGVALSQPVQALLTGLVIVADWIASNENYFPYLLTGSDEDRLRTGWELVDLPVPWRPTAPPANVDELFRARFALPTGATPRPVQRTVVDLAETMPTPGMMIVEAAMGEGKTEAALAAVEILARRTGASGCYLALPTRATSDAMFGRMLSWLRRLPDTQVGRGDRDVRLAHGKAALNPDYDHLRTTSLPSGIGEDTGGADIGVHRWLAGTKRTMLSSFVVGTIDQLLFAALRSKHLVLRHLGLAGKVVVIDEAHAYDVYMGRFLDRALEWLGAYGVPVVVLSATLPAHRRAELMKAYDDGRLGPPPPLTWRDRGRPQVDPYAALRSDLRYPLVTVSTDQRGAAAISCGDSGRGIDVTLRRLPDDLPALVDLLRDRLAEGGCALVVRNTVARVQESAAVLRAALGPDTPVSVAHSRFMAVDRAAKDRWLRDTFGPPGSNNRPHRHVVVASQVAEQSLDIDFDLLVTDLAPVDLVLQRIGRLHRHPRADRPARLTEATCWITGADWSVEPPQPVTGSRRVYQPATLLRSAAVLLPHLDGTPVRLPHDISPITQTAYGDAPVGPESWQPSIVEAETKQRDEIASKESKADSFRLAGVAEPGVPLIGWLSGGVGDAEERVAQGHVRDTDADSLEVLLLVRTPEGLVLPPWIDGGGVRVPIASSPSSTLARSIARCTLPLPRAMTSADVIDGVIGEIEGRVDVRAWQENPWLAGELVLDVDGEGHGRIGPFDLYYEPHEGLRVFRNE

SEQ ID NO: 11816 - protein, 822 aa, Methanothrix soehngenii GP6
MASESYSFKLMSHPDKRLVDHLRRVGQLSRKTVRDKSLNIDDKDLLTDAAYLIGVTHDLGKATKFFQEYIIETDERKKRSLKAKDTTHHGLLSAFFAYAVIKEYLHQSEIKGGLADYLPIISFLTVKRHHGNLMNAMDEISEVDAEKDKILKVAREQIESMDMDKTELSEILELLLSEEKINLKIDIDKILDYILQDAPREIGRKEKRLVRHLNEKSDLYLYFITQFLYSALLDADKTDAGLNGKDLDRLDLPADLVDQYRDRKGFTSDRNNINSLRNQIYEDAMVGISDWNLDNRILSLNVPTGTGKTLTSLSFALKLRDRLKKEKNFTPRIIYALPFLSIIDQNYAVFDDVVTQGGRLKDSRLLLKHHHLADVSYKTEDNDEYKADESLLLLEGWNAEIIVTTFWQYFYTLFSNKNKLLRKFNKLANSIIILDEVQAVPHQYWQLIHDATKMLCEKFNSYVVFVTATEPLIFDEAIGEIKEIVQKKEEYFRGLDRIELIPRIETALTLEEFKVLLEKDITGNPEKDFLIVLNTISAANDVYNFVKGLELVNTENFYLSTNVIPKERLERIRKIKGPSEKREANESLRKRKVIVSTQLIEAGVDIDADMVYRDFAPMDSINQVAGRCNRNSAKADKGTVSIFILKDDRKEFYKYIYDPFLMSKTLDTLKNINDTIKESDFLELNNKYFKAVKMGMGDEKSKENLACLAQLSFRDLSKKFKLIEEDYPKVNVFVELDETAVEIWKKYQDMRMEKDLKERIRKKLEIRKEFSEYVISAPEKFAHSLIIEDSEFGYISNAELPNYYDMETGFMRAGAGVGSMII

SEQ ID NO: 11817 - protein, 800 aa, Methanothrix soehngenii GP6
MLKPSLIDGYASFFKEITSYCPYPYQEKVFSLLDRGKSVVLRAPTGSGKTLSVIMPYLYLRKNNEKMADRIIYALPMRALAFDLYNSTIQTAEKAGFCVVEDPEKRSGEDRDSEICITIQTGELQNDHFFEGDIIFTTIDQLLSGYLTLPVSLPDRLGNINIGAIIGSLIVFDEVHLMEFQRSFLTATEMMNRFEGLAQFFVMTATLTEPTQKWLAKQIKAEPITCSINELKSVPGYEKRSRVYSFENSPISSDTVIKNHRQKTLVICNRVDKAQQIYSELKEKLINADTKIALLHSRFFKRDRSEIEKNLQLWFGKRSEDVNAILVSTQVVEAGIDISCNTMHTELAPANSLIQRAGRCARYSGTGNVFIHEIEDPSNPLPYPKNEVDATRKEIKNFREKELDPDFEKDLVERVHAPLDDSRLIDSLQNRRGEVNEAMDHGHSSSIQKLIREVDSVNIILTPNPHSENLEISWPEMLSVPRSTLYKLKKKGADDWIFKIPIFSDDEEFKGVKWEKVESVRDISWLVALNPKFARYSQEVGLIFGEEGTRCIILNKKSPYKSYKYSCESFQEHTHRVIAEARSLIPLSDKGIMKLSKKMRLDRNHSIEKMILLACALHDTGKLSVRWQGAMNRWQGISNPNAEQFIKGLPLAHTTYDPVKDWIRMQELKIQKGPHAAEGAYAVFTMIFKGSQTMLGDGDDTQNMAIGIMAAIARHHGPRTSNLQPFELIPQAKNVLNDAMKTLEIDLGDMEISETPNKDVIDSFRQYLKISEIDNGIFLYWLSVRIIRLADQRATSKIGA

SEQ ID NO: 11818 - protein, 672 aa, Clostridium botulinum BKT015925
MNDLNDKLKQYKAKSDGTTLFQHNQDLLVALEQLSKIHSIPQELKNSLIKCIKYHDIGKVTDDFQNNIESKHRNIRHEIISASAKDLDDNERLNILLHHRVLEKLAQFINNVYYKDSLNEVKNKLNIKVEDITSYLKKICRGGRENHKKLHNKDLIIQLGLLKMCDHIASAGINNIDIGLNTKEVFNFEKYRSIQEKVLNLKEVKDIIIQAPTGLGKTETALLWTNLVQNKFKGKRIFYILPYTASINALYKRFKEQNISVGVLHSKVQSLLSRDEDIENIEEELQLFKKNIKQVTICTIFQLLKAMFSCKNFEMILAQLKDSIIVIDEIHCFDLRTFAFMMESLKYLRENFGINICIMSASIPTCMLEFMKETLNINTLINADKEDFLIRHHINRVDKELVNDLDKIKAAIENNKQALLCVNNVAASQKLFSNLKEQYPNKNIKLIHGRFNARDRSEIEKDLKNCDVLIGTQAIEVSLDIDYDVLYTEMAPLDALLQRFGRVNRKGEKGIADVYIYNKSKEYNSIYDNNIIDKTDIELNNIIKNDSGIILEDKVNLYLDNIYTEFNIDEYNQYKKQINDIINNIRVGYYNENACEEMLSNDNSVQMIPVSLLSEYIKSREEKRYIEGNELFVNSKKYLSEYNKNLRIYITDRVYDIRGLVEKEIDIDNQMV

SEQ ID NO: 11819 - protein, 498 aa, Metallosphaera cuprina Ar-4
MSDIYKDICSKENVEPRDKITETLDEIENGHSVILTAPTGYGKTSITKALAVAAVQGNDNFDRVIHVLPYRSIVQDLTAKLRYSLAKIGLNQDLVGAQDMDFHDSPYFLLKANVTTLDTFVLNLFKLPVAEIDRGLNGLGTHFEVPRGAIYSSIVVFDEFHLFSEDGKPLTSAIASLKSLGSMGVPFIIATATMPDSVKSLIKESLIKEGVSLTEVNVIDSPVKRSIDIRFESDLPRIDTEKRTLIVFNTRTEAINAYRKLKGLGYSPLLIHSKFSSRDRVEKVNKIVNRNEQAKLVISTQVIEAGVDVSFDTLITEAAPLPNLIQRAGRVARYGGEGEVIIIPFMGKVYERSEVDQAVKLIEENNVIDHSLMQFYKVNVDVDPSLRTSLNMIDDVALYTSGATTELLEEVCSLTRDVSLVMGFPHGCTSPECAVPLTDQEAKDLINAGNMIVKNGQFMHPSQARLKSLKDCLPLQFLKLGIDGVVIESYDKEEGAII

SEQ ID NO: 11820 - protein, 752 aa, Selenomonas sputigena ATCC 35185
MTKSSAYLGHLDEETGREQLLFDHLTGVADLAGRFAAAFGEEAMGRLLGLYHDIGKYSREFQEYLRADEAEKKRRRGRIDHSTAGAQEIVKLRQSADDEQSKRLARGMAQVMAFCIAGHHGGIPNQGTSANTAEDGTLLGRLKRRNLPDYHAYHEADLPQTLPPSSLLLAQAARAPLSAMLYTRMLFSCLVDADFLDTEDFMSAGNVEREGFASVETLLERLQESLEEKFSKPKTEKEKQKLQLPINEKRSALLAESIAAGKEARGSLYRLTVPTGGGKTISSLAFALHYAAHAKRKRRRIIYVIPYTSIIEQNAAVFRDLLGSDSVVEHHQNVDYDDVQDMDMNRKRLATENWDAPVIVTTNVQFFESLFSNRPSKCRKLHNLAESIVIFDEAQMIPIDYLRPSLAAIEALVRHYACTAVLCTATQPPLGQFFSADMQPLEICPALMENAAFFRRTKIELREETMTEEELAEELAAHEQVLCIVNVKKTAQSVFDLLREDEGTYHLSTNLYPVHREQVLEEIRARLKDGKPCRVISTSLVEAGVDLDFPCVYREINGLDSIVQAAGRCNREGRRSAEESAVHVFSLEKLAKNAQLAAEITKNVARSFAEDLASPEAIRRYFEELYDLSGKNRLDKKDIMGQSGKFAFADIADDVRLIEDRTKPIFIPQTEEGQALLARLEQGERSRSLMRKVGRYIVTVYTGYAEAPFEQLAAQGKIRMLDENLAVLVDMAVYDSEKGLSNNVGEGEGMFL

SEQ ID NO: 11821 - protein, 641 aa, Pyrococcus sp. NA2
MDIKEFFKRLTGFEPYDYQVRAWEAIQQIMETGGKVVIEVPTAGGKTEAAIIPFLFGVYNNTWPVARLIYVLPTRSLVEKQAERIKKLIYEALKLRGMSEKEAKDYAEKVVVVEYGLERTHAFLGWVIVTTWDSFLYGLAAHRTVGNRFTFPAGAIAESLVVFDEVHMYQDESMYMPRLLSLVVDILAKANVPVVIMSATLPSKLRDMIAKNAKTINVDPSDEHKPSRGEVDVEIIEGDVVNVLEEIKRVLNEGKKVLVVHNTVSRAIETYEFLKEELKNELEDPDILLIHSRFTLEDRKKKEKAIESARLIVSTQVIEAGLDLPNVGLVVTDIAPLDAIIQRIGRCARRTGERGKGIILLPIIKKDDISSMRIVRGLSELKKTVGGDIESATLNSGDRVVEVVCKVGSKTQSVYVSDITGIKERSGKKGAKSPKDIYVLPYSSLPYDPLILLTTYDELVYSKNIRDYLEDAEKARNALDRVYKFHYENNIVPREFASAYIYFKELKLFSAPPEYELRSRPELYVMLYLTDSKEINELDTNKIIRITYRNSKEWKEEDIIVGKLEPQWDKEGKRILKWKVQKTFRINPYEIYVLNPKYYDPEIGFVPESKEKYKNKQKASKSSNRESKTKQVTLTELGVIR

SEQ ID NO: 11822 - protein, 767 aa, Porphyromonas asaccharolytica DSM 20707
MSNTKQIAHVRALEDGSYETQPLLDHLHGVAELAQSYAERITDDPELGEIGYLLGLLHDLGKYQEGFQRYIRQQSGLDPTLNGWRTPHSPAGARYAYNLKQVGGNQQLLKILSLCIGAHHRGLYDDSEWRGQVVDSSDTKRAVANLVKGLRPEASQLEELLHKASLDKATKAWNKIEEDDYQLLVRMLFSCLVDADFLDTERFMTPDKSLVRQSAKASLEQMRAQLEEYVSHFNREGRINEARAAFLDQCRNHGRTAQRKIYSLTLPTGAGKTVSSMMWALEHAIAQGCERIIYVIPYTSIITQTAQTFRDIFGADQVLEHHSDVDAKERPDEAMEYTKLMTENWDVPLVVTTNVQFFESLYAHRVSRCRKLHNICNSVVVFDEVQMFPPRLLNPILRVVESLHFAFRVEPLFCTATLPVFDKDILSDSKRIGHEFFFLEEPIQEVVPYDAERFAPFDKVRYHWDLLKLSTEELAERLAQHESFLCIVNSRKDAARLYTALQAQDKSGEGLIHLSRRMCSAHIQERIEEIRRRLKAGEPVRVVSTQLVEAGVDLDFPVVYRAMAGLDSVMQAAGRCNREGRMAEPGEVYIFRLDETVSLGEMSWAQGALEDLLDRLAEQGAPQREEIERYYKAFYNDVDCFDNKRDKEVSKLLWNVNDDRCEGLRFDYETASENFRYIENQDIPIVIPYTDEGKAIIKKLQNNLPLTRQEYRQMNRLTVGLKRKDCLTLEGSVSVSDSGIAYLTDDKLYSTETGIQIIDRTLIFTTA

SEQ ID NO: 11823 - protein, 783 aa, Thermodesulfobium narugense DSM 14796
MKAVKTLSSSELFSHPGRLLEDHLISVADFIETFLDEKPKDLVEELKDLAIIVALTHDIGKATSYFQEYISSENNKIKLKNIETRHSLFSSICSFYLAKDILKDNILAIFAYIVVKRHHSNLIDILDELSIDEKELKVLNKQIDSIDDKKFSILCEKIKVRGLNRLLTKHVLYDWFNNFEKELSSLRPKIRRLNSDPRNYIKLNFLFSLLIDADKSDVVIGNLDSFTKRNNINPNAVDVFLKGRNFLPSPINDLRMKAYNEVVGKIESFNIQDKLYMINLPTGMGKTLISFSFALKLKKVLRENNIFSRIVYSLPFLSIIDQNSKVFEDVLQKNNVETSSNIILKHHHLSELYYKVDYTEFETNEAKILIEGWNSEIIITTFVQLFHTIFSNKNASLRKFHRFSNSIIILDEIQALPLKYWNVITNLFLSLTEELNIYLIISTATKPLIFNDQRVINLVDKKFYFNSLDRITIVPNITQKITLEKMKQKINFDLEKSILFIFNTISSAKKFYYLIKDVPNKTFLSSHILPEDRQNRINDIKRGKYQIVVSTQLVEAGVDVDFNLVVRDFAPIDSINQSSGRCNRNALNKGKVRIYYLKDDNTGKSYASYIYDPVLLDISEKILQEYKELKEANFLEVLDKYFSLIKEKKTQIESDKIFESMCKLKYDCGDNNDRCISVSNFHLIEEDYPREDIFIELNSEAEKIWLEYSELIKIEDRFLKKQKFEEIKSNFYKYVISVPSLHQNASNLPSIVNGFRYVCNAMLDTYYDRETGFILDSNNFMFV

SEQ ID NO: 11824 - protein, 755 aa, Haliscomenobacter hydrossis DSM 1100
MPSVILAKSSNEENTRPLTLAEHNNDLLDIKRYLLEAFPQVQRISTLPEFWEILHTAIIFHDLGKAHAEFQKVLLRYKNHKWCGQRHELFSLPFVAGLSLHPDQQELIEKLVAGHHKPYHKLLHHCEELYDEGDFATQFQAVDTAAVLDLIKEYGYELQTFKVKPPNQLFLHYKKQMHERRVPLVQPLLMLTGALKHCDHLASAFIRKKDLQLLDSSNFKFLDQKLSSPYQHQIDAEQTLGSTILTAPTGSGKTETALLWTRKQMQEQGRGMVFYILPFTASINAMWKRLGNPENGLNEKVGMLHGNLDAVLYRELFEEFGGDTQKIKDKIPAIKKQFREMMTPLRIVTPFQLIKHIFGLKGYEKGIFEWTGAYFIFDEIHAYDPGVLAQIMVLLQYTIDKCGVRAFVMTATLPSFLKDLIAKTLGSHSLLKASTELYQKFKRHRIQVLGGEITEALDLVRADLVIGKKVLVVCNTVQRAQEIYQVLSSDSTNSILLHSAFNGEDRASKEAKLKNESLPDLLVGTQAIEVSLDIDYDVIYTELAPLDALLQRFGRVNRATKKAPCPCFVFEQRNDKDRYIYPVEICERTLISLREMENEHDGIVDELTLQAKIDFVYPRFSEKEQQEFDQVVDSLTYSIEHVLVPFNEDKKSEQDFYDQFDGVKVLPIELKAEYYERIKKFNFIHADMLKVSIRKNEFQRWRKDGTLQPERLHLEKNAKDSMDVPVWLLQKPYDQELGLLKYLELSMLDLNDNQL

SEQ ID NO: 11825 - protein, 1001 aa, Tepidanaerobacter acetatoxydans Re1
MKRTETKIKRNIFSGVKKQGKYMSTSEVIKSWDNGTTEVIAEDINGIGLRPAQFGALSAIRAHWTVSNKDATVVMPTGTGKTETMMAAVVTESIERTLVAVPSALLRTQVYDKFKTLGILYDIGYLKDRVVPPNVLKLNNNIKNFDEFRRYIEKSNIIVTTMALLCKMQEDYKTYLSDMIDLLIVDESHHISAKTWMETKSWFLNNKIIQFTATPFRDDGKKIDGDIIYNFPLHLAQKQGYFKKIEFEPVEEFDELKSDREIAKRAVYLLQKDLRDGYEHLLLVRAKTIARAEELFDNIYNKYYSEFKPILITNRQSAKEKKERMEQLKSLESKILVCVDMFGEGIDIPNLKIAAIHDKYKSIPITLQFIGRFARTAEKLGDAKIVANIADDDIVDAIEELYEKDTDWNQLLPLKSNEYIDKELSLQKLIRGFSSEDLDDVSLSQLKPKVSMIAYRTNDKKWYCDRWTNIFDESKCRYFINQDEKILIIIEPREVNIGWTSQQDIFNIEWHLYIVYWNNDKNIVFLNSTDKSKGYRLIKEIFDNEPITIKSENVFRSFSGINRLMLGTVGLNSGIDGPVRYKMFAGIDVGEGISESQKANCYKSNLFGNGYNGNGKVSIGASHKGTVWSRWVESIDYWKNWCDQTIDKINDDTINVGKLLEGVLTPKLISKLPESHPYRIDWPLDFDVNMDRRIIIDTGLYEVPMYELDIRLKSVNHKNNDIIFMVKGEQFIEEFRLSILKDNYFITSVSNMMAEIKIGNSKKQYLYEFFKEEPPTIWFADGSSLQGNILVSIPKNQIIEFPEKNIISYDWNLLGVDIRSESQLDKTTNLKKKNSIQYKVIEKLIEANKYTIIFDDDGSGEIADIVAISEEDNTITMNLFHCKFFHGDKPGSRINDLYEVCGQAEKSVSWKQKPIDLIDRMKYREVSRNKENKPSRFEIGDLHELSIIRKKLMRQKSNMNIYIVQPGVDSAKITTDMNSLLATSHSYCMDTFGIELKLICS

SEQ ID NO: 11826 - protein, 485 aa, Acidianus hospitalis W1
MSSLVDYYNDFIYKNKLEERKGIEQTLRKLENGENVILKAPTGYGKTTLTKILANAVERGNEVGSRVIHVLPLRAIVQDLYIKLMKDSKDGKIYTRSIGAQDMDYFSSPFFMKKVTVTTLDTFVMNLFKLPPVESRNIFNNYGSHYELPRAMIYSSIVIFDEAHLIGEEGRPLTAFLASLRVLSEVGVPIVIMSATIDEGLEKTIKNYINVETIEANDFSIKRNITVSKIDDPIKDARNQVKEGKRVLLTFNTRRDAIDSYMRLRDLNPVLIHSKFNRFDRIELMWEVLDRNTKLVISTQVIEAGIDTTFDVLITEAAPAHNLIQRAGRVARYGGNGEVHVFPFRGKVYDEKEVSDTYNRINNGVDDSLLVRREYKVDNTLLHDLTVIDSIYADAKRAKSLYEQVCNIVRDTSIILGFPPHSDSTMFAIPLSKDEAKKLIEKGYSLVPEGRSLNTLNCLQLQMIKNSILGVRIKGYSREIGGILE

SEQ ID NO: 11827 - protein, 815 aa, Mahella australiensis 50-1 BON
MEFYSHITKDEQGNITRKKLLENHLREVAAQMERSIVGMPIDGAADVAKAAYLMGISHDFGKFTTYFQRYLLHGSKDGSLHFHGFISAVFVGYVMQKFWHSDKPHETYMPLISYFFVLHHHGNLGSLEDDVLTKSLLKGGAYATDKRWSDKINIFKTQLDDIKLHVHDIEQCYRDLGVDISVNEFIANWEDILRKLDLQRYKLMNKESSDVRIRVLMLGLMMYSELIDNDKMDAAQVEISQRKVLPADIIDTYRMKKFKNPAKPLDEMRNSIYQSVMSSIENAPLSQHLFTLTAPTGSGKTLTGLSAALKLRARIEQRLGYSPRIIYSLPFTSIIDQNYDVIKEILSQMDDFNGNEGLYLVKHHHLSELSYTRQGEEEPLDKALMLIESWQAEIVVTTFIQLFYTLVGYRNKFLKKYHNIIGSIIVLDEIQNVGVEYWPLINKVMNIMASEMGCYIILMTATKPLIFEDGSSMELVKAPEQYFKKLDRVSLLPIPITMTVDEMADKFMDIYDGEHSYLVVMNTIKSSIQLYDLIKDRIDIPILYLSTNIIPKHRNQRIKEIKEHTDRHEPIVVISTQVVEAGVDIDMDVVMRDIGPVDSIIQVAGRCKRSSMDDDGKVYVYKLVDKKDEGKGETLLAKRIYGSIHCMLALKMLERGTISEHAFYDMINEYFNELTFSESQQISDDIWEAFEHLRFSKDESDIVTVSSFSLIDNRPNYADVFIEIDDEARDIWEAYSENVLAQNDEAKRREARLRFKGKLDAYIISVPDKLAMGLQPNMAVSKDKTFWRLPLEGLDLFYDIETGFKRSLDMEVWMA

SEQ ID NO: 11828 - protein, 787 aa, Thermoanaerobacterium xylanolyticum LX-11
MNTSCFSELYSHPDKYLEEHLVGCAELAEKFLGEAKVNLMDEELLSSLIKIVALCHDLGKSTSFFQEYLTSQDDNKKKDLKSKKETHHSLISAIIAYFAVKQEISGLDIDNDTKILLPFISYIAVKKHHGNLNDVVTEASLEDSDIEIMKSQLQSIDDIKFKILSDNLRKVGLNIDLNKTTVANNIEDIKNEMRSIRLYLRKIRQKEDLTYYILINYVFSLLIDADKSEVVIGKISSSYTELMDDAVDKYKSKIRYKDSKINVLRENAYREVNENEINVDERILSINLPTGLGKTLASISFALKLKKKLHDVYNKKFRIIYSLPYLSIIEQNYQEFEKILKTNNINVNTSVLLKHHHLSEVKYSDDETEFDTEKSKIMIEGWNSEIIVTTFIQLFHTFLSNRNSALRKFHRIANSIIILDEVQSIPFYYWKLVKEVLKAVAYKLNSYIIFVTATQPMIFDDNEVRQLTDKTRYFNQMNRVVIKPVFQKDMHLDELIDVFDLKDGRSYLFILNTISSARQFYQLLKEKLPDEEIIYMSTHVIPHERLERINLLKTKSIKYAVTTQLVEAGVDIDFDVVVRDLAPMDSINQSAGRCNRNWEKKGEVYVVSLIDEKNRKYALRIYNKVMLNITERILSEYEIISEKDFLDIIDRYYREISQNLSSKETIDILDAVFKLRYDSDDGMPSISKFKLIDDEYYKVDVFIEYNEEAIELWQRYIDLKKIKNLFKRRSIFDEFKADFYKYVISIPEKTENMPAEVEGFKYVNAASLKDYYDSETGFKTSDVLSIW

SEQ ID NO: 11829 - protein, 763 aa, Hydrogenobaculum sp. 3684
MDNLENSLKEHLKNYFAKSDRETTLEKHINDLLDQFRIFLDRYPNVLNEREKMLLEKAIEYHDYGKLNKLFQDKMKQPTRRDDIVPHQFLSPLFLISRENKLSDKDLLIIVYSIVNHHQRGQDKYLEKIENGVNRLFTEMESCFSMFFQHIGFKGLSKDTKERYKDCLHEIATNIKPIEILNKMLYEGNEFIKTLIKVSGLLIRIDHAASGDGMEIEEPCLEGDREEIFLNYLKKLKKDNNVSLKRFQQRFKDCENTVLVADTGLGKTGLAFLWSRRKMFYVLPNRTSTNAMYETFKQIAGEDKVGLLHSTSMFYIYEKSKEDVDYTILRDHDNTKNLSKPITVNTADQLFEAVFKYPTYEKIYATLSYSDVVIDEIQGFDPAQIVPIIKQIKETTKLGTRYLIMTATLPGIVKEKFEELGFNVVVDDPDTIDKTKRHKVCFVEKSILSDIESIVKKAKENKHVLVILNTVSEAQNIYKKLRDSYENVKLLHSRFIWKDRIEREQQIQKDYKHNEGVIWVTTQLVEASLDIDFDVLFTEIAPADSLIQRMGRVHRHKKHDYLGDYNVYIYTEVDEKKTSRIYEKVLRDKSIELIKENLDKEDYLNSYSKRKIVETLYSEEFLKRINSKYLEKWKRIEEILNSKWENVFKTAQEMFRDIFTVEVVPYMFKEIVQGLEKDYYNTKKINDEQKRKIERVGILKQINDYKVPIPLYWWLSQNKSKFEYYSRLGIKILGKEFEYDSDLGIIINKETLQNSYVDEDIFI

SEQ ID NO: 11830 - protein, 735 aa, Hydrogenobaculum sp. 3684
MKKILQNLLEERWAKDDGTTIRDHTDKLLENCEKLKNYYKQEIEELMPKGLPYELKERFWEILKLACEYHDYGKIHCKFQEKLGNKNLKCEKPIKELPEVRHNLLSPAFVDIEDELARKIVRLLVLHHHPVEDPSVENVEKVLKEEFGFEKIPIRFMLKKTETDYLRDDVAKIFNISIDELIGYYRLLKGLLLRIDHASSSKKTQEVEDNPPEDTLNFVDEFFKSTKRVPNEMQIFVKENRDKNLLIIAPTGSGKTEAGLIYLKKKGFFMLPYRVSANGIYTRAEGILKDYAGLLHSSALSYVLEKEYSTEDIQNNKGDSIFLNYFLSRNFAKPIIISTPDQLMHFVFRYKGFEKYYATTLYSRLVIDEIQSYDPITLAFMVKALEIIIQNGGKFLVMTATFPEFLRDRFKNMGVVYKELNLQPMIYHNIQVIDDTIDNYVDIINNLSKNAKVLVVVNTVKKAIEVKEKLSNANLLHSRFILKDRKDKEKKIKEFFDANSNGAWITTQLAEVSLDLDADYLFTELSTADSLIQRMGRCNRKGEKPTDKPNVFVFTKDCSGIGKVYYKHLFESTLKNLKDGLWDWAFKWKLVENVYSEQSLKGTKYLERFNKAEEYIKSLWEGTDSLIRSKSQAQELFRDINTISAIPIKFESEVENLMQKWEAVKGNLKERTKIFNEILEYTISVPEWSLKKIKLQKANEKLRRFGVYYLEGDYSEDTGFVIKPEADLEQIDNII

SEQ ID NO: 11831 - protein, 812 aa, Bifidobacterium breve ACS-071-V-Sch8b
MGHALMPKDLLLARKDDDGNTQTLYDHLHNTAKLAAGFEKRSSVTAFAAGLLHDSGKATDDFKRYLLTGNRKRGEVVHAKQGAFIVDDCAADFPSSAASMITAEVLELAIANHHGHLPDCLDACGGTAYFRKLTGENKKAEQYHYQEVLSHVSSLNLDINTNFANSVAETNRLLETVDSCGISPRNTRNSRSFFLGLYAKYIYSRLVDADRVDAANFTAHQPYTSQTPNWEELTRRLENAISGFDTSSKISKIRMRISEDCLAASTRDTGIYRLGVPTGGGKTLASLRFALHHAQETGKHHIIYITPYLSITEQTVQVFRNVLDLDKDDEILLEHYSSVVPDKDDEKEQQRRLAAERWDKPIIVTTMVQFLETVMSAKATKLRKFHNLADSVIVFDEVQALPTNTINVFNEVVSFLSKILGSTILLCSATQPLLEQTDRRNLLLSDKPDLIDPDNDYAEQLRRTNIVASSQGLTLDDFAAEIYSKALDNGNCLAVVNLKGEAKQLYQLVKELDVDHRFTLVHLSTAMCGAHRKNQLAVLKKCLPKKTGDSGQPVICISTQLIEAGVDISFSCVIRAMAGLDSILQAAGRCNRNGESQMPRNVYVYPIKDESGLRYLPEIQLGKEITDQLIHDYPEQDLLSAFMIEEYYRAYLIRYPKLVDSKSRNIGTMDYSILGGEETVYDLLSFNRRRRGLYCNRVGEQYPYAFAQAFQTVGDSFHVIPGGTTDVVVHYGQAMELIDQLSGEGDFASKIKILRSLQEYTVSLFDYEFKALDKSKSIGEANGDFGILVLNEENYSQDFGFLLKAEMPLLMK

SEQ ID NO: 11832 - protein, 728 aa, Desulfotomaculum nigrificans CO-1-SRB
MEYYAHSDGTKNKKFWQKLRNHLEAVADLAGKFGEKFGSKEPAFVAGLLHDIGKYSAEFQARLEGAAKRVDHSTFGAQEILSLYKKPIGYLLAYVIAGHHSGLPDGGSVADDSSLEGRLKKTGLPNCSGWTKEIASIPDSSRLRPNLRPINGQLGFCLSFYIRMLYSCLVDADFLDTERFIAAETFNRRGGWPTLSELMAHLDQYLDTMSAAAPDTPVNCLRKDILAHCREKANNQPGFFTLTVPTGGGKTLSSLAFALRHAVRHGLERIIYVIPYTSIIEQTADVFRSALGREAVLEHHSNFQYNREDDEDWQEISEKLKLSAENWDAPIIVTTNVQFFESLFANRSSKCRKLHNLARSVIILDEAQMLPTDYLKPCLAALIELVTNYSASVILCTATQPALNRLMPESICFKEIASDIDKLYEAFRRVKVSFIGEKTDAAVVEQLSRHEQVLCIVNTRRHARMLYEQLKSVGDVYHLSARMCPVHRTEKLKEIREILANGKPCRLVSTQLIEAGVNIDFPVVYRAAAGIDSVAQAAGRCNREGRLRTGHVFVFKPEKHGLPGGWFSRTAEIAGMVMREFDDPMSLAAVRRYFEYLFDIDREELDKQRILQLFRENEKHLLFPFTEVANKFKLIDSKTVSIIIPWDKEAKELIRELQFTNYPAGMARRFQPYTVQVYTYEFAELLRTRAIRTVAGMYHILDDSRYYDEQVGLLTPESTVLPEEVLIF

SEQ ID NO: 11833 - protein, 781 aa, Desulfotomaculum nigrificans CO-1-SRB
MYLDDIKQALADVWAKSTDSSEKSGLSLFQHTENVIKQMGQFILLYHTELNQVAEMNMTRVLLYAALMHDFGKIHPGFQRMLRKGTRFGLRHELLSLAFLEFLKIPPEEKPYLASAIALHHKNWVFITNGDIIYYDRCFSVEEVNSVFRLVEGLKQHEINGLLLLLKNAGTYLLTVTGFCIEPYKFIENSITPSGIYRNLTLIDHFIGTFVKQGRRAGRQINRQVCHYATIARGLILSADHLASAKPMELTPGFTSAEQVLTALNLTDDSLHPHQKQLKEAATSKILIAPTGSGKTEAALLWAGSVREAKQTKGRLYFLLPYRASINAMANRLRRGFGEQSTAVIHGKTLIESYQQLMENGYTPDEARKLASYQESLARLNTTPIRICTPYQLVKTFFAPNGYEAMLCSALGAQLVFDEIHAYDTELTAMTVAAAKFMKHVLGAECLFMSATLPNHLKNILQEQFMLDEPVKPSGEWLASRVRHRLNLIDNHITSVNSIERIKQSAEQGSVLVVVNTVPRAVKVVEELNKVGLRDITLLHSKFCPRDRIDKERKLQPIEGKILVATQVVEVSLDIDYDTLFTELAPLESLLQRFGRVNRNRPLESKGVSTVNVFTEFANDNETSYRPYNKAHLCQVKKVLQDYLRENPGGVINETKIQDMLDASYPEVLKEDLAIKIKDRLERFDKSFVQELLPLGINEMGTIKNLREEWDNLFDGVEVLPAKYLDEARNMPNPLDVAQLLVPISRAQLQRLQRERKAWRDEEINQIITNCDYSYQYGLII

SEQ ID NO: 11834 - protein, 754 aa, Methylomonas methanica MC09
MPTQHLNQTVYYAHSGALEDLSDGQTLFDHLSEVSEIARQNAQWFGAEELAMYAGLLHDLGKYCPQFLRRLQGGKIRVDHATAGAKIANERWQQMGKLLAYCIAGHHAGLANGIDEGQQRSTLDERFKLKFGEDIPHLDPVWQQEIKLPTHLTPPALKLHKIWPGFQLAFFTRMIFSCLIDADRRDTNNYYRRLEGKGNAESNYPPLSALRVRFNTKLEKIQQNLATQPPKSINQLRQRILDRSRKQAELRPGLFSLTVPTGGGKTYTSMAFALDHAIAQQLRRIIYVIPFTSIIEQNAKVFREAFGDLADAVIEHHSAFDDTKLPNNDARDTLKLAMESWDAPVIVTTAVQFFESLFADRPSQCRKLHNIAGSMIILDEAQTLPLKLLRPIMAAIDELALNYRCSVVLCTATQPALKKAEGFINGFEDVREISPDPLALFTELERVTVKNIGEHTDEHLLTHLQEKEQVLIIVNNRRHARSLYDGMKKLKLVGATHLTTLMCAKHRSQILEKVREDLLQGKPCRLVSTSLIEAGVDVDFPCVLRAEAGLDSIAQAAGRCNREGKREPKDSEVLIFQSPDWRAPPELEQLAGNMREVMRNHSGNLLSPSALTSYFNAVYWSKGDELDKRKILETHNNHCRQLSFPFQNIARDFRMIETMLKPVIIEFDDEAERLLRDLEFAENASSIARRLQVYLVQMPEHGFKELLKVGAIKPIKPEKFGDQFWRLTDPDLYDGGAGLSWDNPVFMEAEKTIM

SEQ ID NO: 11835 - protein, 902 aa, Desulfofundulus kuznetsovii DSM 6115
MSFLAKSNGVTLEKHIADVLASVRVLEQKNRECHPRELWRDLKLAAFLHDVGKVDPVFQQKLKSSVEEASRGASTISHNLISVFLINREKLLSYAQNPEAVLGAVAFHHWRDYYPDLFLGARGEEVSRMARSMLEEREMWEDLVNRLHHELQTLAHEYDIDPEVISFNKTWADYFQYNSIGNAGLLLPPYLLSFLPQKLKLRDIKDDQERIFLAGNLMRCDHFASLIETEDLDLSPEDIEHNLFPSTSELHRSLEEDFREKAAARNEPEPSFWQRDFFASAPDLREGSLVFIAPTGVGKTEFAYLWGAGRKNIYLLPMRAAVNAMWQRTRRAFGRAREDLTGHIAFLHGEAAMELRSAGRNPDLEGESLTRSLALARHLAEPYIIATGDQVAPAVLKYPGYERLYTVLMDSCLVVDEVQAYDPRAAAVVTKLLEDVHNLQGRVLLMTATLPPFIQEEISQRLRLSSDRILNFLETSFGKAFAGQVRHRLQFKVYRKKPAQTKLGYPDVVSFQVLMEEMVALARDGKKVLAVFNTVKAAQEAYDLASSLLDGVEGSPPLLLIHSRYTRTDRRENEKAIEDYMPNGRAPRLEKGCLVLATQVVEASLDIDADILYTELCPVDSLIQRLGRVWRRAARQASGMEEPSYANVYVLVETEDLCSGCGRVYDRHLVALTGFILARQAMGDLELMGEQSHIENLLADYRDIVFKKDRRRAYNPDEKENSALCKLLAKAPQFCLNELEKVRLVALTYGALTWSWKRGEKDVGSYLKEYYETLDILDSGYCSDRKYDAQRLFRQVYTVEVVPRKRIEEFGRKLKAFIERQDRPCYFDFNEQVLGNFTVPVDFRSLPSHAVTQPLAEVIDISFINARFARKIERWLQGIMVVPAHYDSQRGLVLEVGENGEE

SEQ ID NO: 11836 - protein, 836 aa, Desulfofundulus kuznetsovii DSM 6115
MLNEARLASLFQKIINKPDASPHPFQIEVTRSILDGNNVMLIAPTGAGKTWAALLPYLYARKYEEQIVDRVIYALPLRALATSLYDSTIKGCERAGWRIINDPNQRDKGCLFDELCITIQTGERKEDPFFQGDVIFTTIDQLLSSYLNMPVSLPEKMANINAGAMLGSLIVLDEIHLLEPERSLGTALEMATRLRGYSLFLWMTATLSERAIDLLKNKLNAKHIYVTKEELERIPGQLEKKKIYHWVNTPLEARHVMEVHHGGRSIVICNSVKRSQEVYRSIKEKIKENNLTTKLFLLHSRFFNSDRQQVEDKLLDYFGPDAKETDVILVATQVVEAGIDISADNLHTELAPANSLVQRAGRCARYKGERSKGTVWVYELCQNEKGQYRMGPYRDQAEIVTKTRQEIQKISGNVDYLREKQFLEKVLEKQETDQIARVIADLPRRYQEVNLSIELAGKGRTLSAVRNLIRDVDSLNVLIHDNPEKHDLFSPVEYLSLPRVSLWALQDLFNNKKEAWVAKFLVSGDDGNEENGVFYWKEATSVKQLTTAGWLVALHPGIACYTPEIGLALGTPGLPITHPAALKPLIIRPEYQCESFREHAFSVVEEGMKILERHQVALKNISSKMGMEIKALIDLIRITLLLHDTGKLNNKWQEAIRAWQYLVDPDCSLLKKNEPLAHSTFSWEKHHQLQRDLQKDQRYQRGPHAVEGAFAVANSLIDFLENYPNGSIDPELALVAWTAIARHHNAGAVNLSDFVVDQRMKNYVNNCLIELGFEPFVKQLDDKPSAVDRKTFGEKELLRPSAGGEKYLPFYWFTVRLLRLADQSSQRKNSEFMRKG

SEQ ID NO: 11837 - protein, 817 aa, Thermus thermophilus SG0.5JP17-16
MGEGIGRVFFLKDKVGFQPLSNHQGLVVKLLESWREGDEPLALSPKTKERLLLAARYHDDGKRFTFRIVPDGKGGLTYSFRGHRFRVAQAVQDPYAQALIRGHHDYSTREVVNLAADFLEEGLGHRFPEDLFLLMMADQLEAELAVRLWQGQAGEVRPFVEFDLLPDGEGGFLLDPWPFRVDEVALDFLVYFHPYRGEEAEVVEGWGRALVGALEEGKVPEAFQEETRRVRLRPWAAEARKADDPEAFYARFGLEPTPFQREVFKVAEGDPAHLLLAPTGTGKTEAAAFPALARGERLVFVLPTRSLVDDLEGRFRRYLKILAQEEGRPKALVVDTGHRQARFRFSPDGQEEATKERHLYHADVILTTLDKLLYRYFGYAEGVKSYTFPRRIHDRRTLFVFDEVHLYEATAWANFRHLIASLYKAGVRFLVMSATMPGTYREELLLEGTLEHPPAKRPSRVLRYMPQGNPMEIIQSHRGKRVLVVLEEVKEAAELYKRLKGEGVFLYHGRLAEGQRRRVFGEVKRRDEAQEPYLLITTPAIEVGVDLDAEVLVTTLCPPENLLQRLGRVNRRGRGQGEAYVVGETYPDYLGSLPEGYLELLKALDGQDLAQGGEERLRQAIRYPKYLDPRAETFFEALQEYVYGLDLTQEPLHRKGFVATRGWTPSVRLRQGEDEVEVPIDRLVGRKEELTPVRVVERLLTDGERGNRRWEEVPLRSGELYGRELVVDYPYPYDAELGFVELPKVFQRLRHPDPQRVQLLYAPEKDAGETPEGVMDTDQVTGGGRRVLWYLGESAWAESAKSGEVAEETEEEEEEGD

SEQ ID NO: 11838 - protein, 727 aa, Thermus thermophilus SG0.5JP17-16
MDPKAHTPNPQGAWHALKDHLEAVSRLAGGFAQHFGTPSLGQALALLHDLGKATRDFQAYLKVAAEGKRTNSVPHAVWGAALAYVALGSGQHEGWEAFGLPVMGHHAGLPKRGEAASKLAQALKEEPFKEVAAFLRSSELRTRLEGLLNEALKEVRSKTAGDPLRLDFLVRMAFSALVDADYLDTEAHFDPSVARLRQEGYSLEKLWERFHRDQEALLQRVRPSLVNSVRREVYEACLQAAELSPGLFRLTVPTGGGKTRSGLAFALRHALKHGLRRVVVAIPYTSIIDQTAQVYREILGEEAVLEHHSAYEPPLGEEQEENVLRQRLTTENWDAPLVVTTTVQLFESLFSNRPSKMRKVHRLARSVILLDEVQTLPPELLKPTLEALRLLATPVEEGGYGATVVLSTATQPTFEVIPTFQGLPVREIVPDYPRHFARLQRVVYERRPKPLSWEELSRELQTRPQVMVVLNTRKDALALLEALGEDPHAYHLSTLLCPAHRREVLEEVRRRLREGAPVRLISTQVVEAGVDLDFPEVWRAIGPLDRVVQAAGRCNREGRLDKGKVVLFWPEEGTTPRGPYRVGVEKARLLLEEYPPERLHDPGLYQAYFKELFTTVKTDKGIQEHRKDLDYPEVARRYRLIQEDTVSVVVPYGEGLARLEAFQKAPSLQNWRRLQAFVVGLFRNQVRERCGFLEAVPGFQDLYVWRGSYDPRRGLVEEYADPSDLIV

SEQ ID NO: 11839 - protein, 763 aa, Hydrogenobaculum sp. SHO; identical to SEQ ID NO: 11829

SEQ ID NO: 11840 - protein, 735 aa, Hydrogenobaculum sp. SHO; identical to SEQ ID NO: 11830

SEQ ID NO: 11841 - protein, 791 aa, Desulfotomaculum ruminis DSM 2154
MSQGHSSLRSHPHLLLHEHIDQVRIAMRALQQLHSSRTVTFRIQDIMERTAVFHDLGKATDFFQEYIKDPESYKGNSSDKAHTGLSVFLTLIIAKEQEWDVRDALMVVAAISGHHSRLPTFSEQRVGFVDETKHAIERFANGSNVSTIQRQISSIDFEILSSEVNLEFNEIKTVRDSPQEITLLIRKALKFLNSKLIKENKNLYLQEAIAFRLKCQFIYSIMLEADKALLAVSDPAIYLMRPVNQWQSKWIDKRIGKPDVTDTNCLRQKIRNEVVEVIANKRDSRIFNLTAPTGAGKTLLAATWALKLRENTDNYWHPPKIIVVLPFLSVIDQTVNEYKKLLRVGGVENDSEWLLTSHSLSDRVYDSELTTGDNSFLVDTWRNDIIITTYDQFLFSLIEPYAKYQMRFHNLCDALIIMDEVQSLPCKLWQPLDEIFEQLTLVGNSKLLLMSATLPPFVKNAEPLLKNPNLYFAQCKRYCLRLRLNTHISLDEFCLELEERLDDWFTQRLRVLLTFNTRKSARKVRDYIDDWRKGKDEFADIPLFFISADVTPKNRLQSIDKIKEGNPCIVVSTQCIEAGVDIDMDLIIRDFAPLDCLIQIAGRCNREGGKETRGIIEIIDIVDEGKRYSEMIYDEVHLSVTRRLLKEYKEVLEEDILTLTDCYFKELSVRKDTGFIHLERFARWQDDVSIRELLRGKEKQQYTFLVIEQDPTLYQDMCEIMEIKNIWERREAWRRVAGRMAMVSVNVFVKPGFYPQQIAYEFKINTGLWILKDGYYSDDKGLVVEGETMIF

SEQ ID NO: 11842 - protein, 910 aa, Ralstonia solanacearum Po82
MEKGAARYFAYWGKARMQEGASQLYHLLVFHALDVAACGAELLRLPRFSLAPLAAELGWPLRIVEKIFIWFLALHDLGKFARAFQNLAPGLSTDLVSPDQTKRYLRRHDTLGWLLWQERAACLGASLPDPVHGFWAAWVQTAVGHHGMPPQETAGGGLLPLQLHTFYLPEDMDAAVAFANAVAPFLLPSDIPVPGRAQRQTLLRHAWRLAGLAVLADWLGSNQEHFRYCVHPQDLSAYWCEVAQPAAARAVRLAGLSDQAVSPWQGSQALFPYLVSSTPLQRYAEIVPLAQGPQLFLLEDVTGAGKTEAAMMLAHRLMAAGHAHGIYFALPSMATANQIYRRTAAMYRRLYQAGTVPSLVLSHGARQLVDDFWRSVLEPQAHDDDFGYGREESSASAQCSAWLADNRKKALLADMGVGTVDQALLAVLPARHQALRLLGLSGKVLLVDEVHAYDPYMHTLLCRLLTAHARQGGSVLLLSATLPTGMRAELIAAFQVGCGREGAEPAADTRYPLATHVHAEVSTHACATRPQLVRKVAVAPFHAEQAAVERVIAEARAGRCICWIRNTVDDARHAFIALQAHLPEPSLALFHSRFAMGDRLAIEAAALDRFGKASTAAQRRGRVLIATQVVEQSLDLDFDIMISDLAPIDLLIQRAGRLQRHARHGDGEPATDGCERRPAPPLYLLCPENTDTPASDWYAALFPKARHVYPDVGKLWLTQRALLAAGHIVSPGGPGEDGAVRSLVEAVYGAEADSIPDALQPATQEREGKDMAAVSQAHFNALNLERGYCTDSSRHWYEDTQTPTRLGDETCEIYLAREEGGGLVPFVAASDFPWEHAAVRVRAGTVGTLSDCWQAKFGPAIDALRKRHRLLADPALVLPLAWEDGRWVGYCERNGKAQRIEYDDVLGLQV

SEQ ID NO: 11843 - protein, 762 aa, Ramlibacter tataouinensis TTB310
MPPDHTDHASPAGNSSDFFAHSSPDGDRSRWQPLVEHLRSAGDLAAQRATIFGAEAAARVQGELHDLGKYTDAFQRRLAGDARSVDHSTWGAKVAVERYKAAGQLLAYGIAGHHAGLANGQGEGERTALATRLLDSELEPLHPVWEQEIRLPAELALPRLKAHPQRKQFQHAFFTRMLFSCLVDADFIDTERYYLELSGKVPARTGAYPSLETLRAQLNAYLQGLPREGDVNPVRTRILDHVRSMSECTPGLFSLTVPTGGGKTLASLAFALDHAIRHGLRRVIFVIPFTSVVEQNAAVFRRALGTLGDIAVLEHHSAFVEQPPPREDPEKYQSFKKLRLAMENWDAPIVVTTAVQFFESLFAARPSQCRKLHNTAGSVVVIDEAQTMPLKLLRPCVAAIDELARNYRSSVVLCTATQPALEAPRFEGGLDNNEVRELAPDPPRLYKELERVRVRHVGTLDDAALAGHLRTRDQVLCIVNNRRHARAMYQAIIDLPGARHLSTLMCAKHRSQVLEEIRGLLEARQPCRLVATSLIEAGVDVDFSTVLRAEAGLDSIAQAAGRCNREGRRSSETSEVLVFATANEDWAPPAELKQYAQAAREVLRRHEQDPLGPQAIAEYFRLLYWQQGSDALDAHNLMGLLRESRLDSLPMETLATKFQMIDNVQMPVIVPYNDEAREALAALRFAEPKGGIGGLARKLQPYLVQLPRQGFHALRDAGAVQPVAAQKWGEQFMELVHEDLYDLRFGLDWRNPSFVQADRLHW

SEQ ID NO: 11844 - protein, 725 aa, Pyrococcus yayanosii CH1
MKVCYAKFIPHDFLECHINDAINVLKSMKISFKWLEELFPRVWELSFYSVLLHDLGKCASGFQRDPRGWGYRHEVLSTPFTAFLELPEDERNLIALTILTHHRPLDELEEILPSGEHRGEFEEKVGELFQNRDYIEEIFFERVPYWELYFFGRRKDLFNPPADWVEQIEGYDFDPLLSWYERNAKKYWSELVFLRGILNASDHLASAGELGIRLLSDIRAAVESRIPLERWRLLQRQAGETEGNLILRAPTGYGKTEASLLWADRNAFRTKKGVASRIFYVLPYKASINAMHSRLLALFREPELVGVLHSSSAFYLYSSELEYKRLSSLYRKIYTPLKVTTPFQLMKPFFGVGFPEMGLTELTGSLLIFDEIHAYEPNVLGIILAMLELLMRKKAKALVMSATLPKFLEKLLREVLKPHLLSTPSEEADRFTRHRVNVIDGSMDEVGELVEEVNAHGPVLIACNTVSRAMEVYSRLCDRYNAMLLHSRFTYGDREEKEKKLLASLEDYDVVVATQVVEVSLDVSFSTIITEPAPLDALIQRFGRVNRQGFGNPRDVYILTTGGEGDKRIYPMEVVKESLRILEELNGKPLLESRVPELVSHAYEPIADKLTDEVLTYREQALELFDSLKPLKSNESERQFYEMFQGLEAVPGVYQDRVLELINRGRSIEIHRYLVPVPLWLFMSESDAFHRLSDRGPGKYVLVAELEYSPELGLLREPASGGEVL

SEQ ID NO: 11845 - protein, 526 aa, Pyrococcus yayanosii CH1
MNAYDKVVKRLGEIKGFEPEKRPLLERAFDMILSSEAPFFVVQAPTGYGKTSLSFSFALYSMEDASLFDRVIHVLPMRSIIEDIDRTAKEAFGFSRTKMMGSSEEFLHLFPLNITTVDTFTWDVLKLNTKKIIQVDKGSEFGYDYLTQASILTSLVIFDEAHFILEEPKMKTAFLAVLEFLTDNCVPIIVMTATLSKGYVELFRKYARKNEYDFEILIPQEDDPFIQRELRKEFKIKFQTGNPLDFIDNAKRNAIIVNTVSRAVEIFDQAKENAAELGLNEDKIMLIHGRMKPSHKEKLIEKLRKWKHKESFLVIGTQAIEAGVDFSVDLMITDAAPINSLLQRFGRVARYNERKAEIIIMEDAPAGPYNGEKVKKTINLIKEASELNPRIPWTYQEIVDEVHGKTISKVMRGVNRSLMKKLYGLLKNPRKRSKDVLDEIKLITKENEPLLRDFLIPLEVEGETVLISPKRLLELYKKGLAEIIVGERKLSLRSLEDAYNVAKRIALGEVIAVKFTGKYDEERGIV

SEQ ID NO: 11846 - protein, 692 aa, Pyrococcus yayanosii CH1
MDWEELIALMKTRMAKPGKSLYEHSLGVRREAEKLLKRIPHDKSLDDCILRHAFLHDVGKLDDRFQAKLEGKRKRAPPHAYLGIEVASLFLDCDEPYRTIALLSILTHHSDLHEGLYQREIEENEKLMVDGKVISSPAETVRNLREAIFYEDLIYDHGLDPVELRNLYTLFNGVLRLADWLDSAGLGAESYHLDSGHSVHQRVIEYLRRRGHELRPYQRAVIGKGGGYFRLPTGDGKTETSLLATPDSVSKVVYSLPTITTTEAMRTRFEAMFGRDKVSFSHSMLFLSLYHRGELDKKLIHRYAMKPIFISTVDQVLLAFLNYPRFPVREFALRNAHWIIDEIHAYTPYTLSLILNAIEHAIKHLNTRVTVMSATLPNLLAEELEKRGLKPLISPKSVESRYRLRKRVEVRVRNEPLMNAIDEIARENGRVLVVANTVSRAVRIYGELRRRRKDVYLFHSRFINEDKRKKMRLVEKIEKGILVATQVVEVSLDIDYDVMYTEAAPIDALVQRFGRVNRRGLKKGRVYIFEPEGKRAYLPYDRAAFNASLNLLGELEQIGSELDLLRINDRFYEEIWGRYERAINGRPPLVKLRDVTRWSLAEKYLSTRDAFITLPAVPRPFLDEAIDYASRWEEMSHEERLKAAVYVIEHTVNVPIWTLKEHLHHSDDLYDVFGVFGVELEYDSETGLLEEL

SEQ ID NO: 11847 - protein, 726 aa, Thermodesulfatator indicus DSM 15286
MAELLAKPDKTLREHLEKVAELARELALRLGLREDLLKRSILAALFHDLGKATRDFQRYMQLLKEGCEKEARHLKPKVFPHALASLNFVFLVEAEIFGEPFLATGAVLSHHSPLSGDLYHTWEGKPVFEKGLEELITHLLEAWKTVLGDIPGPNNFDTIRKIPPLVLLERAHERDGRKVSLRGLIKEAPRWDFARVKAVLHLADWLESSGKQSVDEIFLKDARKAVKDHFSRRKLTPYEFQRRAEESSQNGLALRAPTGSGKTEALLLWAGGAERILYLLPTQATVNAMFQRLKDIYGAKKVGIAHGHASYILHQENEEDFLWERLSSSVFAKPVTVATLDQFLLAGLQGRHWEERLTLAASANIIFDEIHSYEPYTLGLLAEALSDFPAQSLAFASATLPKALLEIFSPENLLEAEEEFFSRKRHRLSLRPFPLKEALPEIIALAQDDHRILVILNTVREAQEIYRELRQNYSDQVYLFHSRFVFRDRLEKERLVQEQRPGTILVATQVVEVSLDISYDVLFTELAPLDALVQRLGRVNRRGERPLAEVKIFTQVGEGSQRVYPEGVLKNSLSLLKDLPKNPAEREWVEAVSLLYEEIVREDSFQRDFDLGRRTLQEVREILGCYTIDLADEELRARFATRKGTPSVEVLPETLLEEAQAFKAQGEAWRLVELLVPVPIWWLHAFKGWFYPSEDLGCFVTRLPYSIEEGLLPPKKDETPEEYEFW

SEQ ID NO: 11848 - protein, 726 aa, Parageobacillus thermoglucosidasius C56-YS93
MTFYAKSETKETIREHTDRLLDNLQLLKDSYGRKFVRIDERMWELLRLAAEYHDVGKANTVFQNKIRRAIRDEMLETDCDADVPHNYLSVGLIPFSQLDLTKEESRLLIHAVGYHHERDKPPDKEMIRHILEADMKKQRNAISEHMQLPLAEKLSFRFVDRLLKRYTIHDGEQFWNYVLLKGLLHRIDHAASAHLPVEIDIDRSVGASVRTYMKKQGFRKNALQQFTEANQDKNVVVIAQTGMGKTEAALLWIGDDKAFFTLPLRVSINAIYERIRDKMGYDAVGLLHSTSVHYLAEKGEENWEAMKQQSQQLSTKLLMTTIDQILKFPFYYRGFEKELATMANAKIVIDEIQAYDPKIAAMLIKALEMIHNVGGKFMIMTATLPTLYLDELKKRNIIDEEHSAFGEFIDTSKHRHRIQLHAKEITEGLEDIVRKAQTSQVLVIVNTVRRAIELYQNLLERELHIPVYLLHSQFTQEDRQLLERKIKEFNDEKINGIWITTQLVEASIDIDFDYLFTEMSTLDSLFQRLGRCYRKRILNEERCNVHIFTKNISGVPRVYNEHLINESIKLLQPYDGHILDERTKVEMVKQLYERKRLIGTAFLQDFEDALYMFDNLDPYGMNKKEAQRKLRDIQNIQVIPRRIYDGIIDLLEMYAACRDVKKRLHLRMEIEKKTVSVSRFIAEKYVSERLPKPFEHIYIIDVEYDFQRETWKGKGILLDTPMSTFY

SEQ ID NO: 11849 - protein, 827 aa, Parageobacillus thermoglucosidasius C56-YS93
MYLSHNNPDKKLTVHLKEVYEYSQDMLKHVPLSDENRDMLEYISKIVAVAHDFGKYLSYFQDYLRTGETNGDLHHHSFISAVFAAHLLRHPANLNASWSEFAPLLGYFVVMHHHGNLRDISLDVTKSRHIAENTVQDSLYYRVNTLKQQIDDIKNHASAIVEDLSPLWDELSIPLSLSAELHSFLQNYEKAFDEVYRQYYLIDKRRKQELTRELYYYVLLLYSVLIDADKLSAANIERKPRVHIPAHLVDQYREANFDVNVTEGTNGWRNRMYNVVMERMEKLFKTKPEQRLFTLTAPTGAGKTLLSLSVALKWREQAERQYGYSPKIIYALPFTSVIDQNEKVIRDLLSQLADFHANEQRYLVKHHHLSTFQYRTENEELPLRKALLLTESWEAELIVTTFVQLFHTLIGYENRALKKFHQIAGSIIILDEIQNVPMEYWPLLRSVLYKMAELFSCKILLLTATQPLIFPEGETVELLESELVKPIDFFKEMERVELHWLGGDKGAYSPAEWMELFQNRFEDGKTYLAIFNTIKTSIEIYEGIKEWLKERGYDVIYLSTNIVPCERKRRIERIRQLLKEKKKVVVISTQVVEAGVDVDFDVVYRDLGPIDSIVQAAGRCNRNGKLHELGKVYITPMEREGKLESQYVYKGVHTKIAKEVLPKTPVSEHQFFDIIMQYFTEVRGKKSFDASDGIISAMEELKFDAKDKSGSKNKPKYVSEFQLIENAHQAVDVFVEVDDQAMDIWQQYIQQVIEEKDFETRFENYLRLKKDVRQYVISAPIKLVKNLDRDLYEKTRMIHLANDILNQYYNSEYGLIRTSEMVDAWIM

SEQ ID NO: 11850 - protein, 730 aa, Pseudothermotoga thermarum DSM 5069
MDVLDVLAKPDVPLIKHSSEVVQLAQKIAKILIIENGISQRAILACAFHDIGKSTHSFQKFVRKETKKAYPHALASLPFIMLVESILFDENLLATAAVLTHHSPFTPMLYKGFESSSKEPDYLDKEIIKKLLAQLLQEINMRLPNSQTVDEITQQALTLGKNPAAILDTQITYQDGDTETIRLKLMNLPIDDFSNVKAILQLSDWLVSSSSLSVRNLFLGKSNAWIEKIKSTYNLRNFQRKVLSSPGYVLWLKAPTGTGKTEALLLWARDSKKLIYLLPTQATVNAMWKRLAKLFGKRKVSISHGMSGYLLRSQEKDEQEYWNEKLLAKVFGKPVTVATLDQFLLAHLNTRHWEIQRTLIRNSTVIIDEIHCYDGYTLGLLSQALEFEKPLKIAFASATMPEFLKNILPQGQEIEAEKKLWNRRRHFVELVENPLEDCVDEILRYANQGKNVLVVCNTVKKAQQMYQNISQRYRKVKLLHARFIYKDRLKKERHLIENQNKMRGVILVSTQVVEVSLNISFDVLFTQIAPIDALVQRLGRVNRFPSRSNQAAPVFVSLYEDEDSKRIYDAEILQESRQITMNLPKTPTEREWAEAADQLYKAIWESQTFQQEFNEGKRTLYELRKMLGCYTIDLRDEDMRRRFSTRKGQLSIDVLPAKFFDEARKLMETNQSWQIVEYLVPVPIGWLYAYKDWFQPISDLSCFQVDLEYDQKLGLLPPSKDKMPSNMEIL

SEQ ID NO: 11851 - protein, 742 aa, Pseudothermotoga thermarum DSM 5069
MLDRLKSHEDRYLIDHLDSVTNLMLKKGKLINWEFFDLPWQKMEKILKVCGYCHDYAKATSYFQEYIEKRRKKGVETNHALLSAIVGFEASRKLGLDGKTSAFIYLVIKHHHDRLDNFGPFEIEHMQILQNQIKTISDEFKRWVEQKLGIELELSLENEIKKIKRLFLLNTVDERDYLFVHLLLSLLASADMEDAAFHGLAPSWPEGGLTGSLIDNYVSKIPRKTSIDELRQRFYKSTLEKLKKAAGNVFSVTAPTGVGKTLVNLRIAAELVGENGLIVYCLPFISIIDQTVKVIERLFSSEIDANILLPYHHLADPEYKEYEYDKPNEQQTRVLIEDWHSKIVVTTFVSLFESLFTNRKVPFLHKLSNAVIILDEVQAVPYKYWEPIKIMLSMLSKLGTKIILSTATQPGILDNCTELADRNLFKDLDRTKINFCGEIFIEDFAEKLSKLTKEKLIKGQKMLVICNTIRESQNLYLALREAIGSKDIYYLSASVIPKHRLERISKLKSLSKPVICISTQVVEAGVDLSFDYVIRDEGPMDSVVQAVGRCNRNFEKKLGIADIFTVKDERRALSKYIYDSINIDVTRRILEKNKTFSEQQFHGVVEEYFQEIKLISNQDKENLCEKLRNLMFDEIATSFRLIEDKGETVAVYIEYDDEAIQLRKEYNQIVEDNSLTKFEKLAKLSKKYKQMSSYIVDVRIDKRLVENALVVEHGLIVVPSDQLDLWYDKTTGFGRKDGIIEI

SEQ ID NO: 11852 - protein, 322 aa, Bacillus coagulans 2-6
MVWAVCGAGKTEVLFNGIEAALANGERVCIATPRTDVVLELAPRFRRVFPDIPIAALYGGSPDRHKWAQLVISTTHQLYRFASAFDVVIVDEVDAFPYTFDETLQRAVQKAAKDRCARIYLTATPGETWQLECKAGKRPFVTIPARYHRKPLPVPIFKWAGNWRRKFEKGQLPVPVEAWVKKRLETGKQALLFLPNIRLMKKAEPVFKQLHPSIESVHAEDPERKEKVEKMRARETPLLLTTTILERGVTFPDIDVCVVGAEDAIFTEAALVQIAGRAGRSADFPNGDVTFFHYGKSNAMVKAQRHILSMNEEAGKRGLLDA

SEQ ID NO: 11853 - protein, 917 aa, Methanosalsum zhilinae DSM 4017
MNFYNNWGKFRTGSDEEFNYHLLAYHCLDVAATANSLLHNDKIFLEKFKNYLPIEDDDLICLITFYIAIHDIGKFSKNFQSLQPHLMKKLRGYSSEKSYEIRHDSLGYHLWNSLWNDLWKMNILSLDKTIYDEFDWNELILPWLRATTGHHGYPPIYINNGVQINYDELFSSDDKEMAVSYIESISQLILKNGFSSLTSNSGDVDIFEDLERYFKKTSWLLSGLAVVSDWIGSSESYFNYNSSIMNLEKYWTEIALPASKKALKDSGICPSQVSHESGINHLFGYIKKPTPMQNFVSEMELGNGPQLFIIEDTTGSGKTEAAISLSHRLMIREGLHGLFFGLPTMATSNAMYERLYESYSKIYEPISNPSLVLAHGQSHLSKIFRNTIGPNKTENDFYGENNTKESTISAQCSAWIADNRKKSLLADVGVGTIDQAIMSVLPSKHQSLRLLGLSRNVLIVDEVHAYDPYMHELLCNLLTFHASLGGSVILLSATLPLKQKNDLVRSFSTGAGYEFESVSKIEYPLVTHISSSGSEEQPVDYLSQNERVVSCEFFHDKTHVRKSIIDASNNGFCCCWIRNTVDDAIDAYNSIANCIGHENVILFHARFTMGDRLKIEESVLETFGKNSGNKQRAGKILISTQVVEQSLDLDFDYMVTDLAPIDLIIQRAGRLHRHKRDLNGNIATQDSRKTPVLGILSPRPTEDASDSWYSGMFSKGCYVYQTHGKLWLTAKLLLEMKEMHIPRDSRYLIEGVFGPNADESIPSALLNVDRNAYGETMAEKSMAVWRSLKIFQGYDRTGTQWIDDTVVPTRLGDSITLRLGKLVNGAILPLNSSTRHPWEMSQVNVSAIRVKYPSYPEEINELIDETKNSMKDKCKWSLFIPMELQEDGMWLGFGENQNRQKVKLIYDAKTGLHTSKY

SEQ ID NO: 11854 - protein, 713 aa, Flexistipes sinusarabici DSM 4947
MYAKSNPPKTIFEHNEDLVKNYDILKRYISPQLIEKYDKYLQKMLELHDYGKINTRFQNKLGICKNKIPKELTDIPEVPHEWLSLAFIPKNLKEEILNLDANNFNLYNVLRYSIAFHHTRNEIFDKNDFKSTVEYDLERNKHLLGIKYALNKLLNLTNLENSINDNFENIFEYLVLFKGILHKCDFSASAGTPCETEYKGNYQNDFKIGLQKRGIKELKPFQKNAKNLSDKNVILIASTGIGKTEYSMNWIKGNKAFYLLGIRIAVNAMHKRFADFFSKENVALLHGDISYFLTNETDSKNDYDHKMSKAKQLSYPLTIATADQMVTSVFKYNGFELPYLVASYSKVVVDEIQSFAPESIACIVVFLQEVSHLGAKFLIMTATLPPFIKEEFKNIVHFENPQLSEKKRHKIEVLDMQIEDYDFEKIQSNNVLVICNTVSKAQKIYEKLKEKKPKLLHSKFINKHRNVKEKTIMKCSNGIWITTQIVEASLDIDFDLLLTECCTIDGLLQRFGRCYRKREYYGENPNILIFKFDNISEKIYDKNLLQRSFSILRNDYNKKLLTEKDKQEMIDKVFQDIEKTCYYKSYKEYKELLKSGFKSSKNEAQKLFRKITNTHNVIPEPVYNKNEEEIKEIISQIEETSSLERIKLKEKLNKYCVSLQIFANKAKDIVKPLPVDSKYIKKSEIKMLKGVEYTYEKGVEFKKEYNDMDNFIL

SEQ ID NO: 11855 - protein, 895 aa, Zymomonas mobilis subsp. pomaceae ATCC 29192
MNSVFLKPIEPYIKSYWGKYKTLDDLPEKMLWHPLAYHSLDVAAAMEAILDIRPRYVQEIAKKGAFSETEVKHQLILMAALHDIGKFAQNFQSKNEDLAKEISGHTLNSEDWLRYGHGDVGYTFWKKCKDRIDPTFKKNEYFDDWLHAAFSHHGTPATEINLGNAIASSAIDDAQNYIKDIFDLFGWPERKEIQRSEKNALKEATWCIAGLVILADWLGSNAEKGWFPYEKPDFSLADYWKKAQEKAKTAITEAQLAEAAIATHFDLKSYFKEDVTATPLQKWAEQQQPNKGSHLYIIEDFTGAGKTEAALILAHRLMQSGSAEGIYWALPTMATANGLYARIEKGYRALFADNALPSLVLAHSARDFHKKFQISIEGVSRYKKGSNDPDDIPAEVNCAAFFAENKKYTFLAQFGIGTIDQALIAVLPVRHNNLRLAALSRRVLIIDEAHSFDGYMTKGIEALIEFQAALGGSVIILSATLIQAQKRGFVQAFGGDYNVVERNAPFPLVTYVDPEKHSDEYPLAALRGSRRDLPVKFFSSVEQVLETILFKASQGNCVLYIRNTVSEALEAYEWLKDHAPETVKLHLFHARFCLKDRQERENEILMLLGKESTIQQRAGQIVIATQVVEQSLDLDADYMATDLCPMDLLIQRAGRLHRHTHRPDRSPPELWLVSHSAIADAPEDWVSSLFPKGQYVYSDFGQLWRTVYTLEKMGGLPCLSQSPRSLIEPVFDKNGDCPEALQQASNIACSKRNEKRSMANFNFLKIENEYKETLFEVNAKTPTRLDAEGVTLRLGCWGNGHLTPWAQAEDERLAWRLSEITLRHNQFKEVAEIEDASLNASVQKMQDQWSKHYEAPRILPLRSSPEKGVWENCIIDPSGKERKVYYSFEKGLSII

SEQ ID NO: 11856 - protein, 746 aa, Zymomonas mobilis subsp. pomaceae ATCC 29192
MTTYYAHSGGHLDKSDWQTIPDHAFSTAKLAAEMARPFGLQQAAFVAGLFHDLGKYCTAFQKRLEGDNIAVDHSTAGAIELLNITKGRNKGMAELISYAILGHHTGLPDRSNETKTCYNQRILQSSQLDLVWKKDLKPEVSDLSPEMVKQFSGGLKEIAFSYAFMGRMIFSCLVDADFKDTEAFYAKIGQILPNREWPQLNELIDPFITRFEKYIASLPKKGELNQLRSDILSYVRQGANHAAGLFTLTVPTGGGKTLASLGFALDHAKQHGHRRIIYAIPFTSIIDQTSAIFRSVLGDEYVLEHHAAMDIEISGTKNTEQKDKLKLATEDWIAPVVVTTTIQLFESLFSARSSRARKLHHIAGSIIILDEAQTLPRHLLLPIMRVLDELASHYGCTIVLCTATQPMLGRRPGFENGLPIEGRELAPDPLHLAGKLARNQVKYGGIMDNSALVEALRVNSQILIVVNSRRHALELYNLAKEADIDGLVHLTTRHYAVHRRRILADIRNRLEIGQPCRLISTSLIEAGVDVDFPVGFRAEAGLDQIIQTAGRVNREGKRKKEDSLVTVFTSPDYPPPREIKDLIGDMGRIIGNHENMASPMAVEDYFREVYWRLADGLDEKKILDRFILSKSATDFAYRQVGTDFRMIENGMAPVIVAIEDKAKKAVESLRVKNIPSSKIARELQGYIVQISPKDRDALIQNGQARFEEPELRGDQFAILQKNDFYQEDVGLIWENYDHLSVDDMLI

SEQ ID NO: 11857 - protein, 716 aa, Runella slithyformis DSM 19594
MNTLFAKSGPEWTTLAHHLLHVSIAAKAFAKHLGIDETLAFKGAILHDIGKAHPAFQQRLLGKSKSTKVFRHEISSLFFLSVFPENEHPALIEMVVGHHKSAKNDVGEKGLLDLENGYDYVDHHLGKWDEWSLYGIELLNQFGIEAKPIPVEQALQNLETAVKFTKRKSNERGYSEWRGLLMGADHFASAVIHDTQTFIERTFQKPNLSFYERTSPLYPLSQKTDYKSGKKHSIVVACTGAGKTDYLFKRCKGRVFYTLPFQASINAMFKRVAKDLEKTNPNLDIRVLHGASTVVKRKKDEEESVLQSLFGSAVKILTPHQLAALAFGLKGYEALLLDLKGCDIILDEIHTYTGVSQAIVLKLVEILKIIDCRIHIGTATMPSVLYHKILHILGDDVLEVCLEEAELDQFDRHRTHKLATFEDSQGVIFDAIQKSEKVLVVLNQVEKSQVVYDSLKKIYPNIPILLLHSRFRRGDRNDKERQLIGLDDFGEPTGEFNTSNEACIVVSTQIVEVSLDISFDVMVTETAPLDAMVQRFGRVNRKRTLDTIGKIKNVYIIAPPEGKKEARPYDPDILQKSFNALSDNEVLKERDLQNKIDTVFTEIDFLNIEEHSKFKSDGRITIDKLTHVSKSILFELLDIDSVACIREADQEEYETSYFERRLELEIPVRYFSVHKMNQSEKGNKPFIIPDKAYDMEKGLMLKSIKEENLDSKYQLL

SEQ ID NO: 11858 - protein, 1080 aa, Treponema caldarium DSM 7334
MNRAENKATRLLQIENLLLAHPEGLTQAEIARKLQVDRSTINRDLMDLPASIYIDDIDGGKLKIDRSASLINLNLTLHEAMALHLASRLLATRMDRKNPHTASALRKLSLSMRRWADQIGHHVSIAADMMDDDSQKDDPNYVRVMELLTEGWANHRKVKIWHRSEKMGKTFMYLVSPYFIEPYAIGQTTQLICLSEPPGTLRTYKVERIERAEKTNEPYTIPKDFDPRSLLAEAWGIWYTDEEPQRILLRFTPRVAYRVKESLWHPTQIITEQDNGSLLWEAEIAEPQEMLPWIRGWGADCEVLEPKYLRETLEREVRKLAKLYGIGNISGPKSSFFAHRREGEDREDWQPLIEHLKKTAEMARDFCADANIAELAYIAGLIHDLGKYSDAFQKRLEGTGPRVEHSTAGAKELKALLKGTPQEVFAHLLVYPIMGHHTGLPDYGNETDLEGGTVCARLKNQLPDYSAYKSEVDLYTLSFPKRLNIQPLRLRVFPDKPTKDYFGFSLSFLVRMIYSALVDADFQETETYMKGSKPRGGYDDITTLRDKMGAYLKQFENPSSDINHKRNEILQACIAKGMNEKPGFFSLTVPTGGGKTLASMAFALHHAAEHGLKRVIYVIPFTTIIEQNAKVFKTIFGEGQVLEHHSNFDWEGKKRDNPDDRTNSALAKLKLAAENWDIPIVVTTNVQFFESLFANRSSRCRKLHNIAKSVIIFDEAQMLPREYMRPAMAAVWELVTNYGASAVFCTATQPGLERFLPENAEVRELAPNPHELFNFYKRVEVKYVGTLPDEDLITRLNAHEQALCIVNTRRHASGLFSGLEGEGNFHLSTLMCPAHRRTKLEEIKERLSSGKPCRVVSTTVMEAGIDLDFPVGYRALSGLDSINQAAGRVNREMRRGVSEMFVFEPKSEFIKKTPSFLKQSAEVTRMVLRDHAAEPISIPVISAFFERLYDLQDPNISFDVKRIMECFDSADARFKYETAAREFQIIEDSTETVIIPYNEEAQSLIEELKSTDYPFFTLRKLQPYTVSIFTTEFDKLSSKGVILTIDDTYYVLNPDYMKEYYDFDKGLIIPENGGGDGLLF

SEQ ID NO: 11859 - protein, 788 aa, Sulfobacillus acidophilus TPY
MPKLSECIARPRQGDREFLLTDHLSTVGHWASRRLTGHDRDYLLLAGLLHDLGKASLSWQQYIRQNAPGVHHAFLGSAVYFYLVSRQSLKDAERRTVMWITRDLAHHHAPLGDIERTPPWIAGWEPAAIYEVNWVDVREFLSQHVPDYAAFLPADPARLDGELRRLSRTWQQWWLNLPPLSTPDEFRLQIQRAYTSRLIQADRFDAANIEEDPGISPQAARQALDKIEVHLSTRDQIGSSVIQAYREEAQDFVLNQLALQGSRMLTILQMPTGSGKTLTAIRHALQVISEGRANRLIYVAPYLSIVDQTASILRDITGLSVMVHHHLSLPDHPSDMREQPEGVLLALESWQSPIVVTTFNQLFRAIFPYTAQQSIRLAALERTVLIIDEPQIIDVTVWNAFLFGLEATCRSMDASALIMSATVPPVTHAQLPEPPAMIVAPPLPPTLIRYVVNVADDPWTVERVVEEGRNAIVEGFPSVVIMVNTVGDVARIYHAWELQYPDCSWTVLTLHGAMHGLHKAYQLRIIREKVNKGEPFCVIATQTLEAGVDISFARMFRARPILPSIVQAAGRLNRHHEKGDPGRITVFDLIRDDGRDSRGMVYRDAIMREETDRVLRPGIQYDEIDMNKWIEDYYQTVFERNHYSAVMDKVRKAANGQWSQLAGLEPFYSVYDREPLFVPVAGDAENPTLWLDDDTRNLLGSFSVTLDTLYERWRDPKTYRSLSFTNRKRFLSLVERFVTSVPYRVGRALSDMDPLVAIQKIADPHNYSVDLGLAGWFLHEAREETVIW

SEQ ID NO: 11860 - protein, 926 aa, Streptococcus salivarius 57.I
MKHINDNFWAKKTEENSRLLWLPLTQHLEDTKNIAGLLWEHWLSEGQKVLIENSINAKANIENQGKRLAQFLGAVHDIGKATPAFQTQKGYANSVDLDIQLLEKLERAGFSGISSLQLASPKKSHHSIAGQYLLSHYGVEEDIATIIGGHHGRPVDDLDGINSQKSYPSNYFQDEKKDSLVYQKWNSTQEAFLNWALTETGFNSVSQLPKIKQPAQVILSGLLIMSDWIASNEHFFPLLSLDETNVKSKSQRIETGFKKWKKSNLWEPETFVDLVTLYQERFGFSPRNFQLILSQTIEKTTNPGIVILEAPMGLGKTEAALAASEQLSSKKGCSGLFFGLPTQATSNGIFKRIEQWTESIKGNNSDNFSIQLVHGKAALNTDFIELPKGNTINMDDSENGSIFVNEWFSGRKTSALDDFVVGTVDQFLMVALKQKHLALRHLGFSKKVIVIDEVHAYDAYMSQYLLEAIRWMGAYGVPVIILSATLPAQQREKLIKSYMAGMGVKWRDIENIDQIKIDAYPLITYNDGPNIHQVKTFEKQEQKNIYIHRLPEEQLFDIVKEALDNGGVVGIIVNTVRKSQELARNFSDIFGDDMVDLLHSNFIATERIRKEKDLLQEIGKKAMRPPKKIIIGTQVIEQSLDIDFDVLISDLAPMDLLIQRIGRLHRHKIKRPQKHEVARFYILGTFEEFDFDEGTRLVYGDYLLARTQYFLPDEIRLPDDISPLVQKVYNSDLTITYPKPELHQKYLDAKMEHDDQIKNKERKAKSYRIANPVLKKSRVRTNSLIGWLKNLHPNDSEEKAYAQVRDIEDTVEVIALKKISDGYGLFIENKDISQNITDPIIAKKVAQNTLRLPMSLSKAYNIDQTINELERYNNSHLSQWRNSSWLKGSLGIIFDKNNEFILNGFKLLYDEKYGVTIERLDKNESV

SEQ ID NO: 11861 - protein, 765 aa, Methanococcus maripaludis X1
MSISFNLFSHPHQTLNDHLTGVKDIALNLHENHNVNKDLTDILEIICMAHDFGKVTSFFQDRLKTGNKSKLTDHGEISACFAYWLLPETWKIPGFLIVKKHHGSMENANDEMPLKIDILKKQANDILENSFDELNLIYAEVLKKNSKDLNEFFEFMDSMNERSLKRQFRKEKSSNKYNIEFFMKIQYIYSILLSSDKSQLILNEAYLPNNRLPSEYVEKYKENLKKEFLGRTGALKNNEVYAIRNNAFNELKDKLETVDLNKNKIFSINMPTGTGKTMLGYYAAFKILERLKNEYNLDSQIIYCLPYMSIIDQNYGELYKLLEYNLNRQPTDEELLKFHSMTEIKYNDYEGYDARFCFENWQSKIVTTTFVQFFNTLFKSGKNSIIHRFHTLSNSVIVLDEVQAVETKYFPIIKEFLTLLAEKYNVRIILMTATMPIILDTYELIPNKEKYFRRLNRIKIVNNTSETIQLGDYKEILFEKIGKNPDKSFLIVMNTVKSAREIYHYLKEKTNRNCIYLSTEIYPKLRLEKISQIKKMNNHGEKPIVVSTQLVEAGVDIDMDIVYRDFSTLDSINQTAGRANRNGFGDKSEVYIYNIIDDKGNPYCGYIYPPHLLDCTKSVLLENEINENELYGINEKYFNEVHNRSFGEIDDKVHNSIKELEFKTFRDSFELIKKEEWKKDIFINADKNSNEILEKLENSKDLSNLEIKNLFRVLNNYRISINTKKYDKIKNNLISMDKFDLEYLNIDNYSLEEGILDNLQNELFF

SEQ ID NO: 11862 - protein, 759 aa, Amycolatopsis mediterranei S699; identical to SEQ ID NO: 11754

SEQ ID NO: 11863 - protein, 768 aa, Thermococcus sp. 4557
MGAREDFRKATGFNPYTFQREAMENLIEGSSLIVRAPTGSGKSEMVLIPFIFQINENLPSQMIYSLPNRTLVESIGERARRYTSYKKLRVAVHHGKRPESSLFEEDVIVATIDQTAGAYLSVPLSMPKRWGNIFLGTAGSAMLVFDEVHTLHPEKGLLTSVAMSIESAKLGIPFVMMSATLPRNFMERVKALAEKKGGKVEIIDVEDEKEIEARARRKVELNTEPLFNETCLTAKEIERQAEDVDNLIVVVNTVGKAQQLYRELKANADRPVILIHSRFLEEDRSQKEAKVREIFGKGSSANEAILISTQVIEVGMDISSAKLLTEVSPIDSLIQRAGRVARWGGKGEIIVYNVEKKAGNPYAPYSRELVESTIDALKGVELLDWQTEIELVERVLSKPFEGYLDPYKFYERLGGLARAVYEGKRSYVEENVREAYSVDVAIYNDVSNLNPDDAWKLKRLRVDFRVLKGKFDQIMEVGGGIYRVEENFIIDEYESRYTFVPVSDKNEIMPFEFYIITGISYSPELGLLFDCEGGIKRFEFEERDNVINVVGEGRMRKESWVEHSRKALDVLRVYMLPRYDYPIRAFAKYFGVSKKELISWVELSVALHDLGKLNIYWQKKAGWRLGEEPIAHGFEKKGKLPPHATVSAKALEKLLFSNIEKKIARALYLSIAHHHSPGAREFSKFKLVDSWTSQILKVIDSIDLDVDITRVQEKSDGGKLPIAYSQIPDIQKKNAQYRFYGLVSKLLRISDWIATGGGEYERILYSKN

SEQ ID NO: 11864 - protein, 541 aa, Pyrolobus fumarii 1A
MRAGVGELLEIYEASPPERGLFIAPTGYGKSSLVASLASRLVPARIPRVIHALPLRAILEQLYSRLVESGAGLTIGYQAMGLGLSGKTPFMAPQLVLTTYDSLLVNLLRGNVAERGLGHYEAPRAHILSSLIVLDEIHLGLSAEGLLDTLYTSLWALRGMRVQLLLETATMPPGMMLEVARFARPDLIVAVLPGDGECLDSLGLRGVTGAKVHVVVDREFYEGVAATSWEYGLLEQSRVADTVATLAESGRRVLVVIDSVAGAVDVYRALAARVGEDKVALIHGRMAPFERERVVKRLDSIRVLVGTSAVEAGIDADFDVLVTSAAKPSSLLQRMGRVARRPGRLERAEAYIIDDGGDARRLLLALQGVHPRLPCPYRGWTGYTRLLAVEEAPKPRFDARRLALAYAVIDPRRLEMLLQGFCDLVRNDPLVPLVPSAYLERILDGEPLGMYAFPANLSTVAKRGGEWLSWCNGRGVRVVSLEARGEGEWSSATSYSLDCSEALGRLLREGTDSCRAILEAMEREGVAALVVEGYEPGVGLV

SEQ ID NO: 11865 - protein, 638 aa, Pyrolobus fumarii 1A
MKIGTGKAPTRLLLDRLARAIDECLENGGLVVGVLPTGYGKTSFVRHKLISRIAREGLRVAHVLPLRAIVSEAAVKAASAAKGLGASDVVGFQAGVLVKGVAKSPYLARDYMIVTVDSFALSFYGIPVYELMRSAWHSDVAYTLARSFNLLILDEYHLMVSGDGEAEDDEIDLLRKQAGVITSIVREYVGSGRCVAVFTATLPPSLLEAVLSNAGVKSNVWLVGYGDRQWKLYQRLLSVLGKIAVRLEEHIGFDRGFEAEHCGCIDTIVKRAEVVDSVVDLGALLDELKGRFESGAKSVFIAFNSWRRAYKTFSEWGSRLERELGCKPVLVTGKMSEEQRHDKLEKVEKLLKDGDRVCLFATQVVEAGVDLDFDILVSEAAPLPALIQRAGRVARHRKPSDINTIIIVYDDAEKLRIVNGIYDTDATRETLNLVVNVLGCRVFDGCRGCLDWRCGGVDGCETVWQLLGDLDSKVYSVKVKAAEPSTELEQLLRRLSTLAEPPRKIVKVLDEKLNGSFVRKSTLIPLLPPSDMVVDGREVSEREVEELLGRLVAVDSRFIRKYGERYLEHQDGSVKAVLVTLDEGRLRLRVRSDVSLYELAERPLYTMWRLAVYTDARLLLGFLLKRDVYDRENGLRVV

SEQ ID NO: 11866 - protein, 593 aa, Pyrolobus fumarii 1A
MAGIVAGLRVSLREYQREAVEWAVNRDGAVVVMPTGAGKTLVAAGWIAARLSRGECRKVLVLEPTRILVAQVRGMLSRVLENVTVREARGPISRAERIGVYRSARVVVATPEAALEDIDVIVREGFDCIVVDECHHTVGRDASVKVLERGGFRKRLGLSAYIPRSRRSIIERLIGEIREWHWSDPRIAPYVPPWIGEVYETPLNEAEQRILYELEKLASRLTGRDRALARLAQRWLVRDGALALVDSLRKPTRMAEILSSIEDLLRDPRVRPAHKLEWLLRVLEDHDNPKTIVFIDRVVVAEYVASRLEAKGFRVVKILGRGRVDVARALEEARRPETRVIVSTSAGEEGVDLPEAEMLVVWSNVASPVRFIQRHGRVRRAVGRQGPPRVVVYLVTPDSPDMDAFVESLEYALEAGVDLPVDPGLLDKLRERTIAAKILAVLTQEPMTSDWIAEVTGLARDRVERELRRLCKRGDVIYVHTGIGRVYAAGPAVHLLGEKLPAYTAGDVEAEATIVYDSISGGEGRRKARSWRDALKRLERLLPIRSLRISIEYPLPTGAYKLVNLNYTCLIDTVEKLEIILRNAFSRATLEAR

SEQ ID NO: 11867 - protein, 876 aa, Haloarcula hispanica ATCC 33960
MTMYSHPPEEGYEGVYLRTHLDDVARRANEIVPAEATTPDDESLQRVVETLAYVHDFGKATTFFQEYLRHNTEPEYKPCRYHAPIGSFAAYYALDAQGFESETCLAGFVAVAKHHGRLPDVTQYIHDRAYNSENSTAGAQTNAEQQQAAIAMQLNNIEEHVPELAADLFVAATDNDGSWDGFRQSYKELLDEIAAAVATESGTTINRESLSDSCYGLVLEIWGSLVLADKTSAASRSENTASESAYEAVQPSLQVLDEYVGDLEASSPADPDGSRTERLNHYRSRARAAVTENAKQFAEDGGGVATLTLPTGMGKTLSGLSAAQTVRDELDGERVVYALPFTSIIDQVVDEVKDIYETDTLGRLLTAHHHLSETKIVDEDDVDADKADKNDDVAGILAESWRAGLTVTTFVQLFESLAGPANKQSMKIPALRDSVVILDEPQSLPLDWWKLVPRLVAILTERYDATVIAMTATQPQLFDEATDRGEEVTELVDEPDVYFEATERVQYELDESTERYIETQEIPKPYADASAELLTAVDAGASTLAVCNTIDSARALFDELIDIQDSLLNVGDIYADELSKVESTADIDPQTLATRITKRSDQSILHLSTRLRPVDRLKLIETAKELTDNGHGLITVSTQLIEAGVDISFDRVYRDLAPIDSIVQAAGRCNRSFEREQGRVIVWWLDVPDEQQKTPAEAVYNRGATLLPVAAETLDTVREADESLSETTVARTAVTEYYKKLHTDKNVGKQEYAEYVDNARGDKLAELSLINQRNAVDIIICRTEAERRQVEQVREAWKRYEFDRVRRLMDGLKEIRVSFPIYHGESDKKEKLGQLNPVHSDTDVLCLDVRKHGLSQYFDQNTGFVIPDSTAERRIL

SEQ ID NO: 11868 - protein, 822 aa, Caldicellulosiruptor lactoaceticus 6A
MEKTSFCFDSKNLSGLFSHPGKDGSIQGAKPLEVHLTNTSILANCFASEKNIALCSTKFLSQIAKITALLHDIGKATSFFQKYLFDKKKTKSRHTRHSLISAICVWGTLNRLIEEKKIQEDKTFEGFTAILAFFATLKHHGDLEATSDMLLLSEDDIELCYEQIENIDKEKFNTLILNISCLCPEIGFLTIDSLREFVDHAKVSIKLFKRAFRKLFDTEMKFFFMLNLLYSILLDADKTEAIFGTLVDIPELNLSYIDVDSFRRRIFKPENFENSIKALRDSAFEEATNCEIDENRRIYTLCLPTGLGKTIISFAFALKLRELAQKRFSSKFRIIYSLPFLSIIEQNYDVISKILSFCGLDITSDILLKHHHLSDIVYKTKDGLQNNQEEIFDTDIAKLLIEGWNSNIIVTTFVQFLESIMTNKNSNMRKFHRIANSIIILDEVQAINSEYWFLCKNLFEKMCSSLNCFIILSTATMPFIVDKKTAVEIVKPEKYFDKLCRTVLHFDNNFSKIGLEEFVAKFEFEKEKTYLFVMNTVSSAKKLYELINQRFPDMQDEITILTTHIIPKERLRRIEQIKNKKYKIVVSTQLVEAGVDVDFDHVVRDIAPLDSIIQAAGRANREGKKGKSKVTVIELVSDRGRLFATEVYDSLLIDATKKILSQFQKVDESKFAELIFEYYKELARRGVIETSSDDKGTSQKFLEAIYRLLYTSSDSETDAIGSFKLIEDEPYKVDVFVEADEEAKIIWQRFEEICEIKDFFERKKKFLEIRKSFYDYIISVPKTTNLPVNFENLIFRIPHSQLSDFYDPITGFKTKGESYLSF

SEQ ID NO: 11869 - protein, 778 aa, Thermoanaerobacter wiegelii Rt8.B1; identical to SEQ ID NO: 11626

SEQ ID NO: 11870 - protein, 725 aa, Rhodothermus marinus SG0.5JP17-172
MLLAKPDVSLLDHLAEVTRLGATLADRLDFSESLRQKVILACALHDIGKATEDFQEYIRGRRRRAFPHALASLPFVLLAEGLLNQQQGTRHALEATAAVLTHHSPLGARLYLGYRGGRVTFHESLKECLTELWDLLAQYEVNGLPNIDDFWESLQGLLQSAPADLLESVLELGADRRSLRGLLRLQQVECFARVKAVLHLADWLASARKPDPGILFLQNGSRAIGQHTRQLEGPLRQFQEQAQHASNEAVLWLRAPTGTGKTEALLLWAGDTERLIYLLPTQATTNAMWRRLRRIYGDEAVALAHGRAAYMLRMELDEDPLDARLFGSVFARPVVVATLDQYLLAHLHGRHWEERRTLARRATVVLDEIHAYEPYTLGLLLEALWRELPARLALASATLPESLLQLFPEGHLVEAEEDLWQRRRHHVQLQQGSLLEEGMQQARDFARQGRRVLVVANTVADAQALYEQLQATGLPCTLLHARFAFRDRQHKEEQVARPQPGSIFIATQVVEVSLDISYDVLLTEVAPIDALVQRMGRVNRRGDNPPAPVLIYMDWSEGARRIYGQDVLERSLEILQTLPVEPTDAELAQATHQLYEYVLNTEAWRQEFQEGCQTLDELQRILGCYTIDLTDEQLRARFTTRRGMISVEVLPQCYVQEALQLKEQGEGWRLPELLVPVPVYWLVKAPDAFEDLADLQVRQTSLPYDAEHGLRLTDDWQTQLEASIL

SEQ ID NO: 11871 - protein, 770 aa, Lactobacillus ruminis ATCC 27782
MEYLAKSSGETIVDHTKELLKRLAILKKLYPNALKNDGWRLLEIACKYHDLGKMNRKFQSKLLEGKSKIEGEIPHALLSISMLPFDELEEEFDDEQIRALTYSIALHHARDFSEITESNYDNEIELVRKEEDKFPFYLLGLKRDSEFEKKAVGRFYERIIVQNEYFDLDARLSSSDPEYDYFVILKGFLNRIDYAASGGYDIESPGRINFADRIKKYHKDKNDDFEWNELQKWTVEHNDDSIVFVAQTGMGKTEAALRWAGNNKTFFVLPLRSAINAIFDRVRTQAFGSKDESNEYLSILYSDMSNKVIDNFREKNNVNITNYKEYVERSRQLSQQLTISTIDQIFSFVYHYQGFEAKVATLSYSKVIVDEIQMYSPNLLAYIIYGLKIIQKYGGKFCIMTATLAPFIVDLMKEKGLKYKLPEKEKPFLDKKLNRRHKVKIFHYELDIDKVMEIYRKFDGNILIVCNTVNKAMQVYDALFEHIGNDVHMIHSRFIARDRKKKEIEIQKFSNDHLKGIWIGTQVIEASLDIDFDVLFTELSELNGLFQRMGRCYRRRNYVGDEYNVYVYDGGEKNPSGIHGGGRTVVHYGMYKLSKNAINNIDGYLSEEEKIDLINNVYTTKKIKESDVANDYIEEVKNTISYLESGADDAIDRRSVMKKFRDIDSIQCMPYSVYESNRMSIKDKISFLNDYYKGKNKSKDYLDKKIEYSNYLDQLTVAVPTYIVYEVENIYKVIEVGKRNIIILSKGFNYSFDKGLSLSKNIDDEDSNVW

SEQ ID NO: 11872 - protein, 741 aa, Roseburia hominis A2-183
MVEDKVTGKRMIAHINASGKIQTVKSHSEGTACLTQQFAEEFGCGKQGYFCGLLHDIGKYSEAFQRRIADPEHTAKVDHSTAGAVEAMKIAKENIPLAMTIAEHHSGLLNGGVYRISNKGDGTFFGRIKGAESLPDYAAWKRDIVPEDVNIPAFCRDGSNPCFTMSFFIRMMYSCLVDADYLDTEAFMKENQAVRGEYDSLKVLAERFDNHIKQWLEKTDFKSDKQKILCSIRNQVLQDCMSKGSELPPGIYTLTVPTGGGKTTASLGFALRHAIQSKMKRIIYVIPYTSIIDQNAEVFRSILGEKNVLEHHSGILYDLTEDKAENEAAYRKALATENWDMPVIVTTAVQFFESLYANRSSKCRKLHNMANSVIIFDEAQTMPIPYLEPCVAAIAELAAHYHSTIVLCTATQPVLDEMIQKYIPQTQVREICEHTDILFQKLRRTSIVAAGNMEREKLIDCLTAQEQVLCIVNSRNLAQELFEEIPREGAFCLTTLLYPEHRKEKLREIKERLEHHVPCRVIATSLVEAGVDLDFPCVYRQENGLDALIQAAGRCNREGTHSPEESKVYLFGLKGDASVYFAQNISALRQTLRCYEDPAAPEAIAFYFKQYREILGRENLDQKKIMDAFTAGKGINGDCFPFATVAREFHLIESETQTIYIPVGEAELWIEEMEKGKVSRELMRKLGQYAVNVYPNHLKALYDAGCVEGIGEGMYVLRDMNQYHEDTGLQMDVSTGYGLFG

SEQ ID NO: 11873 - protein, 727 aa, Listeria monocytogenes J0161
MHKYLAKSNPEETIQEHTDNLLKNYQRLKKLYPAVEIDWYLLELVCLLHDLGKMNLLFQTKLGNASGKGKEIPHGYLSVAFVPDSKLEEMGYSEDEIKVVYQAIARHHERKYDFSDSEWKKEIIKLEEQWAGFIYSQLGGNAEYSSEVEMLYFYPGSRIFEGNSAADAETFKKYVLLKGLLNRIDFAASGGIDVELENDFLMDSMEVQLAHFKAENPEADWNALQKYMMQHQNENIVVIAETGMGKTEAGLLWLGNNKGFFTLPLRAAINAIYERITKNIVTTNQAERVGLLHSETYSQYLLHEGNAEMDIDEYYTRTRQMSLPITICTLDQLFDFVFRYAGFEHKLATLSYSKVIIDEIQMYSPDLLAYLILGLSYIDKFGGKFCIMTATLPGIVTDLLLENGVDFVQPEEKFVSSRIRHSMEMVHTEIESEFIKPFFNNNRILVICNTISKAKKIYSELKEHFQGEEIHLIHSQFIKRDRSAKEKAIFKDGQKDSTKKCIWVATQVVEASLDIDFDLLFTELSDVNGLFQRMGRCYRNRALDVDTNVYVFDGGAKVCSGIGTFIDKLIFVNSKTILNEHAGVLTEEKKMELVERVYSTEALRGSEFYNDLRKTINYVKAFDSYELDKADVRRRFRNINSVSVIPEEVWQDNAEEINSYFVTLRKTSKEISTKEKIIARTNLAEFMVSIPDYLYKKGESVVREINRYESVIEFKCGYSSDVGVFMR

SEQ ID NO: 11874 - protein, 885 aa, Rhodospirillum rubrum F11; identical to SEQ ID NO: 11564

SEQ ID NO: 11875 - protein, 752 aa, Rhodospirillum rubrum F11; identical to SEQ ID NO: 11565

SEQ ID NO: 11876 - protein, 787 aa, Bacillus coagulans 36D1
MPVLVPFDKCIARPDEEGKKHLLKNHLLRVKEFAENWISDTGEPVKELIGLAAICHDIAKSHADWQRYILDPEIKKGPTHAPQGAFLFSFLGYHWLEITRQWEAYRVVWLWLVRDIADHHGKLKKLQDDNWLQRYDWEKMDFEGISSFLKDHYPEFSGLELTIDSMDDWLDVADEQIEEAMDDLDTGFGQKKDFDLMVHLQAWRALTTALIAGDRFDVKDTGTSWFDEKTIEKCEAALGRYCTAKAGSPLAQARSQAQKNIIKQMAEQPASWFYTLELPTGYGKTITALKLSLWLGKQRHYRKIVYVAPYLSILEQTSRVIGEAMDIGALEHHSLAILDQSNKSGTQGEQRAPNDELAMESWAHSVICTSFQQWSKAIFPGRAQDVLRRSFLKDSIIIIDEPQIFNPDGWNLFLTGLEAIAKQQHLCVLFLSATMPPFEYGLSRKPIRLAASGSQVERYQVRLEEKMDEEKMAAFLNDREDIKQAAILNTIEDAYRVYKQINGEEDVRLLHGLMVPVHKKLEIAKIQDHLEKEKEKRLIVIATQIIEAGVDVSFHHVIRALPILPSIVQAAGRVNRHFETDNGILTIAPFFRNGEKNTRNSIYARPLQRITDRLLFEKDIWLESEMEPLVRRYYEEMFRENTYETAKQAIREAYEGDWPQLSKYEPFGQDYLKLPLFVPWEVPEEDEKWLPEQFLWLRKKFGVTDAASIYERYSNVNFMNGLSFEERKQFMILFHHFVLNVPVKTALRFVSQEEYLQSNRVPLLYSEGAYDQNLGLVGHFDELDNFI

SEQ ID NO: 11877 - protein, 827 aa, Chloracidobacterium thermophilum B
MSTALPKYLLAKSYPQTKFPQQPPDYALLLQHNRDVAQACTALVEVIGRLVLERAGLTETDIEAFKKAMAAVGWFEDLGKANSHFQAMVTKAPQLIQLLRHETLSGLLLWQNKALRECLEPALGEWFIPALWAAMGHHRKFDCDTQASEAPALTVWLNHPDFRQMLVELGERLELKTAPPAFSEPLIVAPDNRNRDNRNPNAVSARRALQDLKEDFDDLREQLAPEWSKRLAVMKALGIAADVAASAIAARGQSAASYSLDTFVRETLGHVGLDAADFDRLIGEWAWKATGQPRPSDAPQLPPGFAFRPFQCEVAASERFVTLACAGCGSGKSLAAYLWAQAWQRRTGQTNFRLFFCLPTTGTTTEHFKDYALEAGLSAALTHSRSTVDLKALAETADQESDVDASNAERAAQRALDDLRDKIEALSLWDTPLVVTTADTVLGLMANARRPLYAFPAIALSAIVFDEIHAFDDRLFGHLLAFLQFFPKQPVLLMTASLPQHRLAALQKVRPDLRVIAGPPAYEQLPRYKLRYPSSPEEVWQAVADCIAQGGKVLWVRNRVEWANETYAACRERFPKVEVNVYHSRFRYRDRSKLHHYVIGKFKGRDAQILVTTQVAEMSLDLSADLLITDIASVPALIQRMGRANRRSTPECPQPPKPVLVCPLPPKADERDNPALPYDAEDITAAELWIERLLSLEKPLSQRDLADAFGSLSPGKDFDVEQAWKAACFVSGGWETRPGMTRGEGYTVNVILEADWKAYGQSEPGRDWLIEHEVAIPFRPEVLRWGTVGSRRLAPAERVAYDFNPETKKGTGARWVSAQPATNCQIL

SEQ ID NO: 11878 - protein, 752 aa, Leptospira interrogans serovar Lai str. IPAV; identical to SEQ ID NO: 11545

SEQ ID NO: 11879 - protein, 744 aa, Pseudoxanthomonas spadix BD-a59
MEFYAHSTDRKDCSDWQGLRAHLLGVAERASTNAAPFGGQELGWIAGALHDLGKYTRRFQDRLRGEVPRVDHATWGARIAQQRYKGLGTLMAYAIAGHHAGLANGTLGEARSCLRERLSEDYLLRELPPLLPEWEHELELPQRLALPTRFSSVSTRPAFQFSLLARMVFSCLVDADFVDTDNFYRRIEGRDPRPERTGPSLDVLRAKLDAHLVSLPRQGGINPLRADILKHVRAQATHKPGLFSLTVPTGGGKTLASLAFALDHAIAHGLRRVIYVVPFTSIIEQTAAVFRSVFGELGEDAVLEHHSAFFDDPKSELQSKEKRHLAMENWDAPIIVTTAVQFFESLFADRPARCRKLHNIAASVVILDEAQTLPLHLLRPCMQALDELALNYRVSMMLCTATQPALGKADGFKDGLEGVRELAPDPPGLYRQLKRVSVQHAGPLDDAALAGHLRSREQILCIVNNRRHARALFDAIADLPGACHLTTLMYARHRSQVLQDLRTRLKAGQPCRLVSTSLIEAGVDVSFPAVLRAEAGLDSIAQAAGRCNRNMEWAVEDSQVLVFESPDWAPPKELKLFAEAFRMIERRHRADLLSLEAVTDYFRELYWRRDGQLGEMLLQLFDGAIVDDLPLETLAARFRMIEANMRPVIVPYDPQTGAEDPFVASVLRDLEYAPGAARKLQPFLVQVPRQGYDALWNAGAIQPVAPERYGEQFVRLVNPRLYHPKFGLHWDDNPQFLAAEGLVG

SEQ ID NO: 11880 - protein, 3070 aa, Keunjorong mosaic virus
MASAQIQFGTIDFSRERMERAWSVAPAAIEKKLYVPPSARLNQIVARAMISKETRNTEDIFQLFFNKPEIKAELGRKRFGKIVKKASSWCIKPANDKVVEARISEMREASAFEEAFFKGELEDKATIGHVKIRTLVARGEHIGFRTTHYKRSIKTPLKRGEAKRHRKLHNPVEGSPRAILLSLVKIAKKNRTTFEIVKKKKVLRAHFKRVEGQSIACVQLPHEVGVKKRREVDPRLFNDEIDILGKLNRHLRFRNDQIKQGFSGAIFPRTVIREVCRDYNSIVVRGRFEGKLIDARCKVSDFTMHKMVHYSSFEHEFWRGWKRTFDGLASSSQHECTTDLNNEACGEIVAAIFQSVHPCTKVSCPHCRTILEKMGTEEYYERLSELFRERENKLQPLLEKWKTVGTVLNHIKRTSVHNGNLTALNEITRIAQSSKATQMQHILEIQKALLKGAIATPEELAGAADKLLELTRWFKNHLSQISKGDVAVFRNKASSKTSINFSLLCDNQCDKNGNFIWGERGYHSKRLFSNFFEIVEPGNGYQKYIERKNPNGMRLLAIGHLIVPLSLTRARKALEGISVKRLPISESCISRDPSFVHTCCCVTDDVGNPVFSTLKSPTKSHLVIGNTGDPKYVDLPAFDELKMYIAKEGYCYLNIFLAMLVNVHEESAKDFTKIVRDTIIPMLGTWPTMHDLATACYILTVFHPETRNAELPRILVDHEAQIMHVIDSYGSLSTGYHVLKAGTVQQLLPFANESLEGEMKFYRVGGTKDESKRISLEVALIKSVYRPKELIALIENDPYVLFLCLVSPKLINALYNVGGLDIALSHWITRDTDLCAALTMLSFLAQKISRASVVFEQIHCINQSAQQILMLMENLNDATATSVVVKQFLECIADRVVVDSQLQANGFITINEKLYDTWEKIYADRLHKEWQGLSWLEKFSLIKHCYRRKKYSSDVLPEGSGSEVEAKYVVSYNWLCGKIAAARIGARKFVGRQVERSTEVIKRAVVNRTVGVLQYCLADIVYLVNVLLVVNLLVQVIDFVKKHVRENRELKRRERIDDFRMKANEISEIHSVYTQTQGLPTEEEFLGHLENTDTELHSFYMSKIYNKVRLQSKTYLEKNFEKIIAFMALITMMFDDKKSDAVFKCLGKIKTVFGTMEDVVRLQSLDEVLSIEDEKRETVDFTLNTDVIAANEINDKRFETWWQLQLEQNRIVPHYRSTGTFLEFTRATVVQVCNAIQTATEQEFLIRGAVGSGKSTGLPHQLSKKGAVLIIEPTRPLAENVTKQLHKEPFYNNATLRMRGMSTFGSSNITVMTSGFALHYYAHNQEQLAKYDFVIIDECHVIDAAGMAFYCLLKEYSFVGKILKVSATPPGRECEFTTQYPVKLRIEERASLQNFAQAQETGSNLDVTKDGDNILVYVASYNEVDTLSKLLLEKGFLVTKVDGRTMKLGNVEIATRGTAAKKHFIVATNIIENGVTLDIDVVVDFGVKVQAELDSDLRSMSYKKIPISYGERIQRLGRVGRVKPGVGLRIGETFKGISEIPVSIATEAAFLCFAYGLPVMTHNVTTSLLSKCTVNQARCMMHFELPCFFMVDLVLYNGTMHPMIHETLKNFKLRDSEILLSTLAIPNACTSKWISSGEYKKYGVRMNVEETTKIPFFSNNIPETLYERVWQIVLENRSDAGFGRLTLANACKVAYTLTTEPTALSKTIGIIDQLIIEEQRKKAHFETSISSLSTHSFSLQGLVTRVKNRYLQDHTSHNIAALQTARSQILEFSTATHDLSKPDSLMPYGVLDVVRLQHKEDVVEKLGLKGKWNKSLATNDLLIAGMTAIGGLWMLWDYFKNETSDIVVHQGKRKTQKLKFRDARDKKVGQMTFYDDGTAEHTFGEAYNKRGRVKGNNNKNKGNGFKTRNFVHLYGFDPSEYTFVRFLDPVTGVTIDESPLPNIPLVQEEITEARNKAIEENEDVIDYVRQGPGVKAFFVNQKTKKALQVDMRPHNPMQICRNGTVAGFAERQFELRQTGPAIEIPYEEVPKPADVVQLEGKSLMRGPRDYNPIARSICKITNISDGFSTSMFAIGYGSILIAPGHLFSRNNGALEVNTSLGQFTISNTTQLKVHHLKGRDMILVQLPKDFPPFPRKLRFRHPLENEKCCLVESLFQQKSLSSCVSETTAVMPTEGCFYWKHWVSTRDGNCGSPLVSTKDGFIVGIHGLEGKMSEKNYFVTFPDDFEEKILASMDTVEWTKHWKFNVDKILWGKLSYACDETDAAFKMAKIARDLSFDQEDIVREQAVQDKWVYRDLGENLRAVGEAESQLVTKHVVKGKCGYFQSYLNENPEAREYFTPFLSHYGPSKLNKEAFKKDFFKYKSNIAVGTVDTVRFELALHEVILLLMELDFGECLFVTDPDEILNSLNMKASVGALYKGKKKEYFESMTELEKEKLIRLSCERLFDGNMGVWNGSLKAELRPIEKLKENKTRTFTAAPIDTLLGAKVCVDDFNNRFYELNLRGPWTVGMTKFYGGWNKLLQSLPVGWVYCHADGSRFDSSLTPYLINAIIHIRQFFMEDWWIGHHMLENLYTEVVYTPILTPDGTVVKKFKGNNSGQPSTVVDNTLMVILAVYYSVGRCLNNYDEFDDIFKFFANGDDLIIAVRPDFEHVLDGMKESFQELGLSYDFSQRSFDKADLEFMSHRGLERDGMYIPKLDIERIVSILEWDRSTEISHRAEAICAAMIEAWGYDELLQQIRSFYYWLVTKPEMQNANKNGSFPYIAETALRKLYTDQDAAESALEEYYIALSDDRDIGEEDVVTLQSGEEKDAGADAKKNDKNKEVIPNAGPSAISVKDKDVDAGSKGQMVPRLSKMGRNMKMPKVKSGIVLNLEHLVSYKPEQEDLSNARATHGQFENWINVTRQELEISEEQMKVVLNGFMVWCIENGTSPNINGVWTMMEGEEQVEFPLKPFVENAKPTLRQIMRHFSDAAEAYIEFRNSEKPYIPRFAQVRNLRDVSLARYAFDFYEMNSRTPNRAREAHLQMKAAALVNTNTRLFGLDGNVSTIEENTERHVATDVNANMHTLLGVRQM

SEQ ID NO: 11881 - protein, 739 aa, Thermovirga lienii DSM 17291
MWSPGSLPGDLESHPGRPLKDHLMGTWKLAECLSERNRVPIDMEKLKWVCWTHDLGKAHCSFQKYLQGKGTKVRHAEPSAWFTLAVTNDLVCSEGVRRHHSSICNYDESKSYWACDDFKAENVNVSLKEILPSWPFMLSEHKLQELAFELLLGEKNRLEDWLRFRTIYSLFITSDRMDAMRIQKVEKSVIPQWKAKTFSVDTPMAGWRSEVRRLCVEAADNVSLPGIYSLSLPTGSGKTLIGLEMAHNWAKKMKFSNIIYALPFISIVEQNAQVASEVFGEDNVQEDHSLAYISDTETENTTPEKRMQSFFRYWDSPVVVTTLVQLWTAIFGSSANESMNFHRLSNSVVIMDEPQAIRPQLWKGFGKVLSFLSKKLNITFLLMTATKPHIVEGKELAPAGVVAKRPYKTRQECRFLDGVHDIDSLPDLLEENISRLRESSGLVVLNTKRSALKAYDMLKGILGQNDPDPILFLSGWMTPKHRKEVLGKLIGLEKEGVKRYLVSTQVVETGVDLDFQWVFRDLGPLDSIIQVAGRCNRHFSMGEPGEVVIAELMDPEKGKSFSRYVYDDVLLLASREILGKRPLFDEQDTVEMVDEYFSRILDGLKPEHIWEDIERGSWDTLPKLIEKRTKGVSLYVELDENLRNLLDELSNMTRGFENLDKARNIARKLQMYKIEVPAKSIEKWEQKLGSNFIIDGAHPVLCKLPGRDEWFLSKEGIGTVYSMETGFIPPDGDSGDEFL

SEQ ID NO: 11882 - protein, 490 aa, Pyrobaculum ferrireducens
MRAAVARALELARGGTDRFVLELPTGYGKTSTGPLLFRAFREAGLCWKAIHVFPLRAVLHKTLKEYVTKYSDISFTYQDGDVTLTEQGYVKSADFSIGDYILTTVDSFIHNLFKAPVSELHRIAGRSRAIHYHVPFANIYPSCVFFDEAHISALEESGKASAALEAAVSVLAEAHVPVVVMSATMGAWKKKLFRGFKFVQLGSRDREDSDTIYVHDAEFERCVSKIRYTVRKINLENVAEIAKRKVKEGKRVLIVYNNLGEAANLAKKLGGVLIHSRLTRTDRQKAENELAKADIVVGTSAIEAGVDVSFDVLISSADAPESVIQRVGRVCRKVDCNECQGEIYIFGEQADMFLPIKQWRLPYMEGSYISLLRSEINRDAGIAWLLGELSKFIYIPPDVLKKVFIKAGMSYVRSALVEACADESCKPESAFPVSLDKANELPIDKIYINGTFEKPPKEYNISWLVSAVEKYGDFPKLVLKCYVEGLGPFC

SEQ ID NO: 11883 - protein, 475 aa, Vibrio phage SIO-2
MLNTLKDHNRVSLPPRILRNGGLYWASDKMKARLTVKVRSKNNKGQEDLPLYLPHGQYDDQGRELIAVPRNCCPVPQGDRDQRSKGTKKLYLSSVKPLDDNQDFFIKEGCRLIAKGLSFIAKAPTGFGKTVVTMPLIAKAQTTTLIVVHKEDIEDQWRDSLKRFLKLRDSDIGLIKGDKCNYQGKKVVIAYVQSICKKDRYPKEVYRYFGLIVFDEVHKLGAEEFSQAAWRFSAYQVLGLSATPYRKDGRDVLLNAHIGDLLIDIKDIQLVPQIITAHTRYQIPMVPWWNKETQRQEMVLMPHGAGKISGLIKHMRQDPARNAIICQFVKKCFDHGRYTIIFSESKEHLKILEDLLVTYGIARTEIGYYVGGMSKKQRDETKKKKVCLATYAMTESATDNPIWSVGVMATPRADVNQIIGRVLRRHPSKCCALKREEGKKIPIVLDLIDDNSKVLLGYFSSRKKYYDSIKAPIIA

SEQ ID NO: 11884 - protein, 869 aa, Burkholderia sp. YI23
MQEKEGKQHVAWGKRSREGDENAPFHPLCDHMLDVAACFVALTAKGGRIREAMHATAKRVLDDRDIARLAVFVFLHDFGKANSGFQAKRWRTGAPRGWPLHAGHGVEARLALELNENLLAGLPLDEMSAWGGAAFDLLLASLGHHGRPVREPVGIDPHLWQPVFAADGREVYNPAATLRQIGDRLRRDLPRAFEPGGEWLPDLPSFVHLFAGLVQLADWLGSSKQFFPYSEPGVERTFDEALRYATEAVGRVGLDVTHLRAAMRNARITFESAFSVSSPRPMQAALGDADLGPLLILESETGSGKTEAALWRFAKLFEAGKVDSLYFALPTRVAAVQVYKRVRDFVKCLWPSDAPVVVRALPGYESADDSDKIALPHYEVQWSDNPDDIVASKRWAAESPKRFLAATIAVGTIDQALLAGLSVRHAHLRHAALSRSLLVVDEVHASDTYMSELLEHLLKAHLATGGHALLLSATLGSRQRVRFQSVTNPPCIEEACAVPYPALTDGARISKLGRSGAKKHVHWQTCRAIDDFTHVARIAVDAARQGARVLIVRNTVPSAIATQEAIESMVDDRAWLFDVNGVATLHHSRFSVQDRPRLDAEVEARIGKKRDGMKPCIVVGTQTLEQSLDLDADLLITDICPMDVLLQRIGRLHRHDRPDAERPEGFRQARVWVLIPESGSFDAYLQRPRHGLGRLRNGGGVYPDLRMIEATRRLIEARGEREIPDDNRELVERATHPDCLDAVAAEFGPAWQALSQQLDGGKSAERVVARLHALDYDASFEALAFPGNDERVATRLGAKDRLIRFDPPVRGPFGIDVREIAMRHHMLPDDLDPDAAPSDIAPCDDGFEFSLGGAHFTYDRFGVRKRRLA

SEQ ID NO: 11885 - protein, 745 aa, Thermus sp. CCB_US3_UF1
MLLARTSPDEPLLEHLLGVGALAEGYLAPLGLGEEGRLAGLCHDLGKATPYFQEMLAGQRAKGDPLTWHALLGALYAAWTARQRGMGEKSLLLFLAVLEHHGSLKTPWERIPLGPRQASEKAWKILPKQIRALQESPLFPALVADLGLPPPEAFLGEGAWEEAERLAREADALLDREGRDLGLHYRLALLYSALLDADRRLAGQAPPKGEGIPIPPEAAEAHLARKSRPTPLSPQREALFRGVGEVLEGPLERVFPARLTLTAPTGAGKTLAALRFALALRERVHRERGFRPKVVYALPYIAIADQVEEEARGVLQAAGLKPEEHLLVHHHLALAREEEGSVEEALLLQETWDAEVVVTTFHQLFPTLVGPGSALRPLHALAKGAILILDEVQTLPAELWPFLGELLRQLPGQMTVISMTATQPGLVKGQEVAPHLPSYPRRVRLAWHGARTLEELGQALLQEGPKSRLVVVNTVREAISLYRFLREEGLPHLYLLTSHIIPKHRKARLGEIRAKLQEGQPLTLVATQVVEAGVDLDFQEGYRAFAPMESILQVAGRVNRSALGEGRLWVLDLEGDGGRRVYGTILLDRSRRVLGPRLAEGLWDLEAYALLPQYYRLVEEGISQAKGQDLLAKLARLDYSQLRFTLIEEAPSIPIFIEWDQEATRLLGELEGALTLKDPGERRKRLRPLLARIQGYTVSPLLQRALKNLPPPLLGREEWRHVPREAVADFYDEEMGFLWEMEQFL

SEQ ID NO: 11886 - protein, 730 aa, Hungateiclostridium clariflavum DSM 19732
MNKYLAKSDPEETIQQHTDKLLKNLELIKSIYPDLDINWQLLRVASLYHDLGKMNLKFQSKINGGKKYSDEVAHNLLSLAFLDKNELKKQFSEQEIKILAHAIAYHHERGDYEASNYNEEVEALKAEAEKFVYDKVKITTIKKISPKYFSNDRIYENSGCFFDYVKIKGLLNRLDYAASADIDVEIKNDFMCEKLENLKYNWNELQRYMIENREKNVVVVAQTGMGKTEAGLLWIGNNKGFFTLPLKTAINNIYKRFTEKIVGIENKELIGLLHSDTYSKYIENATDDEDIDEYFTKTKQLSLPITVCTLDQLFDFVFKYKGFEIKLATLSYSKIVIDEVQMYSPDLLAYLIIGLSYISKIGGKFAILTATLPGIVTDLLKEQLRNTGVSFEQPKPFINDQFIRHSIKIIDESINSSNIIEKYDGNNKILVICNTVKTAQKIYDELKNDEEFSQKCKNINLFHSRFIKKDRKEKEDEIVRFGKADCNESGIWITTQVVEASLDIDFDILFTELSDINGLFQRMGRCYRNRVWDKEGYNCYVFIGGNKKCSGVGEFIDEKIFEFSKEELKNIDGIMTETEKQKMIEKVYNTDKLKDTDYYNKVLKNIEYVQSFNGYEKNKEEVKKMFRNICNITILPSCVYDANKTEIDNLVSKIQNESDKKERRKLIDDLNGFTLDVNYYEVEKEPYSVLRISKHMEIPIYENFEYDNCLGLRRKSKNQSDDFKVNSSIL

SEQ ID NO: 11887 - protein, 923 aa, Niastella koreensis GR20-10
MLKSFEDILTNMPDIASILNGHDRYWAHIHPSKKEELLAEHTVLVNSYAEKLVEAHHLDAVIDSLITEHVADWEDAAQCAVIIKQCFVGAIVFHDFGKINENFQLLRMQNYNGFTENKNILLKPSYGHSKLGAFLYSCYCIDSIFKQSISANSKKLLAAHCLLLSYSINQHHSPALFSVTENNSYLSGFKGIYESLRYYIQQYNWSLNDKSVIIVLDKMEDVWLRDIKERRAYKPFPFYTLIKLNFSLLTAADYLATHHYTTSSENGNEGETFDFGVFDKRERVEQIAAHLRLFKHNQAAFGKANSYCFEHPNIRSKDNLNKLREEMAVEVIQTIKENAGKRLFYLEAPTGSGKTNLSAIIATELLLTNPELNKIFYVFPFTTLITQTFGSLKESIGLKDNEIAELHSKAGLASKTDIKEEEDKDGLYADSKRDYIDHLFALYPVTLLSHVKFFDILKTNSKEANYLLHRIANSVVIIDELQSYNPNIWDKMLFFISEYAKHFNIRFVLMSATLPKISGLKIGTNNVPDFVDLLPNARKYITNPNFSQRVTFNFELFNLGKIEISRLADFVLEKSVAYATKHNNVKTIVEFIYKKSAANFFQHIQHTDTFQQIFLLSGTVLESRRKEIINYIKRSNSEENILLITTQVVEAGVDIDMDLGFKNVSLIDSDEQLAGRVNRNASKAACEVYLFKMDDAHILYGKDYRYKKTREEISSEIYQAILTGKDFSQLYEKVIGFIDESNKPLFKDSIMGYTDGLFHFDYPEVDRGFRIIEQESACVFVPLDLHLSIDGAKQSERDAIFSQSELDLLSQFDIYPNLENQISGLAIWSLYERLIERRIKHKKQAGSFDIQQKIDFKRLQSIMSKFTFSLMQFAKDYKELQLFGEEKYGYLYLHGWNEKRIEGKPYSYENGLNNEVFMTSNFI

SEQ ID NO: 11888 - protein, 788 aa, Sulfobacillus acidophilus DSM 10332; identical to SEQ ID NO: 11859

SEQ ID NO: 11889 - protein, 694 aa, Tannerella forsythia 92A2
MNEKWQNACRKDHEAFLEWQKRHKGTFRDYSKQDIDKAGKNIRLAGVRHEWQSLLLNVNKKMPIVLQAAIAAHHGKLGFNFEQRWIKEGMGDFWKAFQKESNSKSETLDLMQLANVQYEFSGIRGLLQLADHRASAKEDNDFVPDHTTFNYQFPFPSKRGVQELVEKHWKEELLLVRAPTGAGKTDASLLWASLQITNKRADRLIIAMPTRFTSNALSISVAENLSDTGLYHSSAWFNRFQNKIEKGEVTRQKAERIHEFARLLETPVTVCTIDHLLMALTLTREEHHLITFNMAHSCLVIDEADFYDEFTQANILVLLKILKAWNVPVLLMSASLPEAVLIEYKSIGYSVSEIMEDDSDNARPRFIIKDIRKYEEPDDISDLLILMAEKRNGVIYANTVDKAISYYKWYQEYNNNVIEKIEICLYHSRFTEPDKERKEKEIIDMLGRKAWEKNKAHGIAIMTQIGEMSINISADMMISDICPIDRLTQRAGRMCRFDKSKIGKLYVVVPQKDDCLYPAPYGSFDLHAKSWSSCVSLSKTIQLLEKKSYCAGELVDLLNAVYEQRINYSPKSIENANNLKSYFMMNWLINPQQKSAEDDDSVNFWRSRDIMPQDTVFVQKPDSRFFSNYLEFQNWKIYNSVELPIYIINNAKKQHKIDDINIKVKDEETSIFVIREGFYNYETGATFVEDGVFL

SEQ ID NO: 11890 - protein, 876 aa, Corynebacterium diphtheriae 241
MNPHEELWAKQKGLAKPYPLLAHLLDSAAVAGALWDHWLRQDLRQMFIEELGSNAREIIQFVVGSHDIGKATPLFQYQKAQKGEVWDSIRYAIDRTGRYQKPLPSSYLVKKTSGGPNRHEQWSSFASKNEYLKPSAAAKENWIGLAIGGHHGRFEPVGYGRHQRKAAEDLAKSGWSAAQQDLLRALEKASGITRASLPSELSPELTLVLSGLTILADRISSTESFVITGARMIDDGTLHLATPIDWLKTRKLDSEKHVAKTVGIYHGWNNHESAIHSILKGYDPRPLQTIALQNQVGLLNLMAPTGNGKTEAAILRHSLKENDRLIFLLPTQATSNAIMRRVQGIYSDTPNAAALAHSLASVEDFYQTPLSVFDDHYDPSKEQFESSMSGGLYPSSFVCSGAARLLAPICIGTVDQALATALPGKWIHLRILALANAHIVIDEVHTLDHYQTALLENILPILAKLKTKITFLTATMPSWQRTKLLTAYGGEDLQIPPTVFPAAETVLPGQFNRTLIDSDSTTIDFTMEETSYDHLVESHVKWHQTTRLNAPHARIGLICNTVKRAQEIAAALEKTNDRIVLLHSRMTTEHRRRSAELLESLLGPNGNRKTITVVGTQAIEASLDIDLDILRTELCPAPSLVQRAGRVWRRNDPYRSSRITADHKPISVVFIAEAKDWQVLPYLRAETSRTQRWLEKHNQMFLPQMAQEFIDAATVDLDTATSEMDLDALALMGIHLMKADGAKARIQDVLNSDSKVSDFALLTSKNEIDEAQTRLIEEGTHLRIILGDENESIPGGWKHGLSSLLKLKASDRESLRTALLASIPLLVSEKQKQLLYQHNLVPLSSSKTVLAGFYFLPKAQNFYSKNLGFIWPEEKD

SEQ ID NO: 11891 - protein, 876 aa, Corynebacterium diphtheriae HC01; identical to SEQ ID NO: 11890

SEQ ID NO: 11892 - protein, 783 aa, Marinitoga piezophila KA3
MKSVKSNENLILAKSDGTTLLEHIEDNIVILNNLKRMLPLLPKITKLDNFWDILFSTIFFHDFGKIHKEFQKYIKGEKNLWTKQRHEIYSIPFIDKLNLDERYIKLIKKVILSHHKSFYELKYNYLKSKEDLEYEYELNWKNKTKFHPQDYEGNLKYNFDKKVIDFYIKKFDELAKKYHISVQLKNEKIKINNIRNPIEEFAYNLEKYNKEEYLQHLLLWGSLKICDHLGSAKIIEIYMFEEKHFVFLDEMKRKIEFYDHQKKCFSIKGSCLLIAPTGSGKTESAIGWVKTQLENKQGRVFYVLPYTASINAMHKRLIKNMDRSASKISNIIGILHGNISHYISIYFEEGITKNENSIRNKKIKKIIKQYKNLLSPLIVCTPFQLLKYFYGVKGFEKGFVFFSGAKLIFDEIHAYDIVTFAQIVVMLEVLKKDFLCDVMIMTATIPTFMQNILAERLNIDNIITADKKFVEKLKRHKIKIVDKNIFDFIDSNFRKIINNHNKIILVCNTVEQSQKVYMKVRDMNICSDNEIVLIHGRFNQHDRNDKEKAIYNQKTKILIGTQTIEVSLDIDYDVMITEPAPIDALLQRFGRVNRNSKKKPAPVYICRKGGEYDHYIYPINKIEKTLEVLNDVDILCEKNIGNLIDEVYPNWNDFEKKEFEDTVSLFRNSLKSLQPFSDTKETEEFYYSKFTNIKVLPACYYSKYINLMELYNFIEAEKLLVNINRNFFYKYIKEGKIEKRELVLSEDEKILKKHSFYIIKCKYNSEVGLINEYEEIKHDINFI

SEQ ID NO: 11893 - protein, 803 aa, Clostridium sp. BNL1100
MFIAHIREDGTEQSVREHLENVSLLCAKACKKISLENTGRLIGLLHDMGKETIEFKNYIKYSFLHPEDKSMKGKIDHATAGAKFIYKTYYCSKDPYEKLTAQIICLVICSHHGGLIDCIDLELRDKFTSRINRDDLQINYDEAINNFFEDCREMNEIQRLLMEAVQEIKDILTRIRLVYDKKPFGKFSMGLIVKLLFSCLIDADRYDTYSFMVSKDITDNENDIFKNCLWTGLSEHLNKKLEGLPKLSHIDLLRNEISQSCKSFAKNKTGIYKLLVPTGGGKTLSSLRYALEHARKFKKDRIVYIIPFTTIIDQNSKEIKDFLDREDIILEHHSNLIIDNENEDYKLLTERWDSPIILSTMVQFLNTLFNGGTQSVRRLHNLVNSIIIFDEIQAIPIKCISMFNYAINFLSKICNTTVILCTATQPMLSMTDRPLFIEENTDIISNVGEKFRDFKRTKVIPKIKSGGYSIQDLKDFSSGLMEQVNSTLIILNTKKAAKELFKGINEENSKLSKDKRALVFHLSTNMCPAHRIESLDKIRKVLGKKKVICVSTQLIEAGVNISFECVVRSLAGLDSIAQAAGRCNRHAESSCGNVYVINMDAGSENVSRLLEIKTGRDKTLRFFEEFKQNPEAFDSDLLSPKAIDKYFEYYFNELKLQMNYTLPKPYADKTMFDLLSENKQAVQDYIDRNQVKPDLMLYNSFKTAGDYFKVIDQNTVGVIVPYGKGEELITNINGKCNIKDLKKYLKEAQQYSVNLYDQEYRNLNDLGAFIQLNNGGVITLRKEFYDEQVGITDENQQMEFLNY

SEQ ID NO: 11894 - protein, 967 aa, Streptomyces hygroscopicus subsp. jinggangensis 5008
MGEYGESGLSCRLSAAAQRVWAKYDRDGDGWLPLWRHMEDSAAVARLLWDEWLPRSVRQLISEGLPGGEEDGRLLVGWLAGVHDIGKATPAFASQVEQLAGAMRDVGLDMPTQRQFGQDARLAPHGVAGQLLLAEWLEERRGWSRRRSGQFAVVVGGHHGVPPDASQLKDLDDRDHLLRWRGPSRSMWRGVQEEFLDGCADVFGVADRLSRWETVRLSQPVQVLLSAVVIVADWIASNTDLFPYFPDAAGQSGEERVAAAWKGLDLPPSWQPLEPSADVGELFGSCFALPPGARVRPVQEAAVRAARSMDVPGLLVIEAPMGEGKTEAALAAAKISAARSGAGGVFFALPTMATGNAMFPRLLEWLDRLPAMEGTRWSVLLAHSKAALNKDYSDLLRAGSARVTAVGMDAGEAETAWRPSEDVRAAAAELVAHAWLRGRKKAILSSFAVGTVDQLLFAGLKSRHLALRHLAVAGKVVAIDEVHAYDTYMSAYLDRVLAWLGVYRVPVVVLSATLPAARRRELVEAYAGSVAGGEAFRAVGEAEGYPLITTVAPGGVPVIEEPAAAARGGAVRLERLSDDVEVLAQRLESELAGGGCALVVRNTVKRVLETARVLRARFGADAVTVAHSCFVDVDREAKDAGLLVRFGPPGRATDRPVGPHIVVASQVAEQSLDVDFDVLVSDLCPVDLLLQRMGRLHRHVRGEGQSDRPERLRTARCLLTGVDWEAPVPVPVRGSVAVYGAYALLRAAAVLRPHLEGRPVLLPGDISPLVQGAYAEPWVCPPGWEEPVGVAYERFVEHRRDQAARADVFRLAEPGKPGRPLIGWVAAGVGDADDTRAGRAQVRDGRQSLEVVVVQRRADGVLVTPEWIDPARAGLELPVDRVPASRAAKAAAACGLRLPVQFSYPEVMDRAIEELEQFYVPAWQSKDCHWLAGQLILVLDADCQTRLAGFRLRYSAQDGLEVTREDQ

SEQ ID NO: 11895 - protein, 584 aa, Pyrobaculum oguniense TE7
MTGDLSSVAKEVIKREVEGWAQAKGKAPSLDEHVLARQAEATAKILEVFYDNSGGRLVFLEGPTGSGKTEVFSALFFAQWRLGRWHSGRLFVVEPVHALLRQMRKRLGVYGELFGVGVGEDHGEVAKPTYLYTAPATLTTVDSYVYGYLAKRVDTWLERGAETGRYTLPVGVMMNSFTVFDEAHVIQDEVFLGPRVLADVACFLVKAGAYVAVSTATLPTAFRKLFEERCGERIISVQLPGRRREVAVEIREKELAGDDVECEGGTLVVVNTVRRAREMYKYLRERCGRGVRVVHSLMKRGDRDGVVDELASLEERGDLEEVILVGTQAVEVGLDFSFRRLYTELAPLDALIQRIGRVGRGGQRAEAYVYTKVEPRPYIDVVMKRTAEVVRSASTLMEGLGDVDKTRELLDVVYDDGLVEELSKRGDEFYLETVDYFYKLHLFALPPEEEPFIRPSFYIDVYLLEKGDVKAVGEGQAEAKLDLLYKSRIRISAKFGEESRVERVWLLLDRCKKYRIKDVEDDFAHLELLEAVGQAEGAVYRLGHVVTVCDNLAEVYDEAGLRVEGAGESARPSKGRRRGSRGGV

SEQ ID NO: 11896 - protein, 759 aa, Acetobacterium woodii DSM 1030
MNDEGEGKMKNPEDYQAKPDKTIKEHSLELIDELDRLNNLGYIKNDQIYELTKKACWYHDFGKANKEFQKRVMSEKKIRMSLEREVFHNILSVFLIQPDAFESKDDYYKVTQAILFHHDYAESYEDVYDQLKSRKELCTALLNEFPLVPIKNRLQLELIKRIEDDQVVKIKGLLHKCDYSASGGFVAEYPNDFLESGLENLGYDWNDLQKFCIDHRNENIIAVAQTGMGKTEAGLLWIGNYKGYFVLPLRTAINAIYQRIVGDETKKIVSEKLDERVALLHSSSLSYYLEMAEKNKKELVEMGMDGIDVEEYQKRGHQHSIPLNISTMDQLFDFVFKYQGYELKLATLSYSKIVVDEIQMYDSDLLAYLIMGLKRICELGGQVAILTATLAPFVEDELKMAIPGIIKQGFYDNSLRHNLKVKDEEICIDDILAHYTANKDSGIGNKILVICNTVKKSQEVYEKLRQSGKVENDEVFLLHSKFTRGDRAKKEEAIKNFGKTYVGDSHEIDVRNGIWVSTSLVEASLDIDFDYLFTELQDLNSLLQRLGRCNRKGVKSIDQTNCYVYTVINEKLFIINGHGFIDSDIFNISKAALSQWDGPISEKQKLTLINDNLTTEKLKKSNYYKAYKSKCDWIASIAAYTIKQKEIDLRHIFSEEIIPSPIFERYRDKITKLVEQINQPNMERKEKLRLKELLYQYTLSVEKYHVTNYEKAKFKGEALTFEPLRIGKFETIQVLECSYDESLGFRKLEKSQIRNPEFL

SEQ ID NO: 11897 - protein, 2930 aa, Saprospira grandis str. Lewin
MKALIKLFNQYNIDYKALINNLESIGEKLENFIGIDWLVSAEVLSLFSELEKGHSIDEAALWRLRLKKYKVESETILTQLEGRSFADELGKVERILSREETRSKNIGDSNSLLTQLENITKLEHQILGKKLKLGVVNFIAEDKSHGYVLLFKNFNELKERKFMKNKRGPYLRECSNLKRTEIIEFEHQNNDVIRPQSKLNAFVFFRKGIGYAHILHQDYYQQGIEFPAPVRFKFKADLYRVKLSFKYKGGVKVDLVEELNNIAHESFLLEKLDFFISKLDVVSVLYAYRGGVDEGKLKKLIKSTIQIVDSTDDQEVESYIRLLDEFDLSLNDISVVLNSFSRLYLKLLSKGYKFGISTLDLIQKDLMSFEKYCAESTPKDLAILGVELKSEGLSNEIQQILFEGILKPKLLVDDELQNILTSFAREYPHFKIDLQQLHNGTSLNVKFSLFCNGVLNNIEDSDLEEILRKGYNFEEVLNSFYILEQSQVEKLLRKVLEHQIDFFFHGIDVNNKDLANRFKVILDKYPSIVVSTKHFKVKSFRFYIDLYEKGILKELLEEDIKDYIENEDDLSRLFENINNRVKLGPRILEALLIAKLRVKNTKDVTILFNELPSLRKKFLNIDFQKVQFNVDDKSLLIDLYEANVVRNISTKIIQEVVKEQRLEEDGVYDYVNSLSISAKQKLSVFGQFRKLKKRLISEIKNAIEIEFKKLNFLSLDIESNGEEIYELSFIDVLGVHTFKGGKVKEGIIELKERLLKAEIIIGHNIKQFDLPILKKHGIELANQWIWDTLESEFVINPLRPSFALKTSHQAEDDAKLCLELFKSQYARSILSKDKGLKDLLFPLGKKPLELVDIDVVDWEENANVCFRSCSRIAFFENYDLENFLIPGERNFVFCPPILYDELASFCQVYFLDSRYSYILNENKLSKLENSLDVAILKRFIEKRLAEGRLAYWETIPLAIRIRIGNEKKAILCDLVNYQFLSSLEDKNINVVANNIDSRLRDILIEEKVRVVKVGYKISLLTNRHSTNYEYEITDLYERLKGDKLLLKMTGGRNFIAIDSTITPKLGIANPETVKTIWLENDAKGVYKVFYSIDYEKVFLEIGKTNEIIELEANFSSKVDRKVCILRADIEKSNYTAEQYRVNPESLQRALYWTYQFKLISGVSSNRLKVLLINDVSEQARIEGLAQSYGYYVPNENLALGRKLELLSSANNGLLVCPIGRIEEVLSFIEVAVDFYWDSFLLKEKEVVIGEQLSLLSSDLKGQNEEKINPISDNIQKKGVATQQGDIFALLKVHKFLVDYYYHLIYKHNPESSLHLADVRLMDYFNIETVFLAKKKEVVLWNNEASYKQSLALAQQYFKQRKKVELRRDFSGVKKMLSDVFLGEGCDWYEYQHQYLDAILPAEEDLIVSLPTGAGKSLLFQAPALYRSSISHNLSIVITPLKALMKDQVEGLWERGFISNVDFISGDKSFEETKNLYRRIAGGEVTMVFVTPERFRSKSFEKVMLLRIQNDEGLEYVVFDEAHCISQWGQEFRPDYFYASSQIASWFDHKNQRFSASKLLFSATISQQVLSEIKGVLPTLKVVPNTNIVYNPIQDHISLGFKTSFKNENRLEEIAYYLKNNQFNHRKSKGLVFVNSRAQAEEASADMPSILQRIYTQCEFAENVAYYHAGMDTEERNSVYEKYKSNEINLLFATKAFGMGMDISDIHFIAHLSPPSAFEDYLQEVGRAGRNKSKRIAAGFIADNPIQSLCLASDEDFRKIADRLHKSALSWAFVKEVKKEVEQYTAKFLKVNPPMETPVVIPFNLLTRGLNSINDENETNTKFRLSLHWLEKLGRIKLGYFAIAQLEFEKKSLEHLGREMPGCSDPEIKPALNALWEVFSSLDKNRLDEKVSVPISMLRSKSGMALSKLFRSLIKGERIGLIKMTQTISLKHTKQRTEEVKYLVNEKNATPWALKLIFNLVESVLEEVGPKTSRVFDNEYLDIVFKKIDSIHNSKFNFFINSSNESKIEKSRENYLSDFQKKRIKHVFRIIRLFRKIKHESIFNQSDFSKNHEVNQSIFNGCSRNSEWRDYFRKLERDCIGILKYIGEENIKFNNREFRWQVLLEKTSNPTNFQGLSDAIFILTLMGYVRSSGLMPHGIEVYLKSIDAIDETISNSGDEAIKKEFDEVQQIRTLKQIALKAISDTDSSKHDEFIKGYFSCKSIADFINHLQQYIPSTDPIFQAFRGDAIKEQEDRLNPEQKLVYNSPITKNINVAAGPGSGKTHTLSLRVARLVHHERISPENILVLAYNRAVVSELKHRLKTLFQKLGYAFLSKRIKIRTFHELALVTCSEKIKNNGDVLKFEKWEEVLHNELKNNPGLIMNSLGGVKHILIDEFQDINDIRIEILDLIIQQLPNVKLFVIGDPNQSIYGYDRSVMDPYHYYDVFNEQFSPLKFSLMKNYRSYSGILLEASKLLVNDKAYQKLQQANFSQESSLRMLLTEPIQKQAEIPPALNDLLEQHSDSEAMEEFLENADYKLYSEAQNTVPESFMDNYVEVHKATINNSWEDKLLQLLKEQKVVVDEDGKVSKKPYQQIAIMFRTNNELYRGFQKIQQQNISNVRVRIQGSSSGEFLKIRECFHYLEDLLKKDKNSQQTLIQTKVDLEQYISKGIPQALSNEKNWDSFYLGLFYALLQDYLDNLEGKFSVDKLITHIQEMTRRDDGQLYQIFEKYNASSKTQTEIVLTTMHKVKGLEYDAVIVTPSFSDLPLNSNSPIPLRDQIEEERRLLYVAYTRAKYRLAVFQHQRETAIINYRELNWPSLTSLGVPVKPDLDKIQLSWPANSYNFSKGVNDYIKKYIKVGDQVSIHFRQHGNYLFRELIHNDTAVAALSKNAIRTTNNNTLLGYIVSEVIVYTLEDSKVYDAKNGTNYTQKWCPAAIKQGYIYLVNFAGYGQ

SEQ ID NO: 11898 - protein, 844 aa, Deinococcus gobiensis I-0
MDIPSALQALFGNSPYAYQIRVAEALLSGKNIVLRAPTGAGKTEAALGPYLLAWEHKQIDFPLRCIIASPMRTLAKDLHGRAQEVGDGLGLTVKLHTGEDPTDPLLEADIIVTTVDQLLSNYLHVPYSQSHRGRNIGAGGVVASYVVLDEFHLFDPQRAFRTTLEMARALSGVTPFLFMTATMSGELTQKLAEAVGADFITPSQTELDVMTSQQKTRRFRRVDTMLTAQAVAGAHERRSIAIANTVDRVQTLHADLQRLQDEGHPKLRDVTLALLHSRFFPTHRNTHEQRLKTLLGEGSPENVILVASQAIEVGLNISSENMHTEICPGNALLQRAGRNARYKGENGVVSVYTLPLDQKGEWDTLPYKGQDNVIRATWDALTALPSPVQPQAEEQLIDAVHTAGDERNWAEYLAVRKTTHRDKMKSAFEGDRSMRPALIRDIQNVTLLLVPSEMDLSTWEEVNRHERIGVPWVNFALLEDNRRNLKQEYDLEDNWLVKVPHEVEPEESRSGGESREPTRLEWKTVTDAAELKLETLVQVNPKFVFYTAQEGFRWEAPEGRALGVQDFPPIHSPRSSGERLDYWYTYESYELHIERVLAASYKYAADVWRLCPKVDAKFALPTGTTELALRAAIAAHDIGKLSEGWQRWTRRWQAEQVRKYTGQLLWNGVEEAAQHGATPQGKGEYCAHTDYHPKHDQMSSKTFEKAQGHRPPHAGESAAVLSESFGDFLMDRLGEDQGLSMLQGILGAVCRHHGANHMGEVAPWQLDAGAAAEANRVFERLTGVPLDAERLNDLQRWGVEAVTDPDMPAPDDALAWMVYTLASRALRLGDTRSFEDVRRKEAVT

SEQ ID NO: 11899 - protein, 984 aa, Deinococcus gobiensis I-0
MTPPTVPPSGPQQPNAHQPSAAVQVLWAKSGQKSEGEGWLPVLHHLLDVGACAQAILEREPPSTRALLAADFGTDTDTALRWTCALSALHDLGKASPAFQHKAEGLARQVWQVLPWQDHSAATPHGTVTQVLLPGLLAEHGWTSAASQRVAARIAQAIGCHHGQRDTRDRVPDRGTGEEWKAVQNELLTLVLQAFGLQDAPPPPIQSWSGEAFMRLAGLTSFADWVGSSFVLEGEPDPLPFRDPAAYLEQKLIQARAELDRIGWTVRQPLAPELRTPDETFAYLPSFAARPLQTLLAELLNVPSDRPALVLVEAPMGEGKTEAALYAHLQLQRAAGHRGLYVALPTQATGNAMYGRLRTFLGHQVTAGGGEAVTVDLQLLHGGAAMQGTYQADLERTAQAAARPNTQAPARSAEEQRLFPLPNEQKLTDEAESVRAAEWFSHRKRALLSEYGVGTVDQALLGVLNVNHQFVRLWGMGNRVVVLDEVHAYDTYTTQLIHALCRWLRALNSSVVLMSATLPDQTRRDLLNAWGVTPDAPPCYPRLTVARLGDAAPISRHIPGPRRNVKLRLRPLDPEVATLAAQAVTLAAQGGTVAVIVNTVQRAQQVFVAVRKLLGDRFQSMYQGSRHPERIGVHLYHARYPADERLDREERTLRYLGKQPATYTRKGAVHTEDMRPERFILIATQVAEQSLDFDADVMISDLAPIDLLLQRAGRLHRHAANEGRRGAHCIPTLYVAGLADWPKAALDAHKWKYIYAPALLYRSWYALQGRDTVALPDDLDLLVQRVYDPLCPALEGLTDDQERTLRCADRELNSLRRTHITTGGQAHIGEPDTFLELPVQPSRGEPEGEPVQDDPAATAGEEADEPRLGTRLGDESLRIVPLHRYDTVYLDAKGRETAQVATLRRDNWDLARKIYARSLQISRHDVIAALKANPTVRGNEHRGWAAHPLLRDAEPLELVNGEILLGKTRLRLDLELGLVYERLE

SEQ ID NO: 11900 - protein, 817 aa, Thermus thermophilus JL-18
MGEGIGRVFFLKDEVGFQPLSNHQGLVVKLLESWREGDEPLALSPKTKERLLLAARYHDDGKRFTFRIVPDGKGGLTYSFRGHRFRVAQAVQDPYAQALIRGHHDYSTRGVVNLAADFLEEGLGHRFPEDLFLLMMADQLEAELAVRLWQGRAGEVRPFVEFDLLPDGEGGFLLDPWPFRVDEVALDFLVYFHPYRGEEAEVVEGWGRALVGALEEGKVPEAFQEETRRVRLRPWAAEARKADDPEAFYARFGLEPTPFQREVFKVAEGDPAHLLLAPTGTGKTEAAAFPALARGERLVFVLPTRSLVDDLEGRFRRYLKILAQEEGRPKALVVDTGHRQARFRFSPDGQEEATKERHLYHADVILTTLDKLLYRYFGYAEGVKSYTFPRRIHDRRTLFVFDEVHLYEATAWVNFRHLIASLYKAGVRFLVMSATMPGTYREELLLEGTLEHPPARRPSRVLRYMPQGNPMEIIQSHRGKRVLVVLEEVKEAAELYKRLKGEGVFLYHGRLAEGQRRRVFRKVKRRDKAQKPYLLITTPAIEVGVDLDAEVLVTTLCPPENLLQRLGRVNRRGRGQGEAYVVGETYPDYLGSLPEGYLELLKALDGQDLAQGEEERLRQAIRYPKYLDPRAETFFEALQDYVYGLDLTQEPLHRKGFVATRGWTPSVRLRQGEDEVEVPIDRLVGRKEELTPVRVVERLLTDGEKGNRRWEEVPLRSGELYGRELVVDYPYPYDAELGFVELPKVFQRLRHPDPQRVQLLYAPEKDAGEAPEGVMDTDQVTGGGRRVLWYLGESAWAEPAKSGEVAEETEEEEEEGD

SEQ ID NO: 11901 - protein, 552 aa, Fervidicoccus fontis Kam940
MRLLITEFQDFFDPSVPGLGVLRLPTGYGKTELFLQFAEMTCNGNIERAVYVSPLRTLNEDLYRKLAERVPCLRENSDILAREYMERRESPFFHKKVIVTTIDTIGMHLHKIPIPELKALLRGFFKKDFSTRGHYPVSRSNVSESLVFIDEPHLMVLEKGMKQMFYNTLYYLLGTGATVVLASATIPGSMISNAKKLLETTRDMLKIDIKYTECLYGEKCGEADGRDEDFEEKALAKRVSISMSESLDDSLSLAIKRKREGKRVLIILNTRETVLKAQRKLLELGERPILLHGLLSKNDREERTSELLDMYKRGESYIALATSVVEAGIDISSDFMVAELSPLPSLIQRAGRLLRKDEDVDGELVILITERRGPYDAKEVEATKDLLVERLNRVALKAPLGKEGKIGYMKLVEEWDGLMRSDEEHIQYRKDILSLSPRDQPLNINDFLTGELGRRIVSINAFIEGRRGDSVSIPVQDLFAYPKDRLLNEIRNIETCREEGKVLSKEEFINKIEAMLSREKSIEKVNLYLKENCIESISISEDLYADIAYGGR

SEQ ID NO: 11902 - protein, 823 aa, Borrelia crocidurae str. Achema
MNDFGLPIYKYKDDLIKKLSTNSVLIVESPTGSGKTTQIPRIIYEAGLAKLGKIGVTQPRRIATISIAEYIAKHIGVNLGEEVGYKIRFQEVISPKTKIKLMTDGVLLQELKKDTLLYEYDVIIIDEAHERSLNIDFILGLLKDILNKRNDFKVIISSATINTKIFSKYFNNAPILSIETITYPVQIIYNPPLLNTSKSMILKIKEIIAGIIKEKKEGDILIFLSGEKEIKETIKEIHALNLKKDLIILPLYGRMAKEAQEQIFMPTPKNKRKIIVSTNIAETSITIENIKIVIDSGKVKTNKFQMKTHTYSLQEVPISKSSATQRAGRAGRLSKGTCYRLYKRDEYQLRDEYQKEEIYRTDLSEVILRMADIGIKNFTKFDFISKPSIKSIQTASDILKSLDAINEKNELTEIGKYMIIFPLIPIHSRALVEAMMHYQQAIYPTTIGLSFLSTSGIFLLPQNEEIEARQAHLKYKNPLGDLIGFINIFEDYRKAINKEDFAKENYLDLQGLEEINNVQRQLENIVSSFDIPIVHKNEIDHEGYLKSIMRGMKDYICFKTSKNKYKTIKAQNVVIHPGSLINTDSVKYFVAGEIIETSKRYARAIGVLKKEWLNNIQFEENKNIPQKENKQSHHSHKNNILHKENKDSLKKEIKIGGKKFYIQNEYKNQLTFSLKEIKQLISKGLKNEEEKAIKNVLAKLTYENLIIFKNKKLIEIMRIVNGMEPNWTLLKTYENTNVNINEIDKIKNILECTMNFIQHPNKKSVLFLSLRSDYADNFWLKPQKSFIVAIEESMDSIKSLIDNQDNITKLTSIKKTINKVYKN

SEQ ID NO: 11903 - protein, 991 aa, Methylophaga nitratireducenticrescens
MMVTFVSQCEKKALARTRRVLDAFADRIGDNTWQTVITQEGLNAVRKLLRKTASKNTAVSCHWIRSRSRSELVWVVGRTHVFNHRGVVPVNFTSKEVIMDRLPIETGDLLANTRAQALSKHLFAAGFVAHQILDALQINNQNLKQAVFIAGIFHDIGKIDPEFQNWVNKKLGKIPDDFVPDDGVHIDSPAKFSFEKHPRHHELSWIFAESLMDGCSLNDGQRKQIAHAIYWHHTKPFRKEDKFTNPEAIYAVFKKSLAKDKFEDVFNKVLAVIKDVGYMASKFEVENFLVGLNNSFSLTSKTCPDYKKYDGWADDIPEFQSNVRENALNNLVRSAVISADRLVSSRSSEDLEEYLAEGSLAELNNIEITQDKSLLKEGIEQCLYGFISAYPNSQRNEAQSHAAKSLADLKKIAKLNNSANIGVLQGPAGCGKTKIALEWALKTDAEKIIWVCPRVQVCLGLLHDLTAEEYLPDGQIEIFTGEYKKILGNGRSFEDVPDTDESDYFSGDIVITTIDQVVNSIRSHSHVDTFIQFMNAHVVFDEFHELVNMPAFNLLFAELIEAKKQQGEHANTLLVSATPNYFYLTQFLGIQKEDIITIDSFNASRYQIDFINYDEKEELSPLIRESQQGKTFVITNTALDAQLGYLQHHGIENSVLLHSKYTKQDKAYWFDAVFNSFKRNGSQRYEVLRSGPIVQASLNITCDRMLTEITNAENWLQRLGRLDRFGENEGVNPYITVIPKSLEINGKQTSSCARFLNQMCVWNSTKAWLSFLKERLETQKTVTINQLYEIYRSFYTDKQAQEWLKQDFLLSLKKSVELINKKIIDPISVPPKSKLKQGIIKISANSLRGDNRFVQMAVCEVLEDQQLFFSENYASSETFNPNQPPSALTESIETMRGYGNDDANLVQFMQKKHHNIKSDEGYKKARNEWELIKEARSPESPIYLSYTPKDLSLVNSNPHPQAVYYVISNRQPVGAMSIAKLKNKLKSQTAE

SEQ ID NO: 11904 - protein, 821 aa, Aggregatibacter actinomycetemcomitans D7S-1
MSRNAIAHVRQSDGLRQLLIDHLFETSSIAGQLASKLNLSLAGELLGLLHDFGKYSLSFQDYIKAATGIDPNADDYVLPGGRKIDHSTAGAQWVYRALRKYGVAQGIGELFGQMLGLCIASHHGEGLIDCLDESGNAVWKKRFEKEDELTHLAECSRNADAQVLQRAQTLAGEELVRELLNAVKPILSDKTIPQKKQEFYLGCLTRFLFSCLIDADRINSSDFEKAHQKDVRRLVEKPDWQDAIEKLENHLAQFAIRYPIDQIRRNISDDCLKRAVDFQGVYTLTVPTGGGKTLASLRYALHHAKKHDLDRIIYIIPYTSIIDQNAAAVREILGEDWVLEHHSNLEPEQQSWQDKLLSENWDKPIVFTTMVQFLDAWFGGGTRGARHIHPMTNSVLIFDEIQTLPVKCVHLFCNVLNWLTQFGKSTAILCTATQPLLGEAGLNHFPENEREKIIRRGLIKLPENAEIMGDHQDLDNLFNALSRVEIQFKEKAGGWTAEDAGEFLLEQFQTTQSCLFIVNTKKWAQQLYQYCEQQNVPPEALFHLSTHQCAAHRKAIFERIKGRLKNGEPVICISTQLIEAGVDISMKCVIRALGGLDSIAQAAGRCNRHGEKDSKGQVYVLNLQEPDFQKVLPDIQEGKSNAGHVFRDFAGQDILQPAAMQRYFQYYFYNRSGEMIYPVKNSATGSLFDWLSDNQNNPYGNKNNKKTKSVSLIDAIIQKRGAGFSRHDAPTRAVIVPYGEGKALIGKLCGEWNPAEMRRALQKSQRYSVNVFPNVWDKLQKDQAVHETIEGSGIYYLNERYYNDAFGLSLDETSNMTFYDL

SEQ ID NO: 11905 - protein, 749 aa, Aggregatibacter actinomycetemcomitans D7S-1
MSRAQDNLYYTHSAHAPNGDPLPHDYWQPLQTHAQNVGNLAASFAEYFGAQDIACCTGQLHDLDKYSPDFNARLHGGRRVDHATAGAKIAVERWQVIGKLMAFCIAGHHAGLANGNGKGDNRSTLKQRLNLQFGADIPRLDDIWNGKSSSPQPCPCRRSKPMPIIRFSPTPSSPVCSIPAWSMLITSTPKYYAGVENQPVIRDGYPDLNALQQAFNRFIDGFRRRPTQSAQQTEAEQRNVALNRLRSEILDHAVAQASEPPGLFTLTVPTGGGKTFTSMAFALEHAKRYGMRRVIYVIPFTSIIEQNAAEFRKAFGEWGEAAVLEHHSTFDDGKLQNIDTKDKLRRASENWDVPVVVSTAVQFFESLFADRSSRCRKLHNIAGSVIILDEAQMLPPALLLPIMQAIKELAQNYRCSVVMCTATQPAVQAENGFYRGFENVREIAPKPTALFARLRRTTVQHIGTQTDADLLAKLAEHPQMLVIVNNRRHARSLYDAAQHLDGIFHLTTLMCAKHRSQQLDKIRGRLKNGEPCRVIATSLIEAGVDVDFPLVMRAEAGLDSVAQTAGRCNREGKRLPENSHVWIFAPEDQWQAPPELATQAAAMRLTAGEFSDDLLSTQAIAAYFKELYDLKGSELDKKQILPMHNKAGPSLDFPFQKIAEAFRMLESHMQPLIIPFDSEAEALIDHLRYADQIGGLLRKFQPYTVQIPEKALAALYKAGRIEPLNEKTFGKQFYALIGLDLYDDVAGLS

SEQ ID NO: 11906 - protein, 684 aa, Mesotoga prima MesG1.Ag.4.2
MSLAKPGVSLVEHTERVLDYAHSYLDQNKIALKNTNLDPKQISEAILTACAFHDIGKGCVEFSFDKKGFSHSLASAQIAMASLKESPIKNYILQSILGHHGSRFKDSFSSLEFQRQQATPNLELVNEFKEIKDYAKGHFRIELPDLDLQIPSPRELLKRLCNFFFGAPRDRRLYFLIQGILNLADWSASAKKSLSSASIKLDSRPLRTFQAEASTGKDTIILAPTGRGKSLAALVWTKSTGREKSTLFLPTVTTVEAMYKRYTEEVSDKTGLVHGNIAYYLYSNEGYSEDTRDRIFWMKAFDNPINVATLDQLLLMSLNWGRWEPKIVNIVNSAVIFDEIHASQPYTFGILLESIKMLNAMGTPVCVMSATLPSYMIQKLKEVLDYPVIVRDYEGESLRRITISHLEDVDPVEETKRQHKKGKKAILCFNTVKKATEAFKTLSDKIPDKEIILYHGRFNLEDRERILSRITGDSPPRIIVATQTIEISLDISYDVLITEAAPIDSLTQRFGRVNREGTTPIGEVMIFPQNENSYSVYNKNLVAKSLGLLKAHQTPSGLELREMMEDLLSEIENIEEEISAGKASWQFVREMNFQIYSMSIDQRLADDLIRRIPYKTIEVIPAEFRNDNSGKMQKLGKLVKVPVRDVIGRLEKDDDGFIYAPIIYDPSFGYLGPKEDEGSIVEGF

SEQ ID NO: 11907 - protein, 781 aa, Mesotoga prima MesG1.Ag.4.2
MSHVRSHPDRLLEKHTVGVWSLMTEEIENIGKFIDCENLFGISQSELSVLVKGIAIFHDLGKASEYFQSHLSGARVDSELSQHAAVGSLSVGHYLDGKIPDKSGAAILIAMAVIKYHHGSARDPKLILDSFDENQKFLEKIVRKLDENYLSWMEDLLDETVDLDLPSLIPRILSWERNYRKHREESGIKYYVLFQYLFSLLTWADRVDAAFRGDYKSERQTFSPDIVDIFRTTAGFDEPKTDMNLLRNNFYREAISNLDFTVGSMKGRTGIGKTLATLSLASKKREIIAEEQNYLPRIVYCLPFLSIIDQTFATIRDVLETSKIKVTSDILIQQHHLTELSYIKRKDGDENENYDAYLADILLNSWDSEIVITTFVSLFHSILTDRRNTRFFRLPGSVIILDEVQAIPPKYWKVISEVLEHLSKWGGTKIIFSSATIPQPFFVSSFPLIKGEYNLDRYDVRYLGKMGIEEFKYGLLEESVNTAMEEDKSLMIVLNTINCCKELFEHLQDSGSFTDENLHCLSSSLPPAVRREIIKNIKKKKGFQVLLTTQLIEAGVDISFDYCIRDLGPLDSVLQVAGRVNRSCEGNRGEMTVVDLLKEDSGRPFSWIYNDTIIWTTREILSSLKGSISEPALYELGDQYFSRLMNKGLENESLELLEALVKLDFERIAEFSLIEQLKGAVSFPVFLEIDDEAKRFWENYCEVLSTKPPIEAKFEYIAKRKQAVRNLAPYVVNVRLFLYPGAKKYTLPDIQHGFCYVSSDELEYYYDTKTGLKSDEESLFL

SEQ ID NO: 11908 - protein, 864 aa, Haloferax mediterranei ATCC 33500
MTAEYERRYSHPAEDGRPAVLLFEHLRDVRDRVDMVIPEGATTPEGKPLCGVIRRLALVHDFGKATTFFQQYIGAQLGQPTHDKLRYHAPLGSLAAYYVLRETGHSTATCLAGFVAVAKHHGRLPNVVEYVFKRMASPDPEKWMADKKQVENIHKNAPRLATAIFEEATGDDDAWLDFAQSCVNDESLFTEIADHVTRNGERPITEPTFLTDEFYGLMLECWGTLVLADKTSAAGAPQASSVYDATNPRTADLTQYIDNLGDGNTDPDGSRTEQLNYYRSRARQDVLDSVTEFVESESDVATITLPTGMGKTLTGLNAALEIRDQTGGDRIVYALPFTSIIDQVGAEVQDIFDTDGSDGIVALHHHLSDTRFGYSDGDDDASDLNDDIAGMLGESWRAGLTVTTFVQLFESLAGPRNTQSMKIPALRGNVIVLDEPQSLPLDWWKLVPRLVDVLTEQYGATVISMTATQPELFPAPMSLVSDAERYFTVAERVQYHLHDSVERFLRGEEQPLEYNDAANELVEVAQSGDSLLAICNTIDSARVLANAVTERIQAVNLAEQYFESLRNGSSDPVAETVQLVRQSSKQAFVHLSTRLRPTDRLALIRIIKQLRASGSPVIAVTTQLVEAGVDISFENVYRDLAPVDSIVQAAGRCNRSFERELGAVTVWWLTQPAEQRHTPAVAVYDTQGPSLTPVTASALDSVRDGQTKLAGQSVARAAVQEYYGTLHKEKNVGREEYHEYVDDADAESLGRLSLITQTKTVDVLICVTEADQTLVESLEGAYENYDFQEVKRLLNATKPLRVSIPIYRDDSPEANVVTELRPLAGRKDESSIRVLDAGTRDFEKYFDHTTGFVVADSTVEDRFL

SEQ ID NO: 11909 - protein, 524 aa, Pyrococcus sp. ST04
MNPYEQVAQRLSQIKGFKPEKRPLIEEALDRILSSDTPFLVVQAPTGYGKTSISFSLALYSLQDASLFDRVIHVLPMRSIIEDIDRTAKEAFGFSRTKMMSSNEEFLHLFPLNITTVDTFTWDVLKLNTKKIPQIDRGREFGYDYLTQASILTSLIIFDEAHFILEDPRMKTVFFSVLKFLAENNVPIVIMTATLSRGYIKLFEECTKKNNLEILSPNEEDPFIRRELRKEFEIKFQTGNPLDFVDNTKRVAIVANSVSRAVEIFDQAKENAPELGFEEDKIILIHGRMKPSHKAELIERLRKLNNEKSFLLIGTQAIEAGVDFSVDIMITDAAPINSLLQRFGRVARYRERKGEIIILEDAPTGPYSKEKIEKTVTLIKEAPGFNPRVPWTYQKIVNEVHGERKPEVMRGVNRSLMRKLHTLLKNPTKRSKDVLNEIKLITKDEGPLLRGFLIPLEVEGEIVLISPKKLLELSKKGLVKVVAREREVSLCSFKDAYDVAKMIALGNPITIKFTGEYDKERGIV

SEQ ID NO: 11910 - protein, 803 aa, Tistrella mobilis KA081020-065
MPFYAHSLKDRPETAWHLLADHLRAVGAGAGVSAARFGQGSIAGAAGLLHDTGKYSPAFQARLRGDVTKVDHATWGARVMSEMIRDRAGGLAGRLPGAQAVLYAVAGHHAGLADFEDQGDGGRGSLRERVEKKPLDDASAWKDEITPPEPDESWRHLPPPRPGEAPDDRAGFRFAVMTRMVFSCLVDADYADTAAFHAAAEGREDPEAGLAAAPIAVLRARVDGFIDGLAADAAARAAGQAGAERVVAARAEVLADCRAAASAGQGVFSLSVPTGGGKTLASLAFALAHAEAHGLDRVIIVIPYTSIIEQTAGVIRKALGADLADQVLEHHSAFDTEADLDRRNIPPEARERWQGRDKLRRAMERWNRPIIVTTAVQFLESLFSDRPARCRKLQAIPRSVVILDEAHMMPRGLLRPTVAMLDELAANYRVTVVLATATQPVLVAPDGTAEVVDEYAQVFGLEGGFQAVREIVSDPSALHDRLARVRVREAGILDDAGVIARLTTGPRALAVVDTRLHARRLYERLAAAAPEGAFHLSALMTAAHRSRRLDEIRARLAAGDTCRIVSTTVIECGVDIDLPMVLRAAAGFDSIAQAAGRCNREGRLGREGVVEVFTPADPADQPRRLAQALAAAAVARGRMVEDRIDDPLSPEAMRLYFDALFWQALDMLDAENIMALHDSPHRLAIPFATVAERYRIIEDGMLPLIIPTTPEAEACVAALDAADPSALDRFGGAGGAARLLQRHVVTLPPRIRKMLVEASAARVVGGERYGEQFMVLTNPSLYREDVGLVWEEPAFVAVEKLLF

SEQ ID NO: 11911 - protein, 787 aa, Thermoanaerobacterium saccharolyticum JW/SL-YS485
MKTSCFSELYSHPDKYLEEHLARCADLAEKFLDEAKSNLMDEELLSKLVRIVALCHDLGKSTGFFQEYLSSQDDNKKKELKSKKETHHSLISAVVAYFAVKQEVSGLDIDDDIKILLPFISYIAVKKHHGNLNDAATEASLEDRDIEIMKSQLQSIDESKFKILSDNLKKAGLNIDLNKTTVANNIENIKNEMRSIRLYLRKIKQREDLTYYILINYVFSLLIDADKSEVVVGEISPAYVELMPDAVDKYKSQISYKDNRINLLRENAYREVNENEINVDERILSINLPTGLGKTLTSISFALKLKRKLYDVYNKNFRIIYSLPFLSIIEQNYQEFEKILKTNDINVNTSVLLKHHHLSEVKYNDNETELDTEKSKIMIEGWNSEIIVTTFIQLFHTLLSNRNSALRKFHRIANSIIILDEIQSIPFYYWKLVKEILKAVAYKLNSYIIFVTATQPMIFEGDEIRQLTDKRKYFSQMERVVIKPVLQKEMHLDELIDMFDLKDGRSYLFILNTISSARDFYRLLKEKLSDEEIVYMSTHVIPYERLERINLLKKNNIKYAVTTQLVEAGVDIDFDVVVRDLAPLDSINQSAGRCNRNWERKGEVYVVSLIDENNRKYASRIYNKVMLNITERILSQHESISEKDFLDIIDQYYKEVSQNLSSKEAIDILDAVFKLKYDSDDDTPSVSNFKLIDDEYYKVDVFIEYNEEAINLWQRYIDLKKIKNLYKRRSTFDEFKADFYKYVISIPEKTENMPAEVEGFKYVNADSLKDYYDAETGFKPSGVLSIW

SEQ ID NO: 11912 - protein, 781 aa, Thermoanaerobacterium saccharolyticum JW/SL-YS485
MCISIPRSSSTLANYSCLNDVLAKDDGETLIEHTKKVVKVLIELKNLFENAGSYFGDDLLFEKVYIAGLLHDLGKIMPSFQIAVQNKSHWDLRHEVASLFLIGDIYINGKKLDENEIIDIYTIIVTHHKSLKDLKEKWIGYIEKSFIEVTKGKIEEGIVELAKLLEADRLSARRIYHDIFLEYVDYVKKTYNGLTGNILDLDIIKNYSESRFFQRFDRIYDIVQDSKRKQKLIFMIGLMKSADHLASSGQTEIVKIKIDFKIFEKGIRLYSTQEKASKIKDDVLLIAPTGSGKTEAALSWAKNNMKDSDNDRIFYLLPNIASINKMVERLQNIFGKDKVVPVHSKTAFKIYENFIEEKTFEELSEEEKRKINKNVSQQKSLIKKIHFPVKVATIYQLLKNAYYIGDYEINFAELYNARVIVDEIHAYEKEAVCKLIIFLKFLKENFNTKIMIMSATIPTSLQEFIIKKLGIENVLKMKDEELESFNRHIVFRLPGTLMDYVNEIACKVRNGKKILVVANTVETAQNLYKILKDKLSDNCIKEEGIKLLHSHFTLKDRDKIEEKVGDYKLLVATQIVEVSLNISYDELYTEPAPLDALLQRFGRINRFREKRELAPVFIVEKDINEKGYPYRDREVVEKTLELFKESPVKLEEKAIQKMLDEVYSSYDYEVFLDPRLHNYLNELLTEKYDNKDLRKQFYEEFDGITVYPFAFKDKVIESIDSRDFYELELYKISLNLGTVLGLMKKRLIEQEKINGIPINFVKCYYDSEIGLDKNRPLEIKK

SEQ ID NO: 11913 - protein, 622 aa, Desulfurococcus amylolyticus DSM 16532
MARSDVDELTVFKELIKEMVGAWAKHNEREISIDEELLYEQASIAKNLYDIFSNEGDRDAIVILEAPPGAGKTEVLLATFFAQWKLGKRFAPRMYIVSPTHSLLSQMASRVKVHVDNILKLNGGKYVGEDHGEVSEPTFLYKALITLTTVDSYSYGYLAKRVPTWPIAGGAETGRYSLPAGLQTLSLTVFDEAHLIQDEVFLGPRVIAKIAVDIAAAGGLVVFSSATLPDSMIQLLNDEAQRRGLSIKSFKMGGKKRRVNVRVINKELEANEIACEDRTLVVVNTIPKAIELSRNLDNKCKGFDILTLHSLMTRADRENVVRKLDQCEKRNCRVILVGTQSVEVGIDYSFKKLYTELAPIDALIQRFGRVGRFTNIGEALVYNPEGPYPYIDKVVDNTRSILSKFGSAFTLDLSNIASLKNLVNQVYDESIVDEIASKGNELYIETLDYLTNLHLLARPPEKTVYLRPSSYINLYILSKDEIVKAGNEVKVRADVLGESHIKYSIPEILELNEYKLKRLSQLVEYARSNGCEAYTISWRQGDYISLRLIDTEETKNREAEIVGILRKFGALVIVCDDPNNIYERGRGLRIKEIGLRIKEIESSMASTQPSRKRGGRKSRRGR

SEQ ID NO: 11914 - protein, 609 aa, Desulfurococcus amylolyticus DSM 16532
MTFIDAIHSRPGLEKARELFKRDGKLVLIAPTGYGKTVLSLKLYRDYVQQGPWGGLIHVVPYRALVRQIYSEKFKPYVPSSGYQSLEYIEPKDKSPYFLRDLVVTTLDSFVYNLFKIPVAELNKIYRMVSQGHYYPIELSIFTSIIVLDEAHVYLGDIDEDTSIAPVVAASMFLNNAGVPLLIESATMHSDIVSALSNNILGGAKVVYIGGENKQVEKLREKGVSVEVVRDRDFESSNSFNWRTQLISKDKIIEVLQRHCRSSLVLLITNTVKRAIEIYNEILEKGVCDKAVLLHGLLSNKDREKALSEMNKALSGVIVSTQVVEAGIELPSRILITDPAPLENLAQRAGRLCREKYTNIYEECKKEGPLVFIVKPAEDSELNELKGPYEAERVKSALDSINNILVRHREVDWRLMSHRENYTPFVELLEDTPVVQQGLLKTNIGTEILKEYLRSDATPEVLIDILSSVGLELTRSGFLVNLLVNAKDVCGRELRDLEELETVPIDLRSLLRRRGVRIVETISMNGRDYLRLAVVRVVRKSGENVFKVVCDEKSKYYIPTWAKEISHKEYQGLTTPKVEDGEEYFGSIAITLLVASEGSYVKGRGLSVW

SEQ ID NO: 11915 - protein, 861 aa, Sulfurospirillum barnesii SES-3
MPLLKFSDFDIKFNIDDKYKAHLSQNKQYKESLKEHIDLVYDYFLKLIEQNDLEQRLNSLFKKSANLFEEIEVKEEFANFTKYLFAKAIYWHDMGKMNPNFQKEKMLNEIDEKSVISDSHHSPLGAYLFINHSLDELYAKKWHEDNEEIFEAIIYLFGFLISKHHGVIYQYEDLDLQNEFVDFLDKFHLETEHTKKLRDEDRVFSSIFDSIENNEEVLFLLSKSLFSLLIISDYYATAQFMNYGNCKELKYKNFGLVDDDFRKTIYKRFYENQFDKELINKTTSDFKDFDELQEKSNSNLNHLRNKLFIEVRTNLQNELKKNKSQNLFYIEAPTGAGKTNLSLMSVVEILKLDTSITKVFYIFPFTTLITQTYTSIKKILALDNAQIVQLHSKAKYNQKQEEKEDGIYGEDKKNFLDNQFMNYPMTLLSHVKFFDILTGISKDDNYIFHRLSNSIVIIDEIQTYSPDFWARIVYLLDMYAKNFNIKFIVMSATLPKIGKIIDSQFTFLVSNKQRYFQNPNFAKRVTIDTNVKNINKPEEIYELLIKGSENYQTLETNDSKKVKTIIEFITKKGADEFYKHAKKYSEIFDEIFILSGTILEPRRKEIIDFIKNTHDKNILLVTTQVVEAGVDIDMDIGFKEKSLVDSDEQLAGRINRNSSKEGNKLFLFSIGKGNDKFVYKKDKRNGLSGKYQEDGKEQNVLNTKDFDKFYSQILDKIIENNTKNFMENLKSYIDDLKNLQFKKTHIELIDMQSVSVFVPINDEAVAVWEAYEKTIQNKEQDLIDKKIDIKKLSAEISKYTFSLADYHGSGIKYLKDYGDEKYGYLYLKDWRNQKDDGTQLYTYEDGLDTSVLKGDFVPMIL

SEQ ID NO: 11916 - protein, 877 aa, Thiocystis violascens DSM 198
MKAFNQCDAFGKLERDQSETVIAWHSLIDHLIDVAACFVRLCRCRSIRRAMEQSAGRALTANDIARLAVLVFLHDLGKANSGFQAKRWPGGQAPTGWPDCAGHRHGHSVEALDLLRDEAFLEPLIDCLPVAEIDTWGEAVFPLFRASISHHGRPVSERPPGDWPRSIWKPVIDAHGNVVYDPASVLVEIGRQARALYPEAFTPGGISLPEASALDHLFAGLVQLADWLGSDTEFFPFSAVGEDRAWTSVDYADRAVMSLGLDAADSRRVLEALSPSFAQVFDDNSPYPIQTAMDAVDLGPLMVLESETGSGKTEAALWRFVHLFERGEVDSLYFALPTRVSASQVYERICKAVNNLWSTNRPIVVRALPGYAAADGHEPKALPDFKVQWPDDPADEEAHRRWAAESPKRFLAAPIAVGTIDQALLGALRVRHAHLRHALLARSLLVVDEVHASDPYMTVLLERLLQAHLGCGGHALLLSATLGSSARARYLAVGQGSRSAPPAFQAACDAPYPALSDRLAMRAIASTIRPKSVTWSLRDLIDDPGAIAGLAIDAASAGAKVLIVRNTVPAAIAVFQAIEKLAPDLLFEVNGARTLHHSRFSREDRPLLDAAIQAQLGKKNRPSGPRIVIGTQTLEQSLDLDADLLITDLCPMDVLLQRIGRLHRHPPAQRPLAYRSPQAWILTPTNHDLSPLLKNSRHGLGPFRDGDGIYPDLRNVEATRRLILERPSITIPADNRILVESATHTDHLAAMERLGEDWARLGERFDGRASAKRTIGYQSGLEIDKAFDKQQPFPNEKEFDIATRLGARDRLLIFDSAPIGPFGSSFTHLPIRHFLISDEVAGDTQPIILTNDNGELLFSLGPAHFRYSRLGLEKIEP

SEQ ID NO: 11917 - protein, 632 aa, Aequorivita sublithincola DSM 14238
MKNIRDILNQYWGYTSFKPMQEEIINSVLNGKDTVALLPTGGGKSLCFQVPAMAIDGICIVVSPLVALMGDQVNALKESGIKALKITGGISFNELNALLDNSLYGNYKFLYLSPERLQQEIVQNYIKQMNVNLIAVDEAHCISQWGNDFRPAYKNITLLREIHPLVPIIALTATATPEVLEDTISELKMELPAVFQNSFVRENLSYQVYKEEDKLYKAEQLLKNNSGSAIVYVRNRKSTIEISEQLNSLGISATFYHGGISAKDKAQKLQTWRNGAVSTMVATNAFGMGIDHPNVRFVIHLQIPESLESYFQEAGRAGRDGEYASAVLFYNEYDKIYVKQQFVESLPNTSELKKIYRTLNNYFQIPYGEGEFSKHNFGFAEFCKTYNLSSLLAYNALNSLDRLGIIQLSQEFGRKSIVQFLISSEKVLHYFEKDITTSVIGKTILRIYGGIFEMPTSINLDLIASKTGQTVETIIAILKKMERDQVVEATIQITDATLTFLVPREDDKTINVISREVEALNNKKIAQVNSVLRYIENTKTCRSMQLVSYFGETTASKCGICSVCNPKSANLSKREIQDIAKKILALLEGGDLTSREISEKLTFTEDHILKVVRLLMDAEKIKINSRNQYNLN

SEQ ID NO: 11918 - protein, 725 aa, Thermococcus cleftensis
MRPCYAKFLPHDFLECHTNDAINVLKSMKTAFKWLEEPFPRVWELSFYSVLLHDLGKCASGFQRNPREWGYRHEVLSAPFASFLDLPEDERNLIALAILTHHRTLDELEEILPSGEHRGGFEDKVEELFQNRDYIEGIFFERVPYWELYFFGRRLELFNPPKDWSERVRGYDFDALISWYERNVERYREELVYLRGLLNASDHLASAGELEVRLLPDIRTAVELRIPEERWRPLQRAAWNTEGNLLLRAPTGYGKTEASLLWADRNAQRTRKGLSSRIFYVLPYKASINAMHSRLLGLFKDPALVGVLHSSSGFYLYSSELEYRRLSSLYRKIYTPLKVTTPFQLMKPFFGVGFFEMGLTELTGSLLIFDEIHAYEPNVLGIILAILELLKGRRTKAMVMTATLPEFLERLIEETIKPRKLQAPPEEADRFTRHRINVVDGSMESIEELIEELKPEDGPALVACNTVSRAVEVYSRLRDDYSAMLLHSRFTYGDREEKEKKLLSNLNDFDVVVATQVVEVSIDVSFSTIITEPAPLDALIQRFGRVNRRGFGNPRNVYVLTEGGEGDKRIYPPEVVRRSLGLLKELDGKPLPESKVPELVTLAYEPLADRLRGEVLEYKAQALELFEALMPLRSGENERRFYEMFRGLEAIPGAYQDAVLELLTRKRYMEVHRYLVPIPLWLFMSESDAFHRLSSTGPGKHIIVAELEYNQELGLLREPSGGEVL

SEQ ID NO: 11919 - protein, 705 aa, Thermococcus cleftensis
MEWNELVELMKRKMAKPNRSLYEHSTGVERIARELLRRIPHDEALDDCLTRHAFLHDVGKLDDMFQAKLEGKLRRAPPHAYLGIELASRFLDCPEPYRTVALASILTHHSDLHSALYREEIHGGVGLVVDDVPISSPADTAKDVRNWLVAGRLARKYGFTGPEGEVRLRSLYTLFNGLLRVSDWLDSAGLSADSYHLRSGSEVRERVVEYLSSRGFSLRPYQREVLGKGGGYFRLPTGDGKTETSLLATPDDSAKVVYSLPTITTTEAMRKRFEAVFGADRVSFAHGMLFLSLYHRGALEERLLHRYAMRPVFVSTIDQILLAFLNYPRFSVREFALRGAHWIIDEIHAYTPFTLSLILDGIEYALKYLGTKVTVMSATLPAPLKEELEKRGLKELLPEERVASRYSSRRRVRIKVGEGSLFNAVDEICRERGKVLVVANTVGRARRLYEELRKRRDDVYLFHSRFINRDKRRKMELVESIGSGILVATQVVEVSLDIDYDIMYTEVAPIDALIQRLGRVNRRGRKEGVAYIFEPEGSKKHLPYNEKAFDESLNLVGELEGAESELELLRLNDRFYSSIWDEYERELKKRFLWRSRDGLRRITKWSKGEKLLSTRDTFISLPAVPRPYLEKALELASSWEDMTERERLDAAVYVIEHTLNVPIWVLNRARTHSGDLYDRFGVFGIEMDYDPEVGLKEEKTGLIMF

SEQ ID NO: 11920 - protein, 763 aa, Acetomicrobium mobile DSM 13181
MLQSAGTMWSPGFLDGELKSHPERHLKDHLNGTYRLMSDMAQYHGLKSILPDIDIEIAGITHDLGKAHPLFQDYLNGRGDGIDHALPSAWFTLNLSKFHTNEDSFSDIWLAEAVRRHHTYMVDGGEALDFWVQHNKQAFKEQKDAMKKLVPTWNIFLSEEQWEDYAEALMLKRKKILNAQTWLFYRLLYSLLITADRMDAIGVRGLKMHHLPLFKEPDFSGRESSPLDAWRQQTREACIRSVDDIEHPGLFTLTLPTGAGKTITGLDIARRMAHKLGSKTIIYALPFISIVEQNSLVAKGLFGEEDVQEDHSLSTLVETSEKNQDPMTRMKTFFRYWDAPVILTTMVQLWESIYSPKANDTIDFHRLSDAVVIMDEPQTINPRYWHGFGETLQYLSDKLHTSYILMTATQPYIIKGIELSPKGLSFPYNRHTYKILPHKYQLNELPSLLEDHIERLYEKSGLIVLNTRKSAVEVYRMIKNAMGAPVYFLSTWMTPHHRRLTMRLLRYLEKKKIQHYLVSTQVVEAGVDLDFDWVFRDLGPLDSVVQVAGRCNRHSRSERGGLVLVAELMNEQGKSFSNMVYDDILLDSSRSTLRQEDRINIFEENMAPIKVDSYYRDITERLQDKGIWKNLCDGRWGPQDRPNLIDKHYDPLSAEVYVEQNNTVRPMFEKLINTKWTLENLNEKRHLHRKLLQYMIEVPLKALESWRNKLATIAFRDELPPLDFNARFQCWFLTKEGRKHVYDHISGFNLTKDSEDEEGACFL

SEQ ID NO: 11921 - protein, 810 aa, Desulfosporosinus acidiphilus SJ4
MHSKRFIAHIRKVDKREQYVDEHNDHVADLAAAVAHQYGVAKMAKLAGRHHDDGKNTPEFAAYIQAAAEGKRVVRGSVIHSTHGAILVNELVSSKDLYSKLTGEIIRTVIMSHHGLRDCLTLDGDAVFAEAAEKVSDSYEGIKDVIYQHYGADFINNEFIGACRDARSIAEKIRFLQDKSEFLGSQHFYLSMFTRLLTSIVIDADRTDTACFEDNTSLPQIKTPSERKEMWENYLKYYESRLEELQKEKKPSSLDPYRAEISRSCAEFDAGEGGIFRLVVPCGAGKTLAALRYALHTARRYEKQRILYIAPFNSILEQNASEISKFIGNANAVLEHHSNIIFDSDESEDEKRYQSLIENWAQSPVVATTAVQFLNTLFAGKTSCLRRMQALGNSVIILDEIQALPIKVLKLFNAAMNSLASFCKTSVVLCSATQPLLDRLDNYRILQPQSIIENEEKYSESFRRVQITDCMTEQGFSMEETAGFIVMQLDSAKSVLAIVNTKACARKIFKHIRDMVGKETQYRVFHLSTNMCPAHRSNVLQQMRKLLAQNDSNEKIICISTSLIEAGVDVSFERVVRSLTGLDSIVQAAGRCNRNYETACGNVSIINIRDEHAGGLGYLKKAQEATRELLYSMKRSPEHYPGGALSKAAMEEYYARYFKPLLKEMAYPLKFDPEYTMIDLLTNNPSGSKQFKANYAHQKPPLLRQAFSEAGKEFSVIDDDGKLDVCIEYDDDAGKWMQKLRSAATFQEKRLALRHLQPYTVQLRENDWLRKQRSALMPEDVGILVLPSGYYDREYGVDETLNILMEPLII

SEQ ID NO: 11922 - protein, 658 aa, Pyrococcus furiosus COM1; identical to SEQ ID NO: 11540

SEQ ID NO: 11923 - protein, 776 aa, Taylorella equigenitalis ATCC 35865
MNVGSLSEKFAQKLNLGEIGALLGLLHDLGKFSDNFQNYIKYNSFNSDKDDAEINNNIHISRVDHSTCGAQWIKDHFLNSNNNVLLGQILSICIASHHGKGLIDVINNNEKTWFNRLKKSRLETNFQSALSNAVNSNSIALKKAVELKESSFDTFNKHISSLYNSNNLSYIEKKFYLGCLTKFLFSCLIDADRIDSADFESNTSTSDRNIFRNYEWDIALKTLENHLKNFSSESDIQKIRESISNKAFECGSKPKNILKFTVPTGGGKTLSSLRFALKHCLEHKLDRIIYVIPFTSIIDQNAQVVRKVLGDEWVHEHHSNIEPEEVTWKNKLISSNWDKPIIFTTMVQFLDSWFSIGTRGVRHIHPMTNSVIIFDEIQSLPLKCTYLFCNVINWLNLYGNSSIVLSTATQPPLELLEPKENGALKFDNDSEIIGNLNEVDELYDNLSRVNIHFDSVKKDIDKTFSFVKEISNSENKILFIANTKKTVLDLFNKFKENNYSLENIYALTTYQCPSHRKAIINELKEKLRNNEKTVCISTQLIEAGVDISFQTVIRVLAGLDSIAQAAGRCNRNKEQDKGNLYIIDVLENLDKLPEISNAKVSVQAVLHEFNNDLHKILKPDAINKYFKQYYELQRNELIYPIESEQTSMLDLLSANSDCIYRKALDDRLLKQSFRIAAENFKSIDAPTKSVICPYEKGVNLIAILCGEWDPKKFRETLIEAQQFSVALYPSTWKMLLDEGAIHPINDTGIYYLDEKYYDSKLGLNFEGNAQMGEFYI

SEQ ID NO: 11924 - protein, 875 aa, Melioribacter roseus P3M-2
MTETNYKIWAKSPSGDNEKGISLYQHIKDVLDNLDKIKPYINDDKIYELVKLSVLLHDLGKALPYFQIRSVGNKGYEPFEVSANIPHSIFSLFLINKKKLKDLVEELVRQKADEYTQFVLSAVAYHHWRNNFEEVVRYSNRDLDKLLNSDRLQEIEKNLKEDLQDLFNGRIDLIEFNKIMAKEILNGAQIQNYAIPPYNLYWLPMRVSYEEVNLIHWVKIAGFLMRCDHFASFCESENNYDYQIEIPGLEYSLIIERIIAGIQEKLGKGAVINLWQAGLVEKDNLGDKNVILIAPTGSGKTEFAYIWSKGEKTFYTLPLRSAVNQIYDRSIKLFGEDKTGLLHSDADVYLLGDGNESENIDSYSLSRQLSYPFMVSTGDQFFPYALRPPSYERIYATFSYSRLVIDEVQAYDPKAAAIVVKYLEHIYKMGGKFLLVTATMPSFIKEELKSRIKKDNEGSPDFELVDYYKQNDIYAQLKKHKLTFIKEENKEKEYRFSDKLIKDIIAKAKENDGHRVLVVVNTVKLAIDTFNKIKKIIERENDIYIELLHSRLTYEKRREKEKRIEEEFSNPKPENEHKPKIVVATQVVEASLDLDADILFTELAPMDSLVQRMGRVLRRYKNDSPTSLDKPNVFITVFENGVESGGYRVYSDDLIGITMKLLSSDTNELANWCDDKYKKKDWRSAKTIDLFFKTIKKMQANDLLLSEAKKRELVEKLYNKDLFAVSGSYISDFYKTLDILDAGFMAERKEEAHRIFREISSITVIPKILLDDIKNELYDFFSKNDGKKNLYINFKKEILNKYVLNVPFNKWKYDTIRFREDIRLSYWLEFSENNFTGYQLNVLKKWCKNIFIVETEYDDEKGVNSYEFTEYSSFI

SEQ ID NO: 11925 - protein, 425 aa, Encephalitozoon romaleae SJ-2008
MIKVTIYFIFYNTLMRNLAILRSLRDKILKKTSGRRPMARVDIVQDTPQSSETTTSNTKGSQWKWPFLLNRDLMPPYPTDVQRIVIPHILAKESIGVVSKTGSGKTLSYVLPYIHILESEDKRLLVIVPTRELVSQVGQIFRKFSEDSLKVVEITGEMGIDSQRLQVSEPFDVIVSTPGRLKELVKLKSIGGFEYVVIDEADRLMQHDFRNDVTFILEEAGAKVISLFSATPFEWNGVTKISVGDVSVSRSVEEFFLYAEENEKQGILEDIFESCEDWLMKNMNVKTKCLEIKKIVVFCNTIKTCESLHKRFKGSLVLHSRRTMEERKAVVEALEEEKVVLIATDLGGRGIDIRDVDLVINYDLPKTIEVYVHRCGRAGRQKEGMSLSMVCREDKELLPKLKRLIERKGGVVPEFMDIKEDIILD

SEQ ID NO: 11926 - protein, 759 aa, Amycolatopsis mediterranei S699; identical to SEQ ID NO: 11754

SEQ ID NO: 11927 - protein, 844 aa, Lactobacillus helveticus R0052; identical to SEQ ID NO: 11799

SEQ ID NO: 11928 - protein, 655 aa, Clostridium  acidurici 9a
MIAINNYLAKSNPKETIIEHTDKLIKNFDILKEMYPSLQVNWDMLYKVCLYHDLGKMNIKFQDKIEKRKRHDDEIPHGILSLAFIDFEDLEEQGYSEDDIKIIFHSIAYHHDRVLDYTNDQLEEEIESLKSEFFGFKYDKLEFKFINDYIEEQFFIANDRIYSKNENHFLKYIMIKGLLNRLDYAASGHVKVETKNDFLLNDLNEKLLESWKEKDSNSDWNKLQQYMINHREDNIVVVAQTGMGKTEAGLLWIGDNKGFFTLPLKTAINAIYERITDKIVIDNYDEKVGLLHSDMRREYLDRKHEIESDIDEYYNKTRQLSLPLTVCTIDQIFDFVYRYRGFESKLATLSYSKVVIDEVQMYSPDLLAYLVVGLSYIDKIGGKFAILTATLPKLFVDLLEKEKVQFKMPDPFTNKRIRHSLKVENQKLNSEFIKQVYDSNKVLVICNTVKEAQKIYGELKDSLDLENINLFHSGFIKKNRKTKEEQILKFGNKDNEGKGIWVATQVVEASLDIDFDILVTELSDLNGLFQRMGRCYRDRDWNKEGYNCYVFDGGEGKCTGVGAFIDKEIFRLSKKALKNIDGNIDENKKMELIDSVYTTEKLNGTDYYTKLIDAIVYVKSIESFEKSKKETMKMFRNIHSTTVIPKIVYDENKKK

SEQ ID NO: 11929 - protein, 374 aa, Bacillus thuringiensis MC28
MGKVSECAVLVRGIAEKEGEMDVNPLQWKGNLSTGQELAAQGVMEAVKQKESFFIWAVCGAGKTEMLFYGIAEALQKGERVCIATPRTDVVLELAPRLKEVFPNINVAALYGGSLDREKDAALVVATTHQLLRYYRAFHVMIVDEIDAFPYHADQMLQYAVKQAMKEKAACIYLTATPDEEWKRNLRKGKQKGIVVSGRYHRHPLPVPKFCWCGNWKKSLINKRIPQVLLQWLKVYLNKKHPIFLFVPHVRYIEKMSRLLKLLDDRVAGVHAEDPMRKEKVAAFRKGEIPLLVTTTILERGVTVKNLQVAVLGTEEEIFSESALVQIAGRIGRSFEEPYGEVIYFHYGKTEAMVRAKKHIRSMNKNAKEQGLID

SEQ ID NO: 11930 - protein, 696 aa, Candidatus Nitrososphaera gargensis Ga9.2
MYEWSELDQKLSHQGKTLLTHINEVKALGKDLLDFYGLNKEYHEILDYLAEYHDYGKRSNKWSINNDKNPPHSPLSVRYCIDNKCYFKEDTKLTNILWYLIFKHHGSLGDVIRDYNGVKPFIERRIIEKRIKELDFDHRVNLIDTFGLFKVADALSASNLQRFKMELPEVNEGIVKRIIGSVDARWNEQLRLSSLPSFGMLKAYTGWGKTSASLIFFMNKNASKIFYLFPTISAINQFYEKLNKEVGEKARKYFYFYDAYIEEPSSGASEDLDLVGNTLLTEYFLCPYIITTIDQFLLSFLQNGKYYRKRVMFRNAGIVLDEIHLLNPLMLTILVYFLKKYRQVYNLKFLAMSATFSSALKGYLSKELRLGDDCWLNFDEGFRRKRRIMFEYKNDDIEKHLDYVNSLSSKKVLIIANTVEKAVAVARKLDEMKKPYVLLHGRFMYRDRVYKEKKIEELKRNPHVLIATQVCEVSLDVSYDFMMTELSPVPSLIQRFGRVNRYGGRINETNVLIFRPDIKNEKYYPYSQDELKAFNEIEKFQGSALENEKQLIDQYDRIYTYDLLQKGIDRVYKEISFGSFEEILEFFFSLSYSEEELMRIMSYRESFTTLIIPHHECIDPGEKEKIAILRKALGKNMKTLDYGERNMLFREIKSLAVSVPIWWLKGLSVEEKIVCPVINFRDKVYNSTYGFVGRGS

SEQ ID NO: 11931 - protein, 1055 aa, Bifidobacterium asteroides PRL2011
MSGAIPTDLGLDAKAMSLWGKTNLQDENDWQGVFAHLSDSAAVAGYLWRDWVPRGTREIIIRDVGDPELARKVCMFITGAHDIGKATPVFQSKPLTHAPGMQELSLQWKPRQAGLRFPDVPITNTNYPTHPIAGQRILESYLTQVQHWSKSVAESYACIVGGHHGQPPTRQALSKSDEDVRMGTAQGYEDWAEVQRQLIEFVAKQCGLNDDDFAQLSGRRLNIYAESVLEGLVIMADWIASNSDDDLFPLVPLNPPSYDEQTWNRMNSVRTRAGLKARQERGWRNLDLPPKWQPIHEQISTGERFASRFDLPKGANPRPVQEQAAHLAETTKDPGIMVIEAPMGEGKTEAALTCAEILAERTGRGGVCVALPTMATTDAMFSRCKSWIDRLPQPEGRSEKSTSLRHGKAALNREFMSMMTSARGSATSSVFDEDVLQGSGAQKAAYPEAVVNDWLRGRKKGVLANFLICTIDQVLMAALQMKHVSLRQLALANKVIIIDECHAYDTYMREYLKRTLEWLGGFHNPVILLSATLPASLRHELVDAYITGYSSVLGGSGSQTGQLSEVAPRSFASMEAFTDCYSKPRIDQISTPLQPGDEQFSNEEQDSDDLHAYPLITYTSGTTCRTSSVEPSGRAVEIDCQVIDDDLEHLSDLLQERLAEGGCAAVICDTVDRAQQTAAALTNVFGSDQVRLTHSRFIDLDRMDNERELRERLGPDATLDNGGRPHRLIVVGTQVLEQSLDIDFDLMVTDIAPVDLLLQRMGRLHRHRRGHGESDRPAGLRKAFCYLRGIASWNADGPAFPDYVDSVYPPASLLEALAVLRLQGDGTHRLLQLPDDIAPLVRTAYDSDAVAQLIPKAWQERYRLDAHKRAEKDAEEIDKAQVYLMKDSARLLRQSHTLVDLFTSTVDARSEAKARQAVRDTHDSVEVVLLRRCGDEYALLPWIGGDTVPCGASVPTNTEPENQLAQVVLRCSVNLPDRICHDIDALINELEIRAGDCVDAWHQSPWLDGCLPLVLDEEESDSNRQRFVTTVLGYRIGYTREDGLTCVKADKGGES

SEQ ID NO: 11932 - protein, 3137 aa, Sunflower mild mosaic virus
MIWSRQNAAANRGLIYDWEDDVYQCPTCEHTFSTVEQYQEEHSCERAAYENKLIEQEYDEMMEWAKNRKHETAAPPVPITSIQFGSLNFAEAMAAAKTIAKVEFAQVTESHEGRTETGVANSSAVHKENKQQDNSQRLSVGLKVPEHTKLAGSSFRVFNKIEQCSWMDEQPSLVTTITTTIAGGVRPSTLEETRMWPPLIYRKKARKSPPNKLCLSTQSVDHLVKALFKVTKHKEMEFQVIGKKKSHNRVFKFKRFEHRMHTFVHLKHHDGKMHRVDCKLGAYATHILQLMACATSKTHSIKVDNLQPGSSGLVLNHKILRGKVSRQRDGMFIVRGRCDGELLEARSKFSHSVVHRMTHYSDKDISQEFFLALSKTFQQFKENNIGHTCQRDVTVAECGAVAGIVIQALFPSGKITCEKCFLLFDKQLDEATDSRESKRIANALDHLRRDHPRFTHVIKRLSQFEESRQPFNPNINAFTEIQRLIGGRTQAPFTHVNRVNEILLRGTKLSASDIGAAADNLVEVARFLKNRTENIKVGELQTFRNKISAKAFLNATLLCDNQLDKNGNFMWGERGYHAKRFFSNFFEEIDPDQGYDKYVVRRSPNCTRKLAIGNLIMSTNFEILRSKLTGECIGPEGISKMCISTRNDNYMYPCCCVTLDDGKPLLSDLKLPTKRHLVVGNTGDSKFIDLPSDLGEKMYIAKDGYCYLNIFLAMLVNVNEGDAKSFTKFVRDILVEKLGTWPSMMDVATACRMLIVLYPNVYNAEIPRILVDHKTKTMHVLDSYGSLSTGYHILKAGTATQLAEFANGDLESEMKHYAVGGEPSSQNENSMLQRLIKSIFKPRLMQAIIEEEPYMLILSIVSPRVILALNNSGAYERAIQTWITRDQSLTSMAATLATLAKKVSLAESVQLQMILISQYSEELLNTILDGVHVNQSYIVAIHYLTVKAAQYQMDESLHASGFRTTSAATYSLLEKNWESHLEASWRELTLWEKFVFTKSLLRFSRNSNTDLKPKIEVESNATYSTSIRGLLTRRKQRVVGMVSSIHAGFKRRCQEIKGRMATTMINGIRHMIPDFLHLINIMCVFSILVSIYVSIQTVIQQRREDKMKLIEYHKKLINERIERRMDLYYVTEGEGKTHKDFVEYLKKVDPELHEYIHMERKAEEVKLQQSKTDMVRLEKIIAYATLIMMAFDTERSDGLYKILNKFKGIISSTNKESIHLQSLDDTIPGLEDKNLTIDIEIDTDEALNTPLTNTTFRTWWDNQLARNNTKPHYRTEGVFKEFTRSTAAQVANEVMHSTDCDFLIRGAVGSGKSTGLPYHLSKKAAVLVLEPTRPLANNVHKQLQSDPFFLKPTLRMRGKSTFGSTPITIMTTGFALHYFAHNIQDLHNYGVVMFDECHVSDASAIAMRNLLHEYSFDGKVLKVSATPPGREVEFTTQFPVHLKVEDNLSFAEFVRAQGTGSNSDVIQHGDNILVYVASYNEVDTLSKMLTDNKHKVTKIDGRTMKDNNTEIQTYGNSKVKHFIVATNIIENGVTLDIDCVVDFGVKVMPVLDIDNRAVSYVKTNVSYGERIQRLGRVGRHKQGFALRIGTTTKDLPQIPEMIATEAAFFCFMYNLPVTTQSVSLSNLEKCTVRQAKTMSQFELSIFYTIQFVRGDGTMHPAIHTILSKYKLHDSETILNKLAIPNASVSQWLTAEEYARRGYRNSLENMRIAFMIKDIPERVHMDIWEAVVRHKHDAGVGRLTSMQTAKIAYTLQTDIHSIGRSLNIIEQLIANEMKKKAHCEAALSNSCDYRTFSLDSIMGALRARYSSKHTAANIEILERAKNQILEFANLTSDKSVEELLKDYGYMEVIGLQSKREVSRCLKLEGHWNYTMLAKDLLLSGAVAVGGVCMLWSCFRSSMSEEIALQGRKNQKHKLKMRQERDSRVHYEVSADPDSIEHYFGSAYNNKGKKKGTVRGMGHKNRRFVNMYGYDPTDYSFVRFVDPLTGATMDESVYADIGLVQEAIGKARQESIADGELEAQLIVHKPGIRAYYVNDATKKALLVDLTPHRSMRASDKTTTIMGFPERENELRQTGPARVIDIGDVPKLEEEIKLEGVSLSRGVRDYNAISSMVCRVTNDSGSSSTTMYGIGYGCYIITNKHLFRENNGRLLITSHHGEYICKNSASLKLSLVPGRDMLLIRLPKDCPPFPSKLKFREPTSEEKAVLVVTNFQEKHLSSMVSESSCVVQREDSPIWRHWISTKDGHCGAPIVSIRDGYIIGSHCGENPMTSNFFTSIPKDFQNLLNGKEANEWVSGWKYNIDAVCWGGLSVVNDAPSEPFITAKVVSALDTEGIKVQAVESKWMLNALNGNLRPVASCPSQLVTKHVVKGKCPLFDLYLSTHPQAKEYFTPLMGAYKPSRLNREAYIKDIMKYSTPIAIGDVDIAIFNEAFATLVQMLKSKGFEKNVYVTDEVDIFASLNMKSAVGALYKGKKRDFFLDASAEQMETYLRESCKRLYMGRKGVWNGSLKAELRPLEKVEQNKTRTFTAAPIDTLLAAKVCVDDFNNQFYSLNLNAPWTVGMTKFYMGWNTLMEKLPEGWVYCDADGSQFDSSLSPFLINAILKLRLEFMEQWDVGEQMLANLYTEIVYTPISTPDGTVIKKHKGNNSGQPSTVVDNTLMVILAMYYTMEKALVPLDKCVFFVNGDDLLIAIHPDYEAKLDEFQEAFVALGLKYEFDSRTKQKEDLWFMSHKAIKVDGIYIPKLEEERIVSILEWDRSAEPTHRLEAICASMIEAWGYPQLVDEIREFYAWTLEQAPYKQLAENGKAPYIAETALRRLYTCVEATNDELLEYLREMIDQTDGMKYEEIHLQGDKEVNAGNQSENNQKDKKQANAVLQTSPPTPQPKGNASSSIVDTSGNNEIERDVNAGTNGTFNIPRLKRLTKKMQIPKSKGRIVVNLEHLLDYKPEQYDLSNTRATHQQFDRWYAAVKSEYEATDEQMSIILNGLMVWCVENGTSPNINGVWVMMDGDEQVEYPLKPIIENAQPTFRQIMAHFSNLAEAYIELRNQSSPYMPRYGLQRNLTDMSLARFAFDFYELTSKTPVKAREAHMQMKAAAVRNTSTKLFGLDGNVGLAEEDTERHTVHDVNRNMHSLLGMRQ

SEQ ID NO: 11933 - protein, 755 aa, Thermacetogenium phaeum DSM 12270
MSPGEVYSHKGKRLEQHLLETAELAQKIARHFRLELEEGERWALLLHDLAKAHPLFQKHLLQQKGRFGHAAPSAALVLGLTGDLLCTEAVRRHHSSLENLDEAKKFWFCWDYQENACGVIGKIPVWNGAEAVMEALGHQLAKWGELLPAQADWDELIFERVEFFPPDEEKMEEAWLRLRMLYSLLVTADRYNAAVGREMEYHPLRIDQKRVEDFAASLRGRPLAEWRQQVREEVVRKAEEVLKKPGIYTLTLPTGAGKTLVGLELAMLAAERFAATGIIYVLPFISLVEQNADVARVLFKDASPVREDHYLSEVAGEEGDPENSSPQERFLSFFRYWQEPVVITTMAKFWEVLYSPKGNDTMSLHRLSRAVVILDEPQAIPSCYWQGFGKTLNLLSEKLNTTFILMTATQPEIAQGLELAPRPYFFPMIRHRFEWRRERLTVPELLGSPDVISKLLAKSALLVFNTHRSALLAYLELQSRGVTSYFLSGWVTPLDRRATLQQIREDESAGKPARLVSTQVVEAGVDLDFQFVYRDLGPLDSIIQVAGRCNRHGKREQGEVLVCELCDENGRSYAGYVYDSTLLVATKAVLKDSFDERDCPGMVAAYYRKVREITAENPLWEDISSGRWGEFHDLIEKEERGEATLVVAYEGVENDLDLLSRQAAPDEDVMRMVEQKREASRRLGLHAVSVPVKMLEEWLLRVGGMIYGAESGDILRKVSSGIYLVQGEGIGRIYSRRTGFMPPDLEAAGDGVDDW

SEQ ID NO: 11934 - protein, 696 aa, Bacillus thuringiensis Bt407
MGFMHTFKKIFNIHDLNKIKLTEPQSKLVRVMNKKKNIILLSPCGSGKTEASYLLTKRWDRKTTYVLPMKTLATSIQKRLNTYESSLKSGKEWSIQHSSISNDPFLDSYYAVTTIDQVLSGYLGIGRQAFIRGKNVLKSNFIFDEIQLLETNKTLKTLFGMLDSIHENGNQFMIMTATMPTYLMEFMSHRYNAEIIEVENPVIENRQVKVFYEESLDCTSIESLKEKQIIICNTQKEQIELYTQIQDKSRVILLNNKLQQKDREQVEADVFKYFGKGSLSNDKILISTQIIEAGMDISAPTVYSSLCSIDSLIQREGRVARWGGNGCLTVFNGHYQGIYDEEVVLATKDKLLANQGICFSWLLQKQWVNEIMNSYYEKSITDRSLQKHKRAMKNGSRNDLIRAIQNVNLIVDNEVNQDSFLKESISISLSSLQKLAKSNTLYRLSNGTSGSIEEIQPHSVRIGDSLVIQGLNSFYDACGFRIEDGVSCLSFAESQEKVENRKYEDYIEESWITHSKEIREVMKTTLIRDGVIRKVDKIQRYSLIAGMHDLGKLTTAWQKYIGYEDIPLAHMPFQPRKIGLIRGVKHNIVSALSVKPNVNKLEFNLILQHHGRFMPSGSIHRVNSYQLIKETPCLLRELGWTEKVITKADSGEIVDANLLTPGDDDWPLFVYLLGTLMQSDIQSIKNVKNRMIHLFE

SEQ ID NO: 11935 - protein, 969 aa, Gluconobacter oxydans H24
MGAMSRTTMRHKATSSSFRTRFATHTPSETDPGRANRNKPAKRVTASTALEQWEKTEFPDLASQETIPSDELGWEHNGMDLTDLAQFWAKTDTQAAAECPMHPVVAHSLDVAAVAMSLPETMLPQIDNDPIDRRLLGFLASLHDIGKLGATFQFLRPDLWPTALGATPAALPPGPRHDAAGLQILGQLSTHPVLKILFPDWSLSEKLRVLAGVAGHHGKPISRAYQRPANLTSLDENTLNAARIFLDVMASLFQPPSFPEDFSEDAMDALAWRLAECLPVADWIGSNRTWFPYATPHTLTDPADYFWNKALPQAQKAIFQAGLGPVRTRPFQSAKDLLPHLETQALSPLQRWAETTSLPDGPALIVIEEMTGSGKTEAALILSHRLIARGHANGVFLALPTMATANAMFDRVAAAYGKMFHPADRPSLALAHGKARLSERFTQTILSEKSLSSFAGIRKQPGESACMEWLASENRRALLAQVGVGTIDQALLAVLPVRYTTIRRQGLTGKILCIDEAHTFDAYMNEEMKELLTLHASRGGSVILLSATLSHALRTALVNAFRKGLNLPATTLQDTHYPLTTLVSGTDAPVETPCEPRPGLGRTVRLNRLSDVGEAETRVIELAETGSAIAWIRNTVDEAIASAESLRAKGLKVQLFHARFAMVDRLEIEQDILRKFGKHSSPDQRAGVLVSSQILEQSLDLDFDSVITDLAPADLLIQRAGRLWRHHREDRPVDYPQLDILSPSPVSDPDANWIRRVLPGTAAVYRDPSLLWRTARALFARNVLRTPEDVRSIIEEVADTTSPGSVPAALEKEMLTTQGKNLSAQGLGRQTVLKTGEPYDPGTGQWDTDLQARTRLETDPTVIVRLALLKDGVIHPYAEDVDPSQAWALSEIRVARRRLKSCPPPEGLQTAIETIRASWSRWERDAVEDILVLVLFESVDGGFEGRGLDKDDNALMLQYHKATGLMFPA

SEQ ID NO: 11936 - protein, 812 aa, Synechococcus sp. PCC 6312
MKRLLAKSYDHKKYNEPPPYSLLTQHSRDVASACKSLAQISGSIALRNAEIESELVDFERILRATGWLEDLGKASSHFLEMLTNNDGLQLIRHETISGLLACLEPQFQSWLEPLGKYRIVAIWGAMGHHRKFDERTEPNQVQRLILHISQSDNLDFNAILEEMSLDLGLGNPPQFERNLVIGYDLDDECDIPALESLNDLMDQFEKYEKKEFANEQSRRFVALVKGYGIAADVAASAVAKKEGEDNQPYSLSDFVNNDLSIKLSPKDLTQLIHSWAWRNSQFKDKPDLSQYPPGFTLRDFQENVAASKSYLTLAVAGCGSGKSLAAYLWARDWCEKLTDRNFRLFFCLPTTGTTTEHFKDYALESGIPESLIALAHSRSSIDLQTMAQTSPQEDAESSDTAKAAQETLRAEQDKIESLALWSTPLTVTTADTVLGLMVNARRSIYSLPAIMQSAIVFDEIHAFDDQMFGHLLVFLKNFPKLPVLLMTASLSEERLRAIEGIRPDLNRVPGLEEFEILPRYDLPYTVEQVNEEIVWREVQKCLENKGKVLWVRNRVDWANQIYQKAQDDFPDIAVNIYHSRLRYKDRSERHRRVIDTFKEEGKAALLVSTQVAEMSLDLSADLLVTDIAPVPALIQRMGRLNRRATLDNPGNPKSALICPLPNIKGDAYKPYEKSDIDTSLIWIQKLLDLNKSLCQRDLADKFLEVSDPKEYDYEKAEKRACFFSGVWRTRPGITRGEGYTISIVLEEDFKKCNDFKYGQPSPNWIRKHEVAIPMRPEVLKWERIAGVRIAPKEFVAYDYNETTKEGTGASWK

SEQ ID NO: 11937 - protein, 740 aa, Pseudanabaena sp. PCC 7367
MQKLQYVAHTPNKLGEWHSLQEHLSDVAIKAQGYAAKIGCDELGYYAGLWHDLGKYHPKFQQYLECCHLATENGRSSSCKKFPHAIYGACLAREYLQPLAPIIWGHHAGLPDKDKLTNDLSKENHAVQNEYRAVLQHVPETLLQVRSIQKSKQAMQGLAKDSTEMLIRMLFSCLVDADYLDTEEHFDPDAPKLRGGYKTVNLLWKIFQADQQQLFDRVKGIDSKVNQIRSEVYLACVEAAAQMPGVFRLAVPTGGGKTRSGLAFALKHAMIHNLDRVIVAVPYTSIIEQTVNVYRNILGEADVLEHHSAAKEPDDEDARQSYAKARLATQNWDASLVVTTTVQLFESLFANRPSRCRKLHNLVGSVIVLDEVQTLPMFLLTPILSGLKELVDRYRVTVVLCTATQPALEGESRYLEGFTAGSVRDIVSSALAKQHFAGLARVNYEIKEQTWSWEQLVADIKEHNHDRALIILNTRKDALAVLDTLQNDDEIDADSLLHLSTLLCGEHRRQVLNQVRNRLDRHQPCLLVSTQVVEAGVDLDFPAVYRAIGPLDRIVQAAGRCNREGKMPEKGRVVVFEPEQGSKPKGDYETAAKRAEGILKSPELDLHNPDTFETYFKVLYKDVKLDQLDIQKKRTNFNYPEVAKNFKFIKDDTTPVVIQFDDRVRKHLKQIQRRDLNSGDYRKLQPYLVNLRQNDFKGTEALREEIAPGLWVWERLSYDELKGIKIGDRSIDFDPADLVQ

SEQ ID NO: 11938 - protein, 893 aa, Chroococcidiopsis thermalis PCC 7203
MSKAHRQYSFKFGRVFFPGEAQPIPSEIRFQPLGNHVGNVMALVKKWSKRDFPSESSFARVLEAAKIHDIGKPQRFEIQAKITKMSKFKEYTYSFRGHRYLAKCDKDAWAEALAIGHHDFSVEDICSQAYKLKKEQKYADILTKEPLAYARELYILEMCDQIEAELACRVFGDGNQADSRAFMDFTIAPDELDDTKYFIEPWIFEDLQPIELTFKSWVMQSNEIDKDGELKKCIQDGREEAIGKILDRIVKTWWQFHQGNSQESITKTITIQPYNSSIQAKIWTVEDFYQKLGGFQPNPMQKEMFEKIYNSHEDQHPAILLKSSTGSGKFESILFPALASSYRLILPLPARSLLEDQKQRTEDYLKKFSKLHPNREFSLVVDTGAQMYRQIYKNGEERKFRTSNSRRHLYKGDVILTTIDKFLYRYFAFGDKQKSFIFPLRINQEKTLICFDEAHSYDEISFTNFNSLVKSLYEAGRSIMLMTATMPSEYLKRFDYLEQIDYIEDSEKYHALQEFQEQTLKQDYPNKKSFEWINSIKRDSEHPEAYQNEYTQIILREWQTESQQKLIVVVERVQDAVEIYQKVKSDLNFSDRSSERFLFLYHGRIADQLRPNIYAEIQKRDSSNQPYLLITTSAIEVGCDLNAKVLISEICPPENLIQRAGRCNRKGNIHNAKVIAIGNSIPEFSNSLDENGWQIYQKTLESLSEFNAQKISECISVSEQVDDYRVIELFSMLHDYVYEADLTCKHAHEKGLIVTRSWTPSATLIYKDGCENPHKITVPVDRLIKNDENDFANTYVLERYYDRETTRFDERELGWGCAYSKDIVIEIHKNQEGAEIYDGKREYSYNPELGFVELPGIFIKLRSTNCDEKLLCKHTDRKSAIITYTKALKTKSD

SEQ ID NO: 11939 - protein, 728 aa, Chamaesiphon minutus PCC 6605
MLLPLNFVAHTPPPNDSQKWHDLKKHLTDVANGTAGFADKLGAQRLGYYAGLWHDLGKYNPEFKKYLIACAQGDKNARSIPHAVHGAILAAELIPPLALLIYGHHGGLPQKAQGIDRIGNPEHQPTYRLILEQAKTAGIDLSPKSDWESEISNFKNPFHYELFLRLLFSCLVDADFLDTEEHFSPELTAQRQQPETVQRLWTVLEKHQTDLIAKAPDKLVNRVRAEVYQACSDKAKLPPGVFSLAVPTGGGKTLSGLAFALKHAAKHGQDRVIVAVPYTSIIEQTVNVYRKIFGEAAVLEHHSAAKTTVDDEDARSQAAQARLATQNWDAPLIVTTTVQLFESLFHNRTSRCRKLHNIINSVIILDEVQTLPIGLLAPILNVLQELAARYNVTVVLCTATQPALEGNSRYLEGFERVEDIIEPEQAQEHFRQLSRVNYELPDEPWSWAQVVEDVQIHQHEQALLILNTRKDALELLAALPQDEPEQLFHLSTLLCGAHRRKVLEAVRSRLKQNLPCWLVSTQVVEAGVDLDFPSVYRALGPLDRIVQAAGRCNREGNSTTGRVVVFQPENGRTPPGDYATAVAETANLLRKQPNFDDPEIFRPYFGHLYQGTNTDKYKVQEARERFDYPETAQRFKLIPDDTQPVVIEYDETARKLIRQIERQGLKSRHHRALQPYLVNLRDREFKQGLEVRREIAPGIWVWEGGYDEVRGISLGGSAIVRDPYDLIV

SEQ ID NO: 11940 - protein, 716 aa, Chamaesiphon minutus PCC 6605
MTFTPLARPNQPLLPHLLGVGHHTSRLCSSQSDWARLIGLLHDYGKYRPEWVEGINAIANGENRDRLPHHAVEGALYLIELFPDRSHFKVRALALLIAAHHGGLGDLKPSMDWLAGKDSARPLPDMDRCQWKIDDKYLVEVKKTIAAVNYSDLDNWMPNQDYRTAQRLRFLYGALIAADRQDAAMSDGWKPAAYSSMTILADKLATWYEGKFSQPKNPLDILRGDFYVECRKAAKLEPGWLSVRGPCGISKTWSVMQMALDHAAEWDKQKVIYCVPWTAILGQSYSQYQDVLGADNVLGHWSTLVDPDTKYPEQLRNSRQWWETPVIATTMVQLFDVLLGSRARTAQRMPSLQNAVIVLDEVQGLPNELLITCIRVLDQLVQDHGVTIILSTATMPDYAPLGINPIEALPQAKVDEYFAGTKRVEYRWAEEPLTWETVAAEIVQSQKSSTLIVTNTVAACDDVYTAMQSLPNYRVYKYTASMSPAHRGVVLAEIKAAVDEAKEGGNPVIICATSAIETGVDLDCTQGYRELSGLESIVQFAGRINRNKKDSESPVTIFKTAKDYPVPPGSDRRTTRTLQAMAMGTDLQSPDVLTLYSKLLLQDAISSQQNPNVYNYLEGLKKLEWDTVSQKWQMISPTTPVLVNPLRWGASSSILAEYDEAMSKANYRVLQRHCVGLYKGKYQKAKDTQCVSDSQIKGLGEWVGTYDMGVVINANP

SEQ ID NO: 11941 - protein, 796 aa, Gloeocapsa sp. PCC 7428
MSKIPEKLLAKSKPQVTLEAHLRDTEKAAELIFRLTGRWGRNWCRFFGIEGEESQKKFLLNLRIAALFHDIGKANEDFYEAVKALGFKPQTLRHEHLSALVLCLPEVRIWLAQNSSLDIDVVTSAVLSHHLKASESQITIKGDREASQTLKNYRWCQPQSSKTSVVLYFQHGEVLRILNRIAEVAELGAIPSVPQIDWKPGSLWELAYRQGKQFGTNFKRELGDVKNQPRKSLLVAVKAGLIVADAAASGLVREGKDIEDWIEEVVHSESITHDDIANAIINPRIEQIKAKTGSFKLATFQKQIAKQGSKALLLAACGAGKTLGAWKWAEQQSREYEIGKVIFLYPTRGTATEGFRDYVGWSPATDAALVTGTARYELEAMQENPTEAIEGKDFQADERLYALGFWSRRYFSATVDQFLSFLEHSYQSICLLPVLADSAVIIDEVHSFDRRMFDSLVSFLENFDIPVLCMTATLPPSRRERLKKAGLTVYPTTADRDLLPDLEEKESHPRYYLEPVDKFAAAFEKAVTAYQQGKRVLWVVNTVDRCLAIAQKLNAINTQVLTYHSRFRLQDRQKVHAKTVAAFALQKDPDARKPAIAVTTQVCEMSLDLDADVLITEIAPIPSLVQRFGRANRHLARGLDFQAKLHTYTPPNHLPYQKDELEDAKQFLQSLSHKTVSQRQFAEALEHYSPPEREADGSAQFLESGYYAIPSNFRDTDDFSVPCILDQDLDTVKAILDSPAKHQKERFIINVPKKWANSKDSYPSWLPKYLSVATWEGHYNEDSGFITKSLEEVELG

SEQ ID NO: 11942 - protein, 760 aa, Stanieria cyanosphaera PCC 7437
MKQAPVLKPDLLLAKSFEPGKWKGSYSLVGHTADVVNAVSTLVDVLGDRLISQFGLQCNLSELKSTACLAAYLHDWGKANEHFQGVVRANIKDAHPKRFLPDHPQIIRHEVASVLLAWEFREWLEQGEGDFLTALAAAGGHHLKLGGRSGKCTDELGEIRFSGDDRLFLYVLDVVDGKQQFNRHFKQLLKYGIKALGLPNNIKLSQKPSLSWSVKQIKEKRFQIADFLSLEWQPDSVFLAVIKSLLIAGDAIGSAIPNVNESISIKNWITENVQNTLDETKLQRVIDARLDAHQLRPFQIQLAQSKTRVTLARAGCGTGKTLGAYNWAKSFAIGRKLIFCYPTTGTSTEGFLDYVHDQLDSVLLHSRADVDLAMATTGEEEEAGEGNNESAIKLESFKAWGKESIVCTVDTVLGLLQCNRRPMYCFPAIANAAFVFDEVHCYDDRLFGALLRFLEVFKAPILLMSASFLPWQKEAITKAVGEPIEIISGSKEIEAQPRYRFNYEAQPDWSIVEHELSTGGKVLWVCNQVNTAIDVYKDAKARRLNAVLYHSRYRYQDRVQHHRDVVDGFKQDEPILAIATQVAEMSLDLSATLLVSQIADPAGLIQRLGRLNRRYCGHALDALFYPDDKVGFPYSKEELENGLRLIQSFEDEVCQRDLAQWLEDSDTFGQPDTKSVLLDGNWRTYPTSLGKEGFNITVLLEQDLATIKSLPAKEIPRYTIPIPAKNYQKWQKHKFYPIAPTEIWSYSPELGAYELKSREN

SEQ ID NO: 11943 - protein, 769 aa, Cyanobacterium stanieri PCC 7202
MSPKLLAKNKSNNKELTLEQHLQDTETACLAIFRGRILNNWCRFFKVTDKNVFLLLLRIACLFHDIGKANPEFIQLVLGGKKFKQTFRHEWISAFILHCPNVKEWFRQSNLDLDLEIITASVLGHHLQATPKQQHKIDAFGKPRNMVKELPLYLDHPQVTNTLEKIATLANLKGLPTLPQKWIDGSAFWDNIYSDIQDTAEDFEYEISKDAQRQSLLLAVKAGLIASDSVASGIYRTQTSSAIEKWVNQTLHTYPITVEEIEEKILQPRYRQIEKDTGKSFELKDFQKEAINLNSRLLLLSACGSGKTIFAYNWAKGVTDSYKIGRVIFLYPTRGTATEGFKDYVSWAPETEASLLTGTANYELRGMTENPTESTKGKDFTTQERLYALGFWQKRFFSATVDQFLSFLTHNYGAICLLPILADSVLIIDEIHSFSRSMFDNFVSFLQHFDIPVLCMTATLPTSRHEELTRILDKHKSGLKVYPSPNNRSQLEDLEQAETLPRYQISQSNFDEAKQKTIIAYQEEKRILWVVNTVDRCREISTQLGEILETDILTYHSRFRLKDRKKRHEETVNAFKQTEKAVIAVTTQVCEMSLDLDAQVLITELAPISALVQRFGRSNRHGKFAHSEILIYEPSQPLPYTKEELEISRQFLHDIVSPLPVSQRLLADKLQEYSLRERFSDGSSHFITGGYWATTQPFRESDDYSFSGILDKDINEYLQLMEDKNPDAESLILPISRKYIIEDFHRPAKLPKYLQIASHENYCEKRGLG

SEQ ID NO: 11944 - protein, 910 aa, Cyanobacterium aponinum PCC 10605
MSKLLTKKRKYPYNFGRVFFPDSQVIPEKILFQPLGNHVGNVVKLVKLWDKKDFPDQSSLERVIEASKIHDMAKPQTFSLQVETNKKEKFKKYIYSFKGHRFKAQHDDLWIETLAQGHHNFSTDCVTNDAYKLRKYKNYQDILNKDSLAYAKELYILEMCDQIEAELACLLKDKTQGEERTFMEYTIKIDENNPNIYRIDPFPFSDDLEYIELTFKYWVFTLLAENKEKLQQLIDKNEENKLGKTLDEIVKDWWEKVEAKPQEEELITIQLKPYQSLNCEYHKDCDYWYQNLTKFQTPNPMQREVFTAITNNEDIAVLLKAPTGVGKLEAVLIPTLALGYRLILPLPTRSLLEDHQERIENYLKKLSKLYPQKEFSLVVDTGSQMYRYIYFNGEKVPSRVKNPRRHLYKGDVILTTLDKFMYRYFGYGDKQKSFIFPLRINDNQNKTIICFDEAHSYDNLAFTNFCNLVKALYETGRNLVLMTATLPKNQIPRFDYLQEGLIDYIDNIDNKEKLDQFLEKNLKQPYPNEKILLWKSEVAIQASPEGKESNNFQQEFINLILNEWQSQENHRLITVVEKVKDAVEIYKQVKEELGTNLDDEGRFLFLYHGRISDTPKDKTHENYQYSRSGVYQQIKQRDNDQKPYLIITTSAIEVGCDLNCQTLITQLCPPENLIQRAGRCNRKGNIANAKVIIIGDSIPDFLNTLTDSELQLYQEKLRSHHSQNFNANEIMKCVSQTQQVDDYRVVELFSQLQEYVYEANLTCKPTHEKGLVITRSWIPSATLIYEDAQITVPLDRLIVKKDQETDKTNQYANVTVEESYYDQETTQWKTRTLRWGNAYQKNIIIKINKSQDGIVFDAGFHEYDYNAEFGFVDLPGVFVKWKPKNFEQQLAYKDGDKTIAVINYITPNND

SEQ ID NO: 11945 - protein, 688 aa, Natronobacterium gregoryi SP2
MSKQVQQVDTIFCHETGDDYLTIVERDGERLFRAKLGLSETSAGPRPAKFRLKQGSTEEPRQPDEFVELARRAKRIRISEQTSQSAREELMEMFSGYQLENKAKAVRTCRYCASAGRYSPITTETAVKDDQDWICQDCARQELERQLTYSSGGEVTGTAKERLEELMLEVQDLQRIVNLLQGQLDPDLTKFDTISATTDEVDPVRVDSLNLHPGLQNLLEDRFETLLPVQSLSVENGLFDGDDQLVVSATATGKTLVGEMAGINRVLNGKGTMLFLVPLVALANQKYEDFTEEYGHLVDVSIRVGASRIADEGERFDPNADVIVGTYEGIDHALRTGKEMGDIGTVVIDEVHTLKEEGRGHRLDGLISRLKYACEQRAKRRDDYGGAQWVYLSATVGNPEQLTSALESTLIEFEERPVPIERHVTFASGQEKVRIENKLVRREFDTESSKGYRGQTIIFTNSRRRCHEISRKLEYSAAPYHAGLDYKRRKKVERQFGDQELSAVVTTAALAAGVDFPASQVIFDSLAMGIEWLSVQEFHQMLGRAGRPDYHDKGTVYVLVEPDCTYHNSMEGTEDEIAFKLLKGEMEPVMTEYDETAAIEETLANVTVGGKAAKSLNDRMLGEIPTKHAVGKLLQYDFIDGFEPTPLGRVVTEHFLDPDEAFVLLDGIRKDAHPYELVTDIELRDTDL

SEQ ID NO: 11946 - protein, 875 aa, Natronobacterium gregoryi SP2
MPTRYSHPPEGGHDGVLLRDHLEDVAQRVGYVVPDDARTPNDDPLRDIVETLAYVHDFGKATTYFQEYLLKGVDPDDSYCRYHAPIGSFAAYYALEAKGYDDETCLAGFVAVAKHHGRLPDIAEYVYERTHRREKIATEQDAEKQQTAVAKQISDINDHVLEFAGNVFDAATDGDGSWEEFCHRFAGNLLEDIKATVATEGYSEGIDRESLSNSCYALVLECWGSLVFADKTSAAAAATDTEPSAATYEAVRPTADSLDDHVRSLEEQASADPDGTRAERLNHYRSEARTDVLESAASFADDGGGVATLTLPTGMGKTLSGLSAAMEIRDRRDGDRVVYALPFTSIIDQVVDELEDIYEVDTTGRLLTAHHHLSETTIRDEDAEDNDDAQADDADRNDDVAGMLGESWRAGLTVTTFVQLFESLAGPSNKQSMKLPALRNSVVVLDEPQSLPLDWWKLVPRLVELLTEQYDATVIAMTATQPQLFEDATELVDDPETYFDATERVTYELDPSAERYLDDQTEPKGYDDAAATLLESTADDESALAVCNTIDSARTLTERVTDRLPESTDVAEVYAEKLEHAGDVEDVDPKCVAERVADAGGRSVLHLSTRLRPCDRLRLIETAKALTQRDQQLLTISTQLVEAGVDISFDRVYRDLAPIDSIVQAAGRCNRSFERDRGRVVVWWLETPAEQEKTPAEAVYNRGTKLLPTTAKTLDAVRSGATISETTVARNAVTRYYDRLHDEKDVGADAYPTYVDEANGRKLAELSLIDKRLAIDVIVCRTAADRRKVNEIRDALNRYDFDAVDSLMRELRPKQISVPVYRSDSKEAQKLAELDTVHGESDIRWVDTTKPHYNGFFDEMTGFVVPDNTAERRLL

SEQ ID NO: 11947 - protein, 750 aa, Singulisphaera acidiphila DSM 18658
MTKSILLAKSDGFGRSRQSIREHTELVMKSGKRLVEVTGATQLVAVGLDPLHWLDRFRREIKITALLHDLGKANDHFQEMLIGRATRGQGLRHEAVSFLIARQPEVREWLQSVIDNNRAVELVLWAIAGHHRKFPPSAPPKDCKPEMTVYLSHPDFHDTLALGTRELSLPEPPRFGSDRKLKLISINSSLREFEDAQEDAEIFFKTASDDEKKYVSVLKACLICADVAGSIGRRGSEPMDKWISDAFLNLPQPQQLESVVGKGLKGGELRPFQIQVAEATNRVVFVQAGCGSGKTSAAYLWAAQQAPGKRLFFCYPTTGTATEGFRDYLIDPSLDAELIHGRAEVDMKILGLGDDEPGREAGTKNRQGKASEDSAGALEQWSTPLVSCTVDTVLGLVQNHRRSIYAWPSIAGAALVFDEIHSYDDNLFSALVRFLTDVRGVRCLLMTASLPQPRLQAIREALQGIGETLGGPIDGPEDLQLLKRYRREYSDSPWDRVEDVLSKGKKVLWVVNTVAEAMSLAEHPRAQKLGPTLYHSRFRYVDRVERHKAVISAFANQNTPAFAITTQVAEMSLDLSADLLITHLAPIPSLIQRLGRLNRRARPDRNDGIRPFIIIEPNSHLPYTQEQLQEARAWLALLGNEELSQADLAAHWIAQPVASSDRANHFAWLDGGFATETRHLRDASPGIDVILQRDRVAVESKQSRPEEVRIPMPPPRTGLNWRAWDEVAFCKIPPDDMIIYEEMKGAKWKP

SEQ ID NO: 11948 - protein, 702 aa, Thermobacillus composti KWC4
MKGYLYAFAEGGRWSACVTISREVDLAYRLDDDFRRAAEAEAGCDGEGAARRPGGRADVVLLLDEPLPLGSAFAAAELFARRAGRVQGEAGAARLLRACVREAEPRSGWPGLAGLNRSFGREQPAGDVRRIAAVRFGRASGEREARALAAAAREAAAALEGRALLRSEAHALLGAAGPAPARWSAAFADAALQLAALLGRLRLGSAIARCDGVRGRRRKRRCLRCGSGEAHMRRTPCAACGRVCAYCEACLLLGRCRECTLLISGIPEGGTSVRMRTADELPPIPARLERWGLSPAQSDAAAAALRWLESADGDAHRSISGQPKHKAARMASRFGIAGTLTRKRTANPVHTSGMERPPFLLWAVTGAGKTEMMFTLIDSVLARGGKAMVATPRRDVVLELEPRIRKAFPEHAVVALHGASREKWTNADITLATTHQAIRFSAGFELVVIDELDAFPYHNNPMLQYAAAKCVMPGGHRVLLSATPPAQLRRAAARGRLPHARIPVRFHGFPLPVPVEIRVPPVREMIRRRSVPDKLRKAIAASLSRGAQVFVFVPRISDTGPAATLLGTICPPDAVIGYTSSQDEQRTETVMRFRRRELRVLVTTTILERGVTIPRSDVFVLDADAPLFDEASLEQMAGRAGRSKDDPHGRVYFCAPHATRAQRAAIRQIREMNALAAARGYIRKETLAAVGKQEARAGGMMH

SEQ ID NO: 11949 - protein, 796 aa, Thermobacillus composti KWC4
MPGLIPFKDCIARPDDGDRRYPLADHLRDTSRLLAEGCTDSVISILFRLAGLCHDIYKAHPDWQTYVNSRGAIQKGPAHAAAGAFLFSWLAYQWLENTGKWRVYRLSWLRMATDIADHHGELGSLMQGNRLAWIKQYEWERLDLDGIRQFLNQEMPELQGVPLLPPSIRDWINVANDAVQDMQFDDLDPEETGGSPLELMQLLQDWRWTTTRFIAADRFSIQSMPPGYWTSDEINSAVRTLERLLVDQQHGTMQELRTRLQAEALTRYQDCGSPDMTTVSLPTGYGKTLLALRLALNMVLNENRRKVIYVAPYLSLLEQAAMDVLHWYGFAPLEHHSLAIHQDIPGSDLEESGHGTGFSTRIMESWSHPVVCTSFQQFCRALFPARAQHTLRRAFLEDSVIIIDEPQIFRPEGWNLFLTGLEALKKRYRLKIIFLSATMPPMRYGLASTPVELCPNPPANLNRYRLECSAEPCDQKRLAELLAERRELTRGAILNTVRDAQLVYQKLMELDKNVTGDVLLLHGGMIPLHKKVQIAKMLHQLKDLSRLTVVATQIIEAGVNVSFQFLFRAAAILPSIVQAAGRVNRHAESDQGIVLVRPFLRDGEKDTRSWIYKQPYLRQMTDELLYAKPIRKESELRMLLIEYFERMFNHNSYQACLQRIEDAYAGNWPALGSFEPFENDALRLPLFIPWEAPEAFGRFVPDHYRYLMRLFSLNNATQIYDRYEDRKWMRSLSYEERKNFMILFHYHVVNIPGRLAVKLADSGSYLQHRIPCLFGAWEYHDETGIASVDDIELQFY

SEQ ID NO: 11950 - protein, 762 aa, Thermobacillus composti KWC4
MRFIARINSNGEEQPLIVHLLGTADKARTFAQSFHAGELAYAAGLHHDLGKFKLKPQLRIRNYPIKATHSTAGALEIGKDSTWRAMFGPTRLHKHLATLVQFAIAFHHGGLRNYGNKDEPGSLCHRLASAAEDPEEQEHLWEAAWQEIERPSLPIPMDGPLVRNLLRQQSKEAYSWKLAFLGRMIYSCLVDADTIDTRDFCDPASAQAIAAPGTTIRELHDRLEQYLAVRFANAEPTIVNRYRKAILERCKSRAQLPPQLFSLSVPTGGGKTFSSLAFALAHAKENDLRRVIYVIPLTSITEQNAAEFRNALGPEVVLEHHSHFHIGDLDETLGETESLRYKLSTENWDAPLVVTTSVQFFESLFASRRSKCRKLHNIAKSVIVIDEAQSLPRGYLEPCLRALEELVEGYGCSVVLCTATHPSWEKLGRRVKEIMDEPTPSELERVFKRTAVELRGKPYEPVRDSTLAEWLLDEHQALCIVNTRRHAKKLLKHFNPKVDGLFHLSGRMTPLHRAEVLDEIRKRLKDGKRCIVISTQLIEAGVDVDFPVVYRAIAGIDSIAQAAGRCNREGKLETGRVIVFHPEPHGLPSIGWLKETAVEATNCIDLYGAENMLSLACISEYFERIHGTRDNEAGPKLRDQYEIVKMMTRTPPHFPYQDIAERFKFIESDMESIVVPWRRPADRSDPNHPQDEHARELIDSLTTALYPAAVLRKLQPYVVQVYPKEREVLQHRQLIQTIQGVHVLNDFTFYDRMTGLTIPDED

SEQ ID NO: 11951 - protein, 714 aa, Methanoregula formicica SMSP
MASVFSTLHESLRQVLSQRLGWFELREVQERACVAISGGSDTLVIAPTAGGKSEAALIPVMDAVLKNGQPGVACLYIAPTKALINDQEERFSAFCLPTSLSVMKWHGDVPKGGRSWKGEPPHFLMITPESLEVLLQERELSQDLRQVRFVIVDELHAFVETDRGVHLRVLLDRLDELAGRKIQRIGLSATAGNPQEILSWLSDGRQGQKLVEVAPAPREKHFSFIIEPDEDLRTSALVRVVTGRKALVFVNSRSGAEHLMKALSGRVRNLHIHHSSLSPVMRRKAEEAFLSEDGACIVCTSTLELGIDIGDLDVVVQVGPPDTVSSFLQRMGRSGRRGRPAFVVFVLETPCQLLCSCAIIECAIDRRVENLHPPEQPYNVLLQQLFLALQKGRTGWGTLMKTLLARPAFSGIRPTELERLIRHLVDEGFIATDGEMLMPGTEAERVLGRSNWKDLYSVIAGGGEYRAMTPEGEAVGKLDARFVNSHSDGDVTLGGQIWSMVKCDEGHNIVVVVPSVAGGARTFWRGSGEAGFSGLICERAGAIRKERTTRLPLGDPERAILHNALQTIPKEVDGSGLFVRERKRAGRRIVEVYSFHGSRFNRVLALLLVHCLGEKSRVSSGDFLLRVSGAGKQDTIARVIAALEAVRALSPGEIAEILPAPQRDAWKFAGLLSDHLFRKTVLPDYYHITEFKQRLAGMAVTALPPSAPEPGTGE

SEQ ID NO: 11952 - protein, 812 aa, Methanoregula formicica SMSP
MNFFSHRHPDILLKDHLKTVGETERNILLEKRINNLDKQFLSDVAYLIGISHDFGKFTTFFQEYLEKKRRSEGLTHHGLISALFTYEVLSEFIRIRKYENHALFKYIPFFGYIIVKHHHGNLDAIEKDVNSEQLLREFSNIREQLSDVRRNDPDIKEIYSVLFLSTDIQVQIIFNNLSHYEKECQSPEILDNVIKHLRKDAYFFKKESSNQAEPLPFLIIQLLYSVLIDSDKKHAGHVEEIRRPTLPSDIVEKYKANPEFQKANSSNINRIRNEIFESVILTIQQSTDKKIFSITAPTGTGKTLTSFSAALKLKNISSTPQRIVYALPFTSIIDQNFKVLEDVLQKTLPDFKTNESPYLLKHHHLAEFKYRYEGENKPVDESLALIESWDSEIIVTTFIQFFYSTIGYENKFLKKFHNIAGSIIILDEVQNIPIKYWRVIGSVLAALSKYFDCTIILLTATQPLLFEKDECTELVKNHEKYFSNADLNRVLLRYDENQKTIEDMISELKISPEKSYLFVLNTIRSSIDFFTQISEKLGYESPSKNPIEYLSTNIIPKERHERISRIKSELDSGQKKIIVTTQLIEAGVDIDVDVVYRDIGPLDSIIQVAGRCNRKKRVTQGEVHILNLVDVKNRPYSKIYDKVLLNIVHQIFKDHPTIEETQFIEIINLYFNKSQEKVVSDEKIMSALFELNYHEKREDVDFEKRVPISEFKLIDDDLPDCDVFIEVDNIASKTWNQYLEIQTIQDTFERKKQFLTIKKEFYEYVISIPSKDAKSIVDTQYGISRIPYSDVEKYYEMKIGFKRGNPVISIFG

SEQ ID NO: 11953 - protein, 728 aa, Methanoregula formicica SMSP
MYYAHSTINPNKSDWQALKKHLKNVADRSQEFANDFHAGNLAYVSGLLHDIGKYSPEFQKRLDGEKNPVDHSTAGSIEATRIFNGKQSAAGLLFAYIVAGHHGGLLNYGSAEGGLCERLRKPVPDYSAYCNEISIDSHTIGPLGLRPSPGKTGFCISFFTRMLYSCLVDADSLDTEQFCNPDKATLRTNYESFDILAKKFDAHMQKIQSGASDSLINRERKKIFSQCIEAGALPPGMFSLTVPTGGGKTLSSMGFALEQVKKNHLKRIFYIIPYTSIIEQNAKVFRDIFGWQNVLEHHSNFDPATVDTDDLDTGGESLRLATENWDMPITVTTNVQFFESLFSNKRSRCRKLHSLAKSVIILDEAQMLPTGYLLPCLAALSELVRNYGATVVICTATQPRLGDLLDENVRPREIMQSPDRLYETFKRVRVTDLGLLSDADLSARLKDHCQILCIVNTRNHAKKLYDAIKDAGNCYHLSARMCPVHRRKKIAEIKKRLKEGLDCRVISTQLIEAGVDIDFPVVYRTMTGIDSVAQAAGRCNREGKLPFGEVFIFKSTESHGKATSWQSFVAEIGEMTLAGSDDPLSFPTVSEYFQRLYHYKSDGGLDEKEILRQLEERAGEFAFPFEEIADEFQIIEEGTKDVIIPFDEHSRSVIERLRTAEFPWRFVRDLQGYSISIYPNEFREMERMNRIETITDRFYVLRSCEDYSDETGLKLRQGAGYDGSLLIH

SEQ ID NO: 11954 - protein, 733 aa, Aciduliprofundum sp. MAR08-339
MNIRLDVPERKISHISNDGKQKVLSKHIQEIMEVSSEILGKHLGDCEECQRIINILAAMHDVGKLNPEWNIYNKRNPPHSILSAYFYLESGDYDPLIFYLIWRHHGSLKAPQYSPGWIKTNFLRYLKHPDININKSMVVKIYRLVKDDLHRSTRDYYKNVLYSDLFGIFKTADILSAKFQVDLKVLKENLNFDEAIVKARFKEYVKSKGIKFNESKWKCWDNMAENSNILLLAPTGWGKTFASIRIALAHKPSHIIYILPTITAIRKMRESLKQLFEDIDIEENYFFADTEMISKESNNIDETLFTELFVAKSFMAPITITTLDQMLMSFLNVGKYHLKRYHFRNSFLIFDEYHLYPLSGLILLLKILTNFNNKFGYNMKFIFMSATEDVLYTSIIKKHISNIKEYRFLSEYKKLKRYNYKLLNVDILDEKIVKLIEEHFERRKILVIVNCVNKAIKMYLRLRSLPTNVILLHSRFTYEDRRKKENTLESLSKSDKPMILISTQVAEVSLDMSFDYLFTEIAPLTSLIQRFGRVNRYGVYTDNLNVFLATNTEDSCSPYGWDQKEIEKKIKLLKELSKIGIKNEYDLLDHILREQINEEEGLISQINLYFKKWEENTRYIYTVDLWDEDINKILKIRDTHTTLVIPRCLEKVALDILSSDNKIKNTLIKNLLVPVPLRWIGEERDKIHNLETTRIPVFESKKYLYSPTLGYYNSEKISSPSDVETCEDYVFLY

SEQ ID NO: 11955 - protein, 787 aa, Thermoanaerobacterium thermosaccharolyticum M0795
MNTSCFSSLYSHPNKYLEDHLSGSAHLIEKFSDESSTYLLDDKLISRLTKVIALCHDLGKSTRYFQDYLFADDSKKKDMKSMKETHHSLISAVIAFFVIKEEISKHAAYNDVKTLLPFIAYIVVKKHHGNLNDVVTEASLDDSDIDTMKSQLQSIDEKRFSILSDNLVKAGLDVKLDKNTINYYIENIKNELRNVKRYIRRINEKNDLSYYILINYIFSLLIDSDKSEVVIGSDFSRSYVELPSDLVDKYKLQMLYKENKINSLREDAYREVNSSEINFDDRILSINLPTGLGKTLTSISFALRLREKLYKTFNKNYRIIYSLPFLSIIEQNFQEFEKILKGNNINTSTNVLLKHHHLSEMKYTDDDTEFDTDSSKIMIEGWNSEIIVTTFIQLFHTLLSNKNKSLRKFHRIANSIIILDEIQSIPFYYWKLVKEILQAVAFKLNSYVIFVTATQPMIFGNDEIKQLTDKRKYFNQMDRVVIKPVLDKNIHLSELVDMFDLKDGRSYLFILNTIASAKQFYELLKQKLPDEEIVYMSTHIVPFERLERIELIKSKKVKYAVTTQLVEAGVDIDFDVVVRDIAPLDSINQSAGRCNRNWQRSGEVYVVSLVDENDKKYSSRIYDKVMINITEKILSQYGEICEKDFLNIIDRYYTAISENLSSDAAIDILNAVYKLKYDSDDGTPSISKFKLIDDGYYKVDAYIEYNDEAIELWQRYLELKNVKNLFKRRNIFNEFKADFYKYVISIPEKTENMPADVEGFKYVNSDSINEYYDKETGFITKGVLSIW

SEQ ID NO: 11956 - protein, 731 aa, Prevotella dentalis DSM 3688
MSERQRDIAHTRYDDGQWTNQSIEEHCLGVAALASGFAAEFHAAGWGKLCGWWHDIGKYALDFQHHILAASGQDVTIKDPGQVTHAVAGAVYAKEQLFQGGMYLPVAYCICGHHAGLHDYRSSGEANLEHHLTEVHVLDGIRELLGTTQIPLLEQPNIDREALHPMAWHLWIRMLYSCLVDADSLDTEKFMEEEDYEQRGKFASMAELKLRLDIFLQQFKSKESTSINQIRNNIQSLCRESGKGSRGIYTLTVPTGGGKTLSSMVWAMEHAKANKCQRIVIAIPYTSIVIQTANILKSIFGEDNVIEHHSSVDVDEEKNVKWKLATENWDAPIIVTTNVQLFESLYANKRSRCRKLHNIVNSILILDEVQMLPAVNLQPIVDVLRSLQRYFGVSILMTTATQPALSGIIGTGMAKFQGLESTEIVTDKMRLFEQLRRVDISFVKEKYTYNSLAEEICKYERVLCVVNTRRDAKMLFEAVHVKSNVPVVHLSKMMCQQHIMDKLDEVRLKLDHGEPIIVVSTQLIEAGVDIDFPVVYRAMAGLDSIAQAAGRCNREGRLERGQVVVFDFENARLRGQVRKAAEAADDMLQQGMDDFLSPCVTEAYFRDYYSKLDTTDEAKIAELLYVPTPNFATAARNFLLIKESNMTVFVPYGNQGKRYMEQLQHDGPSSWLFRKLQRYSVSIPLWQKEQIVALGAVEMGNDIYYLSDTTGYSKETGLFYDNPYLDDTIIL

SEQ ID NO: 11957 - protein, 780 aa, Halobacteroides halobius DSM 5150
MIDITKYYSKIKEGFEPFKYQREVAEAILNGENVILQAPTGAGKTLASTMPYIIANEEGMNFPKKLIYSTPRRTLVNSLYSDILDEIKKGDFTKEYDVTIQTGEKKEDRYFNGDIIFTTFDQSLSSALSMPISLSNRLGNINVGAFLSSYLIFDEFHLFDLSGSYTTTVLLLEKLKDKVPFCVMTATISEEKINALADKLDARVIRADSSEYLADIVTQQGKERRIFTKDNSLDAEEIVKLHNQIEGQSKKSIVMCNRVENAQQIYEDINKLVNKEDGIETLLIHSRFLDEDRKRKEKQIKKLFAKDNDDSNVILVSTQVIEVGIDITSDIMHTEISAIDSFLQRIGRCARYRNQTGKVYVYDVLNEGDNKYLPYDDEVTLKTFSALQEIDGEVLTSELSQQIIDRVYSEETDVDAVANEKVDCSSDEFIKESWKLPDKDRFNNLIRNVIACSIVISPWVYDNCSPYNYQSLSISPGTLRSKVAEIAKETDDWLVKKVIERDDDSDFKYTYGETTADEIYPNNLYILNPDYFGYNLETGLVFDGTGKKFDPLPISNQEPDYDNTYKEESYLQHIESMNKEVPELEREMSYAIELIKDEFDLSADDFRDIVEFTIWAHDLGKLQEEWQLAHKRDEYDFIAHAERKSKPPSHAAESFWIVLELLEDFIFDYLENEGKIVDIIGKAMISHHSLNLNRTDKYTISTTVKKHLLNINADFFTEKDLTQFINKRADRLLLSLSVGEDISDEIRVRSINQYLFYFVLVRILRLADQRATKKLNQDNI

SEQ ID NO: 11958 - protein, 744 aa, Myxococcus stipitatus DSM 14675
MADDEQPCVLTREPLAHVTEAEGRPHLLKEHLEAVGRLAAEFAPREDMKVPALATGRWHDLGKYRRHFQNRIREENGFEAHLEPDQGGDRDHSTAGALWALREDARLLPMAMAIAGHHCGLSDLEKFKERVRRPEKTAQLQDALAQGIPKDIQATPSGFSVEPLLKLSPHRLEFWTRMLFSALCDADFLDTEWFFDASRGAERKVEVTLAQLADGLRASLDRKQSGAPDTVVNQVRREVLSAVLAAAPSAPGVFSLTVPTGGGKTLTSMAFALEHARVHGHRRVIVGIPYTSIIEQSAAVYREAFGELGHAVIEHHSAVDPLKETALNRVASENWDAPVIVTTTVQLLESLFAHRPSACRKLHNIAHSVIVLDEAQTLPPSLLTTILDGLGTLVEDYGCSVVICTATQPALGRRPALPEGFASIRELVPPEVRAFERLRRVRVRWPSSREPTSYAELAEAVAREQDVLVVVHRRDDARRLCALVDALVGGEGRPLHLSALMCPEHRAVVLEDIKARKRRGEPVRLVATQLVEAGVDLDFAVVYRSMAGMDALGQAAGRCNREGLLAGLGELRVYEAETAPPPGVLRAAVDVTRTLLMQRPDLDLFAPESFRLFFERLYANASRDGKGIQDSRKTLQFEAVAGKFKLVEDGWSAPVVVPYAGCEPWLEALKKAGPSRERLRALQRFTVTVPRKVREAWVAREFAQVASDTVVFLGPEYRSTAYDPRFGLMPDKVGVLDPGTLIPG

SEQ ID NO: 11959 - protein, 770 aa, Myxococcus stipitatus DSM 14675
MNAPSRLLAKSARAGVAPVSLEAHLLDTEAAAVALFAAERRLSCNFRRFFRVAPEDSERFVLHLRLACLFHDLGKANADFLQAVQSRHATLQTLRHEHLSALLLHLPEVQQWLLGSASLDVDVLTAAVLCHHFKAAEGPGPHRWCQHRGPVARLSLHLDHPEVRAVLRRVSEVAGLGPAPSLPCVPWGPQAPWSSAYQHGIQSARAFASRVHEEPQRRSLLLAVKAGLIAADAAASGLVREGHPILAWLEDITRKPRLLPEDLARDILDLKAARIPGFELREFQRRAGGLGARALLLAACGSGKTLAAWKWAEAQLRERELGRVIFLYPTRGTATQGFKDYVSWAPGVDSALVHGTARYELEAMRSNPEECTAGQVSQDETTARLFALGLWSKRYFSATVDQFLAFLEHGYASTCLLPVLADSALIIDEVHSFDRHMFDSLVGFLRAFDLPVLCMTATLPASRRAELERAGLRVYPSEADRRGLEDLERSESHPRYRLTAVEDETAAFNVAVESFLQTRRVLWVVNQVGRCQSLARRLREALGVDVLCYHSRFRLEDRHVAHLRTVDAFRASPQPIIAVTTQVCEMSLDLDADVLISELAPVTALIQRFGRANRHLSRGLEFRARLVTYAPERAAPYDTEDLTRASMLLDALGSGDVSQRRLAEALERHARGERDASGGSRFIDAGYFATPGSFRDSDDFARPCLLDEDLPRAHALQVARKPWDGLIVSVPRSSVLGEASRPAWLPAHLGVAEASRYHPWLGFQSEETVS

SEQ ID NO: 11960 - protein, 781 aa, Thermoclostridium stercorarium subsp. stercorarium DSM 8532
MGNLFLAKSDFNHVTIYQHTVEMLKLFEELKSAFPDILTQKEWEVLRLAIIHHDIGKINATFQNKIYVRLKENISLPDTFDGVFEIPHGYLSTCMIDYERIQKEYGFLPEEILLLAMSIYYHHYRKVNYDDNQLKKTLEENVRPYISEFKREFRIGLISDEPDFEHANTKVNLEYLVKNKNLYNTYVKIKGLLNRIDYSASAGITEIEKSPFDSYNESVDQKVLKKYTANGNSLADVQWYLYKNRDKNIILIASTGIGKTEGALLWIGPQKGFYTLPLRVTINAIYKRIKGSSEKNSLNYSPVAILHSDSFNEYLKENDSYESSIYMESEARLFTAPLTITTVDQLFRFVFRYHGYEMIPATLMYSKVVIDEIQMYSPTIIACILYGLREISRLGGKFLIMTATMPKIFIKILEEKLNMKVSEAFELPQPFLRESNRSDKSKHFVKLHEHELDIEQIEKDSLNHKILVIVNTVTKAQEIYQRLNVENKWLLHSLFTREHRSVLENKILNFSKDENAKGVWVTTQIVEASLDIDFDILHTEMCTVDSLFQRMGRILRGRDRFLSEHTPNIHIYTENVSGLGHVINKEIYEFSLKALRKFLGPSGQQILTEEDKQNIIQNVYDPDLNPQILESKYYREILDYIGYLQSIQNRPYQLEKYETKFRDIISDLIIPKSIYIELDNTGILQQMEEQFQRADSIKKRQILDEILKHTIQVSHFYDRELLSNINNVLLKEAGKRAFADAGIKICDCPYDFNEKEEKGLGLLRKISREEKNKMQTMNSIL

SEQ ID NO: 11961 - protein, 737 aa, Thermoclostridium stercorarium subsp. stercorarium DSM 8532
MEYYAKLNPTQTILEHTQKALELYKQLKLLYSRLLSNEEWELLELAIICHDLGKTNAFMQKFFYQKLNIPFPLALEHNIPQIYHNHLSCAFIDYKDVISKYGLKNYKILCNCIYYHHNRPETDKKVLKYYIKNCLPNDIENFNFPLLAYNFRSKLNCEFTPYIDIYNNGLFTDFENFKRYVMIKGLLHKVDYCASAGIDIIEDNTRDEDGLSAAEKIKCIYPNLRDIQIYMNANKDKNLIIVGSTGIGKTEGAILWIGEEKGFYTLPLQIANNSIYARIKDKIKYKNVKLLHSNAISTYIREEKENGNTDAQEEYQKAKLFSSPLTVCTVDQIFKFVFKYNGFEYLLATLAYSKIVIDEIQMYSPEIVASILYGLKLATGLGSKFAIITATFPPILGDLMERYKIPFKGPVFFHKPGLPTRHRIKFFENRDFDLELIIDLAERYKVLIITNTVSKAQKIYEKLKDKVNTWIIHSRYIRKHRRMLENKILEFAPNKKDRNSNPGVWVSTHVVEASLDIDFDYILTSMCSIESLIQRMGRVWRDRLYDAETPNVYIYDNHDGLNSVIDSQIYSFSCNAVKAYDGKLLYETDIQNDKQAMMEMVYDRKKNPDILSSEYFKEIVKRIDSLDNLLPYDLKIKEVVKLFRGINSITIIPSSIYSELKKSGKISEWEYKLNQNISMKEKQSIKDEINEYTLELPWYDKGNLIIQENIIYPHSDINLWNGEYDFDENTLKGIGLI

SEQ ID NO: 11962 - protein, 405 aa, Enterococcus faecium ATCC 8459 = NRRL B-2354
MERLGNWILCHRCGMRTSVIDGQLADYGYFCTHCLYLGRCDTQQDLYLFDQPEAKPREVVFFWTGQLTEKQTEISKRILCHSEKRHHLIWAVTGAGKTEMLYPILVETLKAGGRVAICTPRVDVCNELFLRYRYVFPEEKITLLHGNTATAYTFTSFVICTIHQLYRFYRSFDLIVIDEIDAFPYNGDAGLAHAVQTAIKPDGRFIYLSATPDKKLLKEIKQTFDIHKLALRFHRRLLPEPVLVFMNNWRQKCKNKKKIKSLVRIIHQLIKENHILLFCPSITMMHRLKATLQEALPRYEITDVSSRDNQRAEKVQKMREAKYDILLTTMILERGVTFERISVIVLGADHPVFTKSSLVQIAGRADRKGPYTNSQVYFFYEEKTAAIRKACQEIKEMNEEGKKIL

SEQ ID NO: 11963 - protein, 738 aa, Clostridium saccharoperbutylacetonicum N1-4(HMT)
MIYYAKTKPMETIKEHTDNVLKEYENLKNTYEIEINNVVRNFMEPEYFWKLLEFCCEYHDYGKCNVQFQNKLRKKIIEMKDIDPKSEEFNEIPCDKHEEIPHNYLSPAFLPTEELKQISEPLRNIIYQAIAYHHERKSIPDQNEIKEYIKNTLDKELDGMNKHMGNNISKVFGGYAGKIENVVRIKERDENYKFYIMLKGLIHRLDHSASAHVKVEEKLQKTVGKCTEDFFKNKDWDFRAPQEFAMKNREDNLLIIASTGIGKTESALLWINDKKGFFTLPLRVSLNALYSRVKDDIGYDSVGLLHSSALEYMEKQGDDEAYKTYEEASLLNKKLSFSTIDQIFKYPFKYLGYEKVLATLAYSRVVIDEIQAYSPEIAAVILYSVKQLIEMGGKFMIMTATLPRIYKDKLKEFNIEFKEEKFISDNDRHKIKLVEDEIINSVEKVSELGRKNKVLVIVNTVDKAIEYYKLLEDKKVNVNLLHSLFNNNDRSKKEEEIKKFTKEGNKECGIWVTTQIVEASLDVDFDYLISEMSTLDSQFQRYGRCFRKRTFKGADPNIFIYTSNASGVGGVYDEEIFNKSIELLMPYDNQILKEAIKVDLVDKLYSKEMLKGTKFLKKFIEACNVLENIIPYENTSREAQKVLRDIDSVRVIPNDLYNKNMNLFDEVIEDRNSDRHKLFREINNLTISIPRQKLKKFSKLNNELRVDPVAKIDNILLINAKYTKEEGLCLGELYDNIF

SEQ ID NO: 11964 - protein, 967 aa, Streptomyces hygroscopicus subsp. jinggangensis TL01; identical to SEQ ID NO: 11894

SEQ ID NO: 11965 - protein, 873 aa, Unknown
  uncultured organism
MPLQEAVYPLFWGKSAAEESGGDGHSLLSHLLDVAAVARVLLERFVPPSALQEFGAEVLAALVGLHDYGKAIPGFQAKWPQGRARLESAGFSFRPPQVLKQDRHDLASAALLPREAKLAEALACILGGHHGYIVRSGERKHAAPNRESPEWRAARRALLGDYLAAQGLDASAVPDGEFLETRLDAALWLAGLVSVADWIGSNDAFFPYAGRPPAGPAYWRDAQERARRALRELGWHERVTLLSDEREDTAALLTRMTGKALAPRPLQSAVEELLCEVAEPPLVLIEAPMGEGKTEAAFLAFLRLQRRFGLRGFYVGLPTQATGNAMFERAVRFLQAFADRHDVQLDIQLAHAGAELVESYQALRGVYGEPGEHVAAASWFAKPKRALLSPFGVGTVDQALYAVLHVKHHFVRLWGLARRVVILDEVHAYDVYTGGLIAHLLRWLKRMGCAVILLSATLPRAKRQELLAAWGVAENEESAYPRVLLAQGGRIASRTIIAREQAPIALCALSELLESIAETARNLTAEGGCIAVIVNTVDRAQTLYSMLEDTVGDAAEVLLYHARFPADERQAIEQKVLARFGKECERPERAILIATQVAEQSLDVDFDAMITDLAPVDLVLQRAGRLHRHPRQRPEAHREPVLYVAGLAGESPPDLTATRWKYVYQPYILLRSWRQLRERPIVRLPDDIDSLVQAVYDAAPADEGAEVATVQDQDAAYGQYLAEMQEMRQRMHNVALDADAPDLFALIDIPQAREAGEGGLEVVTRLGEESLAVVPLWVNEAGWRERPDAPPFDPQRPLERNRARAVYARQLRVSRKVLIEALKAQARPPAFAESPYLRDLYPLILDDESKTMVGNLQVRLDPCLGLVYEKEET

SEQ ID NO: 11966 - protein, 892 aa, Dehalococcoides mccartyi DCMB5
MTNDPNLKLWAKTGRGGDLYYHPLLYHMLDVAAVATHMWELLSEDQRKRIGYTLGNEARAITLLLAGGHDIGKASPGFQQQVPQLSELTDLQVSVNDQNRPHGFVSACVLNRFFTTVLGQIAGGHHGIFPRSLDLRMGRDILGNREWEIARNGLLQELAKVLKIDISDDTKCKPKIIDPFIIPLLAGLISVADWIGSNQDFFPCLTKPGQLPELVGDKYFEVAKDRADKALHELGWMPGVIFAKEAPFTHVFSGFIPNSLQNSIEDIAIKQTSPYLMIIEAPTGQGKTEAALYAADLALCRGFARGIYIAMPTQATSNAMFKRVQVDYLKNRRHKGKLNLQLVHGNALLAGMGEVREGEISDFKIADTDTGDTNTDMEAQSWFTAKKRPLLSPFGVGTIDQSLLSVLQTRHWFVRLFGLAGKVVIFDEIHAYDAYMITILERLLQWLAEIDCTVILLSATLPEARRKALIYAYSGQNSSENKCYPRITLAQSRHYINQETNELIVCKEVSVEDSHCIYLNFSRNDLEILAGELTRKLEHGGCAAVICDTVDRSIEVFRYLQANMHETECLLFHARTLQVWRREREDEVLRKFGKGTKQHDGSYTNPDRPFRAVLVATQVIEQSLDLDFDLMFSEIAPVDLLLQRIGRLHRHSRTRPEGLEMPQFTILCDGNRGGAPPDTFGKNIEHIYDRYILLRTWLVVRGKAMIEVPAETEKLIEKVYGTDEEICGPDWIEALEKAKRNLVHEQEESQKAASRLLICPPCDSEDIVRQFNCELFDDDDPEVHTAIRAATREGDPSIMLVMVNAGAVLAAEPALDEVRDLLGHSTMLSYKGLYHELASNCETPKGWEKNTHLNHARLMCLDENNRAKIGGYILTVNEKLGIVIEKESKDNG

SEQ ID NO: 11967 - protein, 930 aa, Vibrio phage ICP1_2011_A
MFIRIKCFSKQPIAKKVSREVSAYLEYTGNNTWEGHISGQGVSNLQTKLINVGKGVKVVCNYQDKVLFAIGNVAMSDTGSVPKYTTKKVYKPDDSIFTLKQGLVGVAALWHDLGKANSYFQRKLRGECNPSDPVRHEWVSGVIVSTFAKGNDWLSDDFIIPEVKHSDNVFGDDQVLNAVLWLINTHHKKGLVEDPIYRATKTMFTETLQCVNVNGGWFNYGDNIDECYKIDTSFITDTYVKQLNRYRKKLLATKHIWFTLGEDQKIAILQECRVALMLGDSNFSSDLIGGDGSHLYANLDECGNLKQTLTQHLLGVTDCALKALFTINHHKPVKANFIPTIAEKGEGKFAWQNGVNMVDSSIDNMFCINMASTGKGKTLANLKLLQHFGNVRCSFGLGMVSLTKQTAKQFLDMGVDYNSAAMVTGFSKSRFNLGSESLDQDEVSVEYWGQTSSLSKVFPNNNAGFKNKKLLSAPILVTTTDHLVKASGVKKGNKQMLPYVRCMHSDLVLDEIDDYGIEDMVVLARLVYLTACYGNKVIISSATITPAISNIFYEAYSSGYKVFCANKQTTYKGVNVVWWDEFGIKVEKVTDQFSNLNTRFVNKRITNLLESTPKHKALVVDQDDNMEAVKQSITTLHNAHNSGGVSFGLIRTTTIKDCVAVTQELQNWETDLSIKILCYHSRFVGDTKAQMEEYLSKVLNRKGDEYKKFVDTTTPTAYIVVATPVVEVGRDFDFDWAIIEPSSERSIVQCAGRVLRHRSSTPTTHNIHILKYPFKFYRNSNICYDVAGYESKGYKLKSKNMLDIYKKESIVNSVNRLQGDAAFYTKSLTALEHKVLLDKLTTDIADTNVFVGGWQLTANPHEYCKWRRGTKNEDLVLTDGKWSGNVTTTKPIQSKIWRKWQGENGSITVPEYLLDKTICYNDFYGGYENE

SEQ ID NO: 11968 - protein, 763 aa, Hydrogenobaculum sp. HO; identical to SEQ ID NO: 11829

SEQ ID NO: 11969 - protein, 735 aa, Hydrogenobaculum sp. HO; identical to SEQ ID NO: 11830

SEQ ID NO: 11970 - protein, 787 aa, Bibersteinia trehalosi USDA-ARS-USMARC-192
MAAKLDLADAGELLGLMHDFGKYSKKFQTYIRHVTGILTYADLDSEDENNGGDHSTAGAQWIYGRLRKLGAAKNADGKIIGIGELVGQILGLCIASHHGAGLIDCLSPEGSEKPKWRERFDKDDKLTHLSECEKNADAVIINRAEELVGIDLVRLVDKPIRAILNQKEIPFKLKEFYLGCLTRFLFSCLIDADRINTSDFENERQKEIRNLTNTPNWQKAIDKLESHLSGFSIKYPIDGIRREISESCLERSTDQQGIYTLTVPTGGGKTLSSLRYALHHAKLHNLDRIIYIIPYTSIIDQNAQAVRKILGEEWVLEHHSNIEPDQQTWQNKLLSENWDKPIVFTTMVQFLDAWFGSGTRGVRHIHAMTKSVLIFDEIQTLPIKCVHLFCNVLNWLTHFGKSSAVLCTATQPLLNSLKNPHLGQIQLADNAELIGNQFKIRELFDKLSRVEVNYCPQTGGYSLENAGEFLLEQFGQYSSCLFIVNTKKWAQDLYRYCQNRNLPQEALFHLSTNQCSAHRKTIFDKIKARLNNKEPVICISTQLIEAGVDISMACVIRALGGLDSIAQAAGRCNRHGENKGKGQVYVLNLQEPNLESVLPDIYIGQQQSERVFNDFEGQDILQPNAMSQYFDYYFYNRSNEMGYSLPNNYSGTLLDWLSDNAQNTYVPKNNQRKTVFPLLMQSFKSAGKLFQTIDAPTQAVIVPYENAKELIATLCGTDDNEKKYKALSQAQRYSVNVFPNVWKKLQENEAIQETQLGSGIFYLKDRHYTEEYGLSIEETGNLTFYDL

SEQ ID NO: 11971 - protein, 821 aa, Bifidobacterium thermophilum RBL67
MGEQYARTYESPDGFRRQTLRDHLDGTGALACRFADSVGLGPLASAAAELHDLGKATGAFQRYLLDGVGAKGSVIHAYQGAFAVEDASYSAHDKVNKSISRLTRDMLEVAIASHHGDLPDCIDHGGLDSFFNHMGSSEKDDGNYHYTEVKSNVKELGLDIDSLCADASKNLGEVYDKCIKGRRANRDFALGMLTKYNYSCLVDADRCDAACFGDPDAVPYYAANWDALIDAFETYNARLSADTPINAVRADISRQCMDSATRPTGIYRLSVPTGGGKTLSSLRFALHHARQWNKKRIIYVIPFLSITSQTAATFREVLGLGDDDSVLLEHYSDAGRGETTHDTEIADEQEARRRLSQERWSQPLIVTTMVQFLETCMASRGTKLRKFHNMADSVIIFDEIQSLPSHSLDLFKEIVNFLSEALRTTIVLCTATQPALENIDKTVRLDLADNPELVTLSGEQRRVFRRVNIVTQQRPLPIAGDGGLAQFVLDKARENGSCLAVVNLKSEARKLTQELRSLDAQSQGFALVHLSTSMCGAHRNDALAEVRAATASGEPIICVSTQLIEAGVDVSFGTVVRAAAGLGSIVQAAGRCNRNGESVKPRNVYVVPVSDDDEKGLSAVRDIKCGKEIMIHSLVPLASKNPDFDLLGKEALDMYNTAFYKDKVEGNELKYPLPDGTNAYDLLGFNKAARYEYNTVTHPDGPSAYVHCLAQSFRTVGRRYQVIPNLTKSVVVRYRSSAGTDSRELLEQLRDEYDPREKVRIIRRLQDFTVQLFDADFKKLTERGLITLADDDFELYALESDDCYDMNFGVVPDAEQKDLFF

SEQ ID NO: 11972 - protein, 881 aa, Edwardsiella piscicida C07-087
MINRRRKATDTESAIAAVPFELCPAKTYKDRQGVPHLGRSVFNHCQIVGQTAKALLERIPETIRHPLFPRGSALQAALHDIGKISPTFFLKLQCAVEGEDSPWLQRMPQFRGIQEREWGGHAGVSELALAAITSNPFVPSVAGQHHGFNPPEVMLTADAPPLGGASWQTERCKLVEALQRAMGEEIPVITTPAQARILAGLTTVADWIGSGHHFEDPATPWQPRIEQALDDAGFVLPQVRNGLTFGDIFRAEDGTPYQPNEPQQLLHQYSQGVGVYVLEAPMGLGKTEAALYAAYKMLEEGRATGIYFALPTQLTSNKLLDRFNGYLKQILTEESPHRHSLLLHGNAWLVNHALGEEGKPGRSWFDSAKRGLLAPFAVGTLDQALMAAMNVKHGFVRAFGLVGKVVILDEVHSYDAYTGVILDELIRLLRTLHCTVIILSATLSQARRSELLGQLAQRDAYPLISVSPGITPSPLQELSVTPEEPRTVYLQCKAMADQTVLEEVLKRASQGQQVLWIENTVAEAQERYLDLAARAQELGVACGLLHSRFTALHRQKNEAHWVGCYGKVGRAARREQGRILIGTQVLEQSLDIDADFLVSRMAPSDMLFQRLGRLWRHEQTPRPPEAIREAWILAPDLDAARQDPYQAFGATAHVYSPYLLCRSLEVWLAQVKEGRVSLPDHIRTLVESTYRERSEDDAMARWKRELFEGAHRRKGVNTLRQLARLTLSKGDKTLPEAKAQTRYSEQESGDLLLLSGLSLNNHDQATTLTFLDGEQIVIPWHGHRLTPAEWRNCAARVTQHLVSCRLSQLPRPAERLWCQKVGLGHVLYLGHPDQDDAAISIALIATDHQLQAVDGRSAPLSDRLSYRYRDDIGLIITQYKE

SEQ ID NO: 11973 - protein, 764 aa, Xanthomonas axonopodis Xac29-1; identical to SEQ ID NO: 11542

SEQ ID NO: 11974 - protein, 763 aa, Hydrogenobaculum sp. SN; identical to SEQ ID NO: 11829

SEQ ID NO: 11975 - protein, 735 aa, Hydrogenobaculum sp. SN; identical to SEQ ID NO: 11830

SEQ ID NO: 11976 - protein, 764 aa, Xanthomonas citri subsp. citri Aw12879; identical to SEQ ID NO: 11542

SEQ ID NO: 11977 - protein, 762 aa, Mannheimia haemolytica USDA-ARS-USMARC-183
MEEHTIQSFYAHSGKLSDHSDWQTLLSHANNVGLLAAEFAAPFASQEIARCTGLLHDLGKYSERYQKRLHGGERVNHSTAGAKIAVERWGPLGKMMAFCIAGHHAGLANGSGEGKNRSTLTQRLQEQFGYGHKDLPVLDAIWQQELNLPEKLPLPPLKPSKNEPFFSYAFFIRMLYSCLVDADFLDTEAFYANLEKRPLERGNYPNLTALHQQFNQFIAQFRERIATQTPNTQEAQRKAEVNRLRSEILDYAVSQAKQETGLFSLTVPTGGGKTFTSMAFALEHAKQYGLCRIIYVIPFTSIIEQNAAEFRKAFGELGTEAVLEHHSTFDHDSLPDKSSRDKLKLASENWDTPVVVTTAVQFFESLFADRSSRCRKLHNIVGSVIILDEAQMLPLNLLRPIMAAIDELARNYQCSVVLCTATQPAIHQANGFYKGFENVREIAPNPTALFEKLKRTTVKHIGIQTDVELQSKLADNPQMLIIVNNRRHARALYDSAKQLEGAYHLTTLMCAKHRSQTLTEIRLRLKQNLPCRVIATSLIEAGVDVDFPLVMRAEAGLDSVAQAAGRCNREGKRLSVESNVWVFQPEEQWKAPPELGLLSGCMRSTVQVHADDLLNPKAINHYFQAVYEAKGKELDKPNILKACHDAGQSLNFPFQKIAEDFRMITSHLIPVIIPFDQEAENLIDRLRYADQVGGILRKLQPYTVQVPEKALAELYNAGRVETINETNFGKQFYCLIGMDLYDEVAGLSWENVDFLESEKLVL

SEQ ID NO: 11978 - protein, 762 aa, Mannheimia haemolytica USDA-ARS-USMARC-185; identical to SEQ ID NO: 11977

SEQ ID NO: 11979 - protein, 781 aa, Thermoclostridium stercorarium subsp. stercorarium DSM 8532; identical to SEQ ID NO: 11960

SEQ ID NO: 11980 - protein, 737 aa, Thermoclostridium stercorarium subsp. stercorarium DSM 8532; identical to SEQ ID NO: 11961

SEQ ID NO: 11981 - protein, 501 aa, Sulfolobus islandicus LAL14/1
MLSLADFYNDFITRHGFEERKGIEETLLNLENGHSVILKAPTGYGKTTLTMILANAVSSDINLGSRVIHVLPYRAIVQDLYLKLKNNADKGVIYTKSIGAQDMDYQDSPFFMKKVNVTTLDTFILNLFKLPTVDFKLIFKNYGSHYEFPRALIYSSIVIFDEFHLLGEDGKSLGAGLAALEVLRDAGVPIVVTSATIDKGLERVLMNKLGKNVKVVNANDFKIDRKIYVNVLENDEISITEVKVKEGKRVLLVYNTRMGAIEAYKKLKGRGLSPILIHSKFSKKDRIDKVNKINEAKLVVSTQVIEAGIDTSFDVLITEASPSHNLIQRAGRVARYGKGGRGKLEGEVYIFPFSGKVYDKREVKETVERVTKLKTIDENLLIERDYTEVIDSILAKDLSVIDNSVFVDSKKVKSIYEEICSITRNASIILGFPPNSNDVNDAIPLTEEEAIKIINSKGSSAFVGNGNVKLYNKKCLQLEMLKNDILGVRIQDYNSEIGGVY

SEQ ID NO: 11982 - protein, 762 aa, Mannheimia haemolytica M42548; identical to SEQ ID NO: 11977

SEQ ID NO: 11983 - protein, 661 aa, Azotobacter vinelandii CA; identical to SEQ ID NO: 11675

SEQ ID NO: 11984 - protein, 661 aa, Azotobacter vinelandii CA6; identical to SEQ ID NO: 11675

SEQ ID NO: 11985 - protein, 498 aa, Bacillus sp. 1NLA3E
MELEGLLHKHFHYDKFRPGQKEVISSLLTGKHTLAMLPTGTGKSLCYQLPGHLLEGHVLIVSPLLSLMQDQVEQMKMNGEKRVIALNSFLTYQEKQTAFLNLRKYKFIFISPEMLGVETIIQSLQKLLISLFVVDEAHCISQWGYDFRPDYLKLGDIRQKLNNPTTLALTATAKQEVRKDIMQSLNTGQWEEIVHSVDRPNITITVEKITNSSRKLERLSELVKDLKGPGIIYFSSKRLAEQTASYLHEQGMNKVMAYHGGMEQEQRILIQQQFLYGQLDVICATSAFGMGINKENIHFIIHYHMPLQMESYLQEIGRAGRDGSQSIAILMYAPGDEFLATQLSEGELPTKDQVEYLYSLMKGHNHPTSEVSVLEEWKRMPGFSDVQWRIVADFLNLTGTNNIGIEESVPKLINFVENRLAFKRSNIANMMDWIISQSCRRQAILTYFSEEQLSSKNISNCCDCCGVDNKLFHSDGLVKNKDDKYKDWKHYLSQILLK

SEQ ID NO: 11986 - protein, 761 aa, Archaeoglobus sulfaticallidus PM70-1
MIVEVFRKLTGVNPYEYQKIAMENLVEGKSLIIRAPTGSGKTEVALIPFIYGLNDFLPSQLIYSLPTRTLVESIGERATKYASFKKLRVATHHGKKATSSLFEEDIIVTTIDQTAGAYLSVPLSMPKRWGNIFVGGVASALTVFDEVHTLDPEKGLQTAAAIAMQSAKLGFPSIIMSATLPDVFIERVGERIEKNGGKVEIIDVANESEIKSRKNRKVELINRTNEELVADTVLNKAENCRKLVVVVNTVERAQRLYLDLREKTDYPILLLHSRYLEEDRAKKEKFLEEVFGKNGKGECIFISTQVVEVGMDISSPVILSEAAPVDALIQRAGRCARWGGNGEFHVFGLAKDVGNPYAPYLKGLVEATITEISSRGNFTLDWQTEVELVNQVLSSHFEFFMDSTFFYQRLGELARAVYEGSKAKVEQNVREVFSCDVTLHENPESLEPEEILALPRIRVDARVLSGKVEKLAELGIKTYKLEENPVIGDYDKSGYIPVLVKSKEDVTPFELYVLSGACYSPEVGLVFDKSAPNAIKSFEPDKLKLNDIKSQAEYKLEKETWVEHAKRALHALDCYLIPRYYYVIKNFADYFGYEYNEFVDLIKCITALHDLGKLNITWQKKVSWDSKIPLAHSDKNNVSGGLPPHAPVSAKALQPYLESLFDDEDVFKAFYLAIAHHHAPWVREYKEYSLIPDFDKFIEEVWSVPKELIKAHDSAGRLDFTYLDLIDENEAYRLYGLLSKLLRISDRLATGGVSYESIFSA

SEQ ID NO: 11987 - protein, 367 aa, Streptococcus cristatus AS 1.3089
MGRVRSDQELYYFPQEDFPENQVLKWQGKLTAFQEKVSQGLLESVVQKQNSLVHAVTGAGKTEMIYQVIAEVVDRGGAVCLASPRIDVCLELYRRLKLDFACPISLLHGESEPYFRSPLVIATTHQLLKFYRAFDLLIVDEVDAFPYVDNPVLYHAVDQSVKEEGTTIFLTATSTDELDKKVQKGELKRLSLPRRFHGNPLIVPQKVWLADFQKYLAKKKLPPKLRKYIERQRKTGFPLLIFASEIKRGQEFAQVLEENFPAERVGFVASTTENRLEIVEEFRKREITILVTTTILERGVTFPCVDVFVLEAHHRLFSRSALVQISGRVGRSMDRPTGDLFFFHDGTTRSIEKAIREIKLMNKEAGL

SEQ ID NO: 11988 - protein, 782 aa, Desulfallas gibsoniae DSM 7213
MLSAGREVKFWDAGVLNDILKILSFAHDFGKATPYFQKYIENPYKQKSGPLARHSLLSAVVGYRLAKYYFEGYRDAQKLSLFVYVAIKRHHGNLHSIEDEFLTFSDQDQDLLLKQVRSIDFSMLEETWKPLVIQLPPGLSKILPFTCEKLEIWIKDMQEELNQISLWWLLNEDKNQSFLGDKNEPQAEYSLDNYFKFLYIYSLLLDADKSQVGIREYHRNNVEISLNLVDEYKKHNQWDSTGLNDFRNMAYEEISDNLSLADQGNLFKITLPTGMGKTLAAYNFAFRLRDKRLKNRGIPPRIIYALPFLSVIDQNYNVLSDIMELQGLTGHNILIKHHHLADPVYTMGKGEDEITYSPNASKLLIEGWASEVVVTTFVQLFETLIGWRNSCLRRFHNLAHSIIVLDEIQALPVSYWQLAQHVLEYMINNMNVDIILVTATQPKIFTGDMNPFELVNAEQYFGNMDRIAMKVDLFPRTVSEFADSIKDELQGQERKSFLFIFNTIASAKEFYQLLVKMVDEPVAFLSTGVVMKDRSLRIKDIKDKKYRFAVSTQLVEAGVDIDFDVVYRDFAPMDSINQAAGRCNRNGLGERRGVVNIIYLVRENKKRSYAGLIYNNTSLDITKRILKDKGMISESELLDLIDLYFQHAKDLGRASESFHLLEALQNLRFNSGDNPDAGVNDFRLIKQRGNRVNIFVELDREAEEVWLEYEDIVQHCEDFYQRQERFETIKKDFYQYVISVTVNEGMFLPPEFNNFCYVSKFQLKSYYDKNLGFDTSNYENIF

SEQ ID NO: 11989 - protein, 733 aa, Desulfallas gibsoniae DSM 7213
MTYFAHSDKDKPASQWQLLKDHLEHAGETASISAKPWGAEKISYLAGLMHDMGKYSVQFQERLKGRIIKVDHSTAGAVEAEKRYGPVGRILAYIIAGHHCGLPDWGSAADESSLAARLNKRLNDYSAFFREIELPPAGEVSFPAIRPVCGAGFSVQFLIRFLYSCLVDADFLDTEKYACPAKSAARNNQYALGELSSKLDWFLDDMCAKAPDTVVNRWRAQILAHCREKARHASGLFTLTVPTGGGKTLSSLSFALKHALQYGQKRVIYVIPYTSIIEQNADVFRKVLGIEQVLEHHSNFTYPQQDQEDSDTEYASDVGQKLKLAAENWDMPVIATTNVQFFESLFAARSSRCRKIHNIANSVIIIDEAQMIPTGFLKPCLNALSELVTNYKTTIVLCTATQPAIGQLLPNGVKPVEIIGDPDGLYQAFKRVKVCNIGTVVDDDLAERLTAYHQVLCIVNTKKHARLLYEQISAEGTFHLSTRMCPEHRSETLKIIKDRLKKGQVCRVVSTQLIEAGVDVDFPVVYRSMAGIDSIAQSAGRCNREGLLPFGRLFVFWPAEKHGLPRGWLSRTASLGGMVFERLSDPLGLDGVKEYFSSLYDVDTALLDKEGIMAEIKEQEKQLKFPFRTIADKFKIIDKNTVPIIIPWGEACNKTLAQAKFSPFPGTYARKLQRYGVGVYENEFNELVNNQALEVIAETFYVLKEEVFIKYYSRKTGLNPFTESMFLNDTLII

SEQ ID NO: 11990 - protein, 845 aa, Fusobacterium nucleatum subsp. animalis 4_8
MTKFEDIFDFQDKYKYLAHIKDNRKETLQEHTELANKYLKKIIEYKNLKPFFERIKNILNLKNIEEELFYKMISDVITFHDFGKINSQFQIDKMLNEEILKMEDKYNISGVLGSDHSLLSASMFIAYYFGKITDLIEIVETKKIVILFEILFALSYVISKHHGNLDSFEEYIEKLSRNNDENILKELKNISVSNGGILLQAFLEKETITIFFNFIETYISERKKKENISSHEAMSIFVFTKMMFSLLVASDYYSTNEFMQEIKYEDFGNMGNIDTIKKEYENSEIIKSIRDKEKNGIPNDEDINNFRTKIFLEAEKNLEKNKDSNIFFLEAPTGSGKSNTALNLSLKLLSENRRKIFYVYPFNTLVEQNMNTLKNIFENNEEVIKNIAVVNSVTALTNKDSRDISIEEYSDILMDRQFLNYPFIVTTHVGIFNSLVGNTKEDCMPFYQLANSVIVFDEIQAYKNTIWTEIIKILNSYAKLINIKIIIMSATLPNLSYLLDEEEKNNISKLIENRDEYFNNAIFKNRVEVNYDLLSEQKIEYEELLEHIIENSLNNQKILIEFISKNDAKKFYELCENNEDLNIKYEILLLTGEDNKARRNSIIKKINSKDKRVILISTQLIEAGVDIDVDVGYKNISGLDNEEQFLGRINRSCKKSGKAYFFYLTDAKKVYKNSVIIENKLNLFSDEMRDVLENKNFDVFYSKVLEILKRKAKEKINNDNFETIIFNKKFRLLKERMKLIEEQDDKKTYFFNRTLTNEEIEEIGENIDGSEVWERYVDILKEENYAKKIVELSKIREKMMYFLYEVKKNVELNYSDIKGSIIYIDDGDEYFTDGVYTGGEGDMFI

SEQ ID NO: 11991 - protein, 948 aa, Methanobrevibacter sp. AbM4
MDFFDLKYDFDSSFIKLNDDFFYFYAHNNEYLNDHIQKTSHIFDNLLNKKIIENFYEIFKQDHLINFSFDDFNKIIKYTVYLHDIGKISFNFQLNRLNTNNKKIFNEQSTFLKKHYFEDYIPLLCKTHSIVGSLIFLSKFKANIDENTLILLLLAYTIYGHHTSIKDILSNKNFSYNLNDKEWNTFCIILLYLDLANKEDIENEKFSTYYFNQIQDNASNYLKSEIEDYNSTLSLFYMYIYSLLIVSDVFASNKYNISVEEVKKLNFNNRITSNLKNIMFSSFYNKTYNKNLSYNLIIDSLDNIDNINVLRKNMLLESSLNLIKNIDKNNVFFLNMPTGAGKTNTSMKLALDIINNTEIDRIIYAMPFINIIEQNFDVICDSYGLSEDNGEIRKIYSGSETLFSDASDEFKYDILLNDDFFNYPVICTTFVSLFNSIIRNDKKSKYKLSALTNSVIILDEIQSLPLKNWNSLYYIINELADKYNIYFIIMSATLPNFNRLILDSKSNLRYPNISLIENPSKYFNHSLFKRTETKNEIKSFELTSENHAEIIDYLLDIVEENFEQGYNKGLMVFNTIKSSRLIYDYLSEYCEEYNFEIDLLNSSLIPSSKKAIISKINHMNENQNKKYILISTQSIEAGVDVSFDFVIRDYAILDSVEQVKGRCNRNGELAIRYNNPSKKGNVYLIKLNDSKKNYYEYIYNNEEQETRIKSTENLIEESPNYTFEDISKYYDNVSDLINLHNNEKESKFNFIDRDNIKFLNNIEYSKLKDKETGIHLIDNNQEQFSIFICTDLNIFTESLKINKNFNVWEKLDDNNFIEFYKENKSDFIFSINELKYIKNISAKTNKKLYHENKIIGKNLLDYYKSLFKNKNKNYDYYKLIKKEFSSILYKFIINITINKYDQLYDKINEWEKFKFFYILDKKDIGNEEESFYSLEKGFNFKPVITEIY

SEQ ID NO: 11992 - protein, 707 aa, Candidatus Methanomassiliicoccus intestinalis Issoire-Mx1
MHYYGEYFSENEKQAIFIALKYHDYGKVNYQFQNKLLKKLEKPLLHNQDLDEFYGDMSIPHGYLSPAFLPYESMIGDFDKEWVISIINAIYYHHTRQDCSKEDVHRTLEADIYPRFQNDYKLQNSYLSKVFKKGIFVELDRWERYAVVKGILNRLDYVASSNDDLSIELDPLQNGQRYDEIVESKLTSKWKLRSVQEEMKDHTDENMIVVASTGIGKTEAALLWGRGSKLFYTLPLKVAINAIYERIHDSTEGYGYENSIFLHSDSLSLLMQEDADADALTKYRRSKLFSYPLTVCTVDQLFTFVYKYLGCEMIPATLKYSKVVIDEIQSYSPDILAKILFGLKIIDHLGGKFAIVTATFPPILEYLIKNKTKIAYRKPTPFLSPYETRHMISYVEGDFDYLEILRNSVSKKVLVICNTVNRACEVFQNLRHDCRNVHLIHSRYQKRHRDVLEAEILKFSDGDENGIWVSTQIVEASLDIDFDELYTEMCPADNLLQRLGRCYRKRNYSGTAPNVHIHNTRSGVSSIYDPEIYDLSVERLKQYDNKFFTEKEKISYVESVYSHELLKNTQYFKKLLKEYNSLEKFAFSDFSKKEATEKFRDILTITIIPDEQYDILLNNGMIDKLRSVIDNPHTKTSRRQKYLDDLMQYTISVNPMIFSKEIMPDKDSICSSVKIYRVNAMYDFDEESHMGVGLTIQSLNENFSNQL

SEQ ID NO: 11993 - protein, 704 aa, Pseudomonas putida H8234
MVGADRDVIIAASTAAGKTEAAFLPILTNLLNDREPAGAVLYISPLKALINDQWDRLSRLCERLELPVVAWHGDVAASKKQRFLKSPEGILLITPESLEALFVNRGSSLPGAFQNLRYIVIDELHAFIGSERGKQLQSLMERVEIVVGRALPRVGLSATLGEMSLARKFLRPVRPDDITIIESKSSNQELQVQVRGYLEQPMQQVVAEYPGKSSTDEGDEQEETSGTKVAIAGHLYKVLRGHNNLIFPNRRQEVEWFADRLRSLCDNDGVPNEFWPHHGSLSKELRQDAERALKAGDPPASAVCTTTLELGIDIGNIRTVAQIGSPPSVASLRQRLGRSGRRPGEPAMLRAYCRERPLTDQSDLSDQLREGLVQTVAMIRLLIGGWFEPPRSGGLHASTLVQQCLSSIAQLGGASAAQLWGNLIASGSFASVTKPDFLSLLKGMGEKELIVQDSSGLLLPGELGERLINHYEFYTAFTSDEEFRLLRDGKPLGSLPVSKPLTKGQRIIFGGRRWQVQSVDLEAKMIVVTPARGGEPPQFDGLGAQVDDRVRLEMRNVLMETTPCPFLDKHAQVLLEEARSNFRALGLGSTAIVGSASVSYVATWRGDYTNDALALLLRHVGIHCENTGLFLEVAFSEEDTLRALRVVGQMDISNVEPILESVENMIREKWDWALPRSLLMKSFASSHLDLQAAVLTARLLGEEA

SEQ ID NO: 11994 - protein, 763 aa, Saccharomycetaceae sp. 'Ashbya aceri'
MAKKHRLTTVKRKELRQKESETLKQLQERIKEYDAKTCRAVAFQDLPISGGTVKGLKEAAYIKMTDIQREAIPVALKGHDVLGAAKTGSGKTLAFLVPVLERLYHERWTELDGLGALIISPTRELAMQIYEVLVKIGKYMSFSAGLVIGGKDVKFEMERVSKINILIGTPGRILQHMDQSVGLNTSNLQILVLDEADRCLDMGFKKALDAIVSNLPPSRQTLLFSATQSQSLADLARLSLADYKSVGTMDGPSAKNKPATPENLEQFYIQVTLPDKLDILFSFIKSHLKSKMIIFLSSSKQVHFVYETFRKMQPGISLMHLHGRQKQTARTETLDKFSRAQHVCLFSTDVVARGIDFPSIDWVIQADCPEDVDTYIHRVGRSARYGKAGKSLLMLTPQEEDAFLARLKSKLIEPSKLNIKQSKRKSIKPQLQSLLFKDPELKYLAQKAFISYVRSIYIQKDTEVFKFNELPLEEFAASLGLPGAPQVKIKGKKSIQKAKELKNTSRQLLSLAKANDDGEVENKEKAVRTKYDKMFGRKNQTVLSEHYMNITKSGAAEDDEADFMTIKRTDHELNENDLPQLTLPTSKRAQKKALSKKASLSTKSNPTKFKFDEDGVPHPIYELEGEEEFHKKGDVSTQVQEFLSKEAEYMARADTEDKQLVKEKRQEKKRKRLEAMRREMEALEDDDDEDNAPTLAYVGTGNLSDDIASSDESDIAPASPPPRKKQKGRSSKSVQTPDAGIVEVEEPDTLEDLESLTSRLING

SEQ ID NO: 11995 - protein, 746 aa, Ferroplasma acidarmanus fer1
MSSSIKIIAKSNGESLEEHTKKCIDNFIIIKEALNEKISYILNKYNIDNNNFWIHAFYAVAFHDFGKLDKSFQDMINKVIQQDPGDKVDIPKALPHALISAIALLNFEENNYLFDNIPISSICVLTHHSMLKDNLFERNSNLSNMNLYDYSDFISFVNKEFKEIFNTDPYKFNININNVDYKKIIKGIHNKIIEYYEKDKLRIMYIIIENIIHMCDWNASSNKSLNMDIDYDNKICMYLQNRPDFNKLNELQIFMQENNDNYIIQSPTGSGKTEASLLWSKYNNGRIVYILPTMVTSNKIFERLKQIFGDIVGIQHSTSLLLMDTDIDADKNNYNHDAFARFYYKTFSSPIMVSTVDQLLYSLFNINRWDSVFFNSGISNVIFDEIHAYDPYTTSLIIEYINKAHIFNQRVLIMSATIPDILKDFIKCKTKKINFVDKEFDINEIRYNVNVIDGDINNSIDIIKKHKDIKKILVIANTIKTAKYLYSQIRDIDEIKDKKVVLFHSQFTYNDRKEKSELLEKEDNIIAIATQVVEVSLDIDFDLLITQIAPPDALIQRFGRVNRRGKKGNTKIFIYKNCENDKYVYKNELMKKTFDYFNKYNYKSNTDSKKLINEIYNDNEYKENLKNAYTEVKNKIYEIQVEDLKSVYKFNIEEQIAEKHNLIRKISYIKILCIPDKYYNNVFQAYEKSIYEGWKEFLKYSLNIPYESTKGHIKTCETYNFKYFDFEYTFEEGINYDKINIDSTII

SEQ ID NO: 11996 - protein, 803 aa, Ferroplasma acidarmanus fer1
MNFYSHKWYENGNVKCRLLKTHLIEVGENVYNSLNELKFNGNVELLLKSSIIISCLHDFGKYTSFFQNYLMSDKDSKSKSDGYSKYKSHAFISALYAAYCASKNNLPNEYIFYVYLSIKHHHGNLCNLDSDIGTSTQDFLRPKISEDIKIAKKQLEDLKHEPIKKDMEDIFTFGSNHGVLLNFIDDFFKEDLTNIFNMLVKINKNRCLNNTNMNIDFSEFLLLYSLLIDNDKRNAASIKNYDRKDISPDIIDKYKNQNLSGKTEINKIRNNFYESVKKNVQNIDLNDHFFTITSPTGTGKTISGLYTAFSIRNKLFKNTGNIFRIIYTLPFTTIVDQNYDTGRNILETCSGFKNNDERYIIKHHHLSILSGKIDDEELSADEVLMLTEDWDSEIIFTTFVQLFSALAGYKNKNLKKYYRIINSIVILDEIQAIDIAKWPQIRYLMNYYAKKFNIYFILMSATLPELVNNSIELGGDYQKRFEELNRVNMHINILERLTPKEIVKKYMYHSETAKLFVFNTINTSIEAFNYLKENVSNDVNTYYLSSNIVPIKKKDVIDNINKDIKNNKKIIVVATQIFEAGVDISFDMVIRDIAPIDSLIQSSGRVNRNSFNTRGNMYIVNCVPEKNGYDGYYCRQVYGKIHTDTTIKILSDRKIVEEKDYLKLIKHYYNEINQNLIGSSENLQNALNKLDFNSKNRDEHYYVSNFSMIDDMDKYISIFVELDSNAMRIIDTYINRKSYERADIIQLKREMYNYIISARIEDIKNITCEKLYSDFYIIRNNYLENSYSNDTGLKKASDGSIVI

SEQ ID NO: 11997 - protein, 762 aa, Mannheimia haemolytica D153; identical to SEQ ID NO: 11977

SEQ ID NO: 11998 - protein, 762 aa, Mannheimia haemolytica D171
MEEHTIQSLYAHSGKLSDHSDWQTLLSHANNVGLLAAEFAAPFASQEIARCTGLLHDLGKYSERYQKRLHGGERVNHSTAGAKIAVERWGPLGKMMAFCIAGHHAGLANGSGEGKNRSTLTQRLQEQFGYGHKDLPVLDAIWQQELNLPEKLPLPPLKPSKNEPFFSYAFFIRMLYSCLVDADFLDTEAFYANLEKRPLERGNSPNLTALHQQFNQFIAQFRERITIQTPNTQEAQRKAEVNRLRSEILDYAVSQVKQETGLFSLTVPTGGGKTFTSMAFALEHAKQYGLCRIIYVIPFTSIIEQNAAEFRKAFGELGEEAVLEHHSTFDHDSLPDKSSRDKLKLASENWDAPVVVTTAVQFFESLFADRSSRCRKLHNIAGSVIILDEAQMLPLNLLRPIMAAIDELARNYQCSVVLCTATQPAIHQANGFYKGFENVREIAPNPTALFEKLKRTTVKHIGIQTDVELQSKLADNPQMLIIVNNRRHARALYDSAKQLEGAYHLTTLMCAKHRSQTLTEIRLRLKQNLPCRVIATSLIEAGVDVDFPLVMRAEAGLDSVAQAAGRCNREGKRLSVESNVWVFQPEEQWKAPPELGLLSGCMRSTVQVHADDLLNPKAINHYFQAVYEAKGKELDKPNILKACHDAGQSLNFPFQKIAEDFRMITSHLIPVIIPFDQEAENLIDRLRYADQVGGILRKLQPYTVQVPEKALAELYNAGRVETINETNFGKQFYCLIGMDLYDEVAGLSWENVDFLESEKLVL

SEQ ID NO: 11999 - protein, 762 aa, Mannheimia haemolytica D174; identical to SEQ ID NO: 11977

SEQ ID NO: 12000 - protein, 729 aa, Listeria monocytogenes
MQKYLAKSNPEETIQEHTDNLLKNYQRLKKLYPAVEIDWYLLELVCLLHDLGKMNLLFQTKLGNASGKGKEIPHGYLSVAFVPDSKLEEMGYSEDEIKVVYQAIARHHERKYDFSDSEWKKEIIKLEEQWAGFIYSQLGENAEYSSEVEMLYFYPGSRIFEGNSAADAETFKKYVLLKGLLNRIDFAASGGIDVELENDFLMDSMEVQLAHFKAENPEADWNALQKYMMQHQNENIVVIAETGMGKTEAGLLWLGNNKGFFTLPLRAAINAIYERITKNIVTTNQAERVGLLHSETYSQYLLHEGNAEMDIDEYYTRTRQMSLPITICTLDQLFDFVFRYAGFEHKLATLSYSKVIIDEIQMYSPDLLAYLILGLSYIDKFGGKFCIMTATLPGIVTDLLLENGVDFVQPEEKFVSSRIRHSMEMVHTEVESEFIKPFFNNNRILVICNTISKAKKIYSELKEHFQGEEIHLIHSQFIKRDRSAKEKAIFEDGQKDSTKKCIWVATQVVEASLDIDFDLLFTELSDVNGLFQRMGRCYRNRRLDVDTNVYVFDGGAKVCSGVGIDNFIDKLIFENSKTILNEHAGVLTEEKKMELVEQVYSTEALSGSKFYKELIRTINYVKAFESYLMNKADVRRRFRNINSVSVIPEEVWQDNAEEINSYFVTLRKTSKEISTKEKIIARTNLAEFMVSIPDYLYKKGESVVREINRYESVIEFKCGYSSDVGVFMR

SEQ ID NO: 12001 - protein, 729 aa, Listeria monocytogenes; identical to SEQ ID NO: 12000

SEQ ID NO: 12002 - protein, 762 aa, Mannheimia haemolytica USMARC_2286; identical to SEQ ID NO: 11977

SEQ ID NO: 12003 - protein, 759 aa, Amycolatopsis mediterranei RB; identical to SEQ ID NO: 11754

SEQ ID NO: 12004 - protein, 858 aa, Clostridium saccharobutylicum DSM 13864
MYFENIKIIDISTLLKEPSDIYSHTKSDILEYETLAEHNERCIKYFYKIVDVKNLDSVFNNFEQRLLKGCSSKCINLWKEIVLNTVFFHDVGKSNPGFQKEKMKNEKYKNIKVNNSNHSRASGIVFFNHYYNEVFAVNNDEAKVLFVFLCLSMYVINKHHSSLEDLAKNLQSINKDLKTPEKNMFANIIKDLNNFDEISDINELHYAFRHELESNTEWISLDMYIYTRFLYSLLVASDFYATSEYMTGAKIEHFGIIDDTKDYRTCLDNSAVGKCIGKYKDFKSGLCTNPYGICKGDMLNQLRTEIYLEADFNIDNNINADIFFLPAPTGAGKTNISINLALKLIENNPLLNKISYNFPFNNLVEQTKNSLYETFNENKKIKESISVINSITPIKEFSSTNDNDEVDFNKSLLSRQFLHYPVIVSTHVGLFDILFGINKENLFPLVHLCNSVIILDEIQAYKNSIWKEIIIFLKTYAKLLNIKFIIMSATLPDLTKLCNTNDGFISLIEDNSKYFTNPLFKDRVDIDYKMLNIDKENLFKALILKVIEVSKLLKKQADKFDNKILVEFITKSAAKDFYENLSTKVKDIHSNEEIILFTGDDSSIERKKIINHIKSSKNIILISTQVIEAGVDIDMDIGFKDISMLDSDEQFVGRINRNCKKENCKVYFFNYDDVTKIYKNDIRNSADYSLLSTKMRELFELKKFDIYYDYIINELNEAADSKNAKNIDFFRKNTLTDLEFYNIKKRMKLIDDQSKITIFLNINVEDENGNIFIGENVWNKYLSLLKNFDITYQEKQVELSKIREKVQYFTYEINDKYKGKFSYDIDKSIGNTFYINNGDDYITNGKFDRDKLINDLFS

SEQ ID NO: 12005 - protein, 863 aa, Clostridium saccharobutylicum DSM 13864
MYFNENYFINIDNLLSKKYSFYAHLKNDRKETLKEHTELCKNYFNKLVDSKGLDRIFLNFEEIYLKNTSEKGKLLFRELLMNTIVLHDIGKINPFFQSRKMGNNSIEYSEKFCIIDSQHSIISAVLYLDYFMDKVLKLEKDDKKCIRLFMFLNAYIISKHHGNLEEFKKFLSSFDDDEVGFKVMSIFNNTYKDIYLKDFSLSEVKMKKACNNTNNYLKKIDKEKAVYLYTYERLLYSLLVACDFYATTEFMNGVELNEFGEIAEISEFYDIYKSTSVYRNIRKYENEDYYKDRKDLKNEKNINILRNEMFLDAEKELSKKINEDIFYLEAPTGSGKSNVSINLSFKLFEDNPTLKKIFYVYPFNTLVEQNLNTLNETFGENEDVFNRIAVINSISPIKMDENSKKGVDNEDNYEYYAKALLNRQFLNYPIILTTHVSLFNSMFNSLKESAFAFHQLVNSVIVLDEIQSYKNIIWAEIILFLKGFAKILNMKVIIMSATLPNLNILTSSKESTATLIEDRNKYFSNSLFKDRVKVSYELMDEDDTINALLNHVIDNSYKKKKILIEFIKKESAYNFYRKVKESIDMNDRINCSVELMTGDDNSIERQRILKSIKSSNAEKEGIILVATQVIEAGVDIDMDIGYKDISKLDSDEQFLGRINRSCKRRGVVYFFNLDRTDGIYKNDVRVNTELSLLDDDMKRILVEKNFEDYYLPVLNLIQERFNNTFNDSNLEKFLIEDVGQLNTRKVEERMKLIEEDNWNMSIYLARIINKEEENTTVNIDGKEVWESYKDLLANNSMQYAEKQVKLSEVKSKMNYFIYQINKNSDLLYNDKIGELYYIKNGEKYFDGEKLNKDKFKREVGIFV

SEQ ID NO: 12006 - protein, 530 aa, Glycine max
MVVGQLVPSNLFLNRSAATRHRHLLCVSANDTTSTNNTDNGSPFSSFGRLKAQKVKTLLVHRRGKDQSHRRPVHLEDDDDYVATPRPRRSQSRTRGGERWDMIPNYTPPAQSKSVSDTKFFSLKSFKEIGCSEYMIESLQKLLFSRPSHVQAMAFTPVISGKTCVIADQSGSGKTFAYLAPIIQRLRQQELEGIISKSSSQAPSPRVLVLAPTAELASQVLDNCRSLSKSGVPFKSMVVTGGFRQKTQLENLQQGVDVLIATPGRFLFLINQGFLHLTNLRCAVLDEVDILFGDEDFEVALQSLINSSPVDTQYLFVTATLPKNVYTKLVEVFPDCEMIMGPGMHRISSRLQEIIVDCSGEDGQEKTPDTAFLNKKTALLQLVEESPVPRTIVFCNKIETCRKVENLLKRFDRKGNCVQVLPFHAAMTQESRLASMEEFTRSPSKGVSQFMVCTDRASRGIDFARVDHVILFDFPRDPSEYVRRVGRTARGAKGVGKAFIFVVGKQVSLARKIMERNQKGHPLHDVPSAY

SEQ ID NO: 12007 - protein, 855 aa, Clostridium autoethanogenum DSM 10061
MYFDDVELFNPEFFISNLDNMYAHRDRTDKTRREKLTDHINLTYKYFEFICSEKDLDNVFNNLQKDILEDRCEDVICLWKEMLANTIYMHDIGKINPAFQYANMLNKLYKDNSAGEKNHSLLGSYIYVSYFNGRINKIKKRYDRYYLKYFMYLNSYIISRHHGFLGSIEGYGEKLKNFSENYKKETYYPDLNMDVLGERVIYKSFCNSQEYIKDCFLANSKLDFTLYIYSKLLFSILTAADYYATSQFMNGEKVDDMGIMDDELKKRFSRDVEDYDILKSIRSYEKNPVIDGKYSNINQLRSKITLESEKSYLKNRNKNIYYLEAPTGAGKTITSINLVRHMLNSNEKINKLFYVFPFNTLVEQTESAFIKIFKNDSKIRESISVINSITPIKTVDKDYEVESDLDSGRKTDYEKSLLNRIFINYPFVITTHVNLFNSLFGTSRKEVFPLINLCNSIIILDEIQSYKNEIWKEIINFLDSYSELLNIKVIIMSATLPRLNKLVEGNSNDFIYLIEDRNKYFKNPYFKSRVKFEMLDLGDEEEQFEKLSRDIQAESRDNGKILIEFIFKKRADRFFDYMNKNFENKYGHEIKIMTADDNKIDRGKIVKMARDKEKKIILIATQIVEAGIDIDMDLGYKNISILDAEEQFMGRVNRSCLKKGRVKFFKIDDCRVIYKGDVRREKELTLIQSEIQKLLGEKDFEKYYEKVIEKIKLKKQESNDHGYEAFTKKLDSMNFKAVQDYMKLIDEDQNKYTVFISREIKLGNNDVIYGDDIWKEYKDVLMDKSMGYAEKKVKLSKITPNLGYFIYKVKEIPTEYSDMLGDIYYISDGEKYIRDGRFNQEIFIGEAPDEANLFM

SEQ ID NO: 12008 - protein, 876 aa, Haloarcula hispanica N601; identical to SEQ ID NO: 11867

SEQ ID NO: 12009 - protein, 761 aa, Thermosynechococcus sp. NK55a
MPPRFTPPKLEPDILLAKSSLPGNPDWGEDHDLVGHTAAVVKSITTLVHSLGSNLLQQFGLGDRHSSFATLEATARLAAYLHDWGKANHQFQGVVRYSLIGSNPSVSPQRNPLERPQLIRHEVGSVLLAWEFREWLVQCPNADFMTAIAAAGGHHLKLGGKDGKDTGKLVEVREGSGDTCLHWYVKHPYFCKLIHYGVRTLGLPQDLPLSQFSQQWEIKTIKDKGEKVLDAFIDEWEPDAAFVAVVKALLVAADAIASASGQMAISLQQWIEDVLKQTLTEADLQTVINTRLCGHSLRPFQTDLANTPQRVTLARAGCGSGKTLGAYCWAQKHAIGRKLFFCYPTTGTSTEGFLGYVHNKVESELLHSRSAVDLELACTGEEVNNGDGSVNETAQKLEAFKAWDAKVNICTVDTVLGLLQCHRRPLYCFPAIANAAFVFDEVHCYDEALFGALLRFLKVVKAPILLMSASFLPTQVEAIKEAVGEPVEVVQGPQELEDLPRYRFHQLTEPDWEWVQQELAKGGKVLWVCNQVDTAIAVYQQAKARGLRPFLYHSRFRYGDRVDRHRAVVDAFKQDQPILAITTQVAEMSLDLSATLLVSQIADPAGLIQRLGRLNRQYCGHPRDALFYPDEKTGFPYSQDQLKAGEALIQKFAAQEVSQRQLAAWLENLNIQHTPKDHFVWLDGKWKTYPAPLRKAGYTVTALLEQDQPTVAQLKWSELARYTVPLPANNIQGWQRHRRGYLIAPQEQWGYDSELGAFALK

SEQ ID NO: 12010 - protein, 762 aa, Salinispira pacifica
MNMDFVAHVKQDNSGNWAPPHELHEHLVDVAEKAAKFASRFGNQDWAKIAGLWHDLGKYKPDFQQYIRKVSGYMNEINTEGGAGRVDHSIVGALLAKRKFGKEGENFAKILGYIIAGHHAGLPDWDHSPNIGGALSGRWTEEHHLDKALQSPIPDEFINTELPSSMPCNLVQNQEADTLMEENLHLWIRMLFSCLVDADFLDTEAYMSPDSANQRGNYALSLTKLKQNLDIYMYQLSESAEETTVNQIRKSVLSQCRERANEKPGIFTLTVPTGGGKTLSGMTFALDHAVTHKMDRVIVAIPYTSIIEQTAEQYRKVFGNGVVIEHHSNLNPDTETNRSKLASENWEAPIIVTTNVQLFESLFAARTSASRKLHNIANSVILLDEAQMIPPQYLQPIISSMRGLIKMFNCSIVLSTATQPVLSENIDAGSEVLHGFNSADVTEIIKKPEELSRQLQRVRIKIMKDGLEKTSWPEVAEAMDEFDQVLTIVNSRRDCKQLFDLLPNGTIHLSALMCPQHRSVVIRTIKDKLKANSPLRVVSTQLVEAGVDIDFPVVFRAVSGFDSIAQAAGRCNREGKLPHLGTTYIFQPERDAPPGLLRKGQYAGQDILQACPELVERLDPEVFRKYFTEFYSKLNSFDEKGIMALLAGERTRNFQFQFRSAAEKFCLIDNSEQRPIVVWYQDGEKLVEKLEFLGPNRTILRKLQRYSVSVPLPVSRKLELNNFIRPVKGMDGLYVQSATNLYSEVYGLNMDGPELSVQDYMT

SEQ ID NO: 12011 - protein, 827 aa, Paenibacillus polymyxa CR1
MQYIAHIRESDQEIQTVAEHLLETRQLAETYGDKIGIRHITGLAGMLHDLGKYTEKFQNYIRLAVQNPDNPPKRGSVDHSSAGGKLLFNLFHIQPKGTFDKQDLFIKYVLTEVVANAIISHHSYLQDFLNPQLESRFLYRVRDLEIEGFEDAVTLFYEQVMEESTFFDYVNQAKAELDQYMNRDDEADFELKLMYLSKFVFSALIDADRTNTRCFEENKNTGDKIAVEAMNYQKLFHEYYEKLMMHIKSLQAAKDANTPINLLRKEMSEQCEQFAERPSGIHTLSIPTGGGKTLASFRYALKHAVTFKKKHIIYVVPFTTIIEQNAREVREIIVDDANILEHHSNVVMDDVEEGESNELEDVVVSTRQKLKLAKDNWDSPIIFTTMVQFLNVFYAGGSRNIRRLHNLSESVIIFDEVQKVPTHCISLFNQAVNFLKTYAHSGIVLCTATQPELDFVHNKLEIEPDAEMVHDLNHVIEAFKRVEIVDKATDMKFNTEKLADFVEERLADEQSVLVILNTKTVVKNLYHRLKEESGTVPIYHLSTSMCPAHRNSILEKVKNHLQHKEPVVCISTQLIEAGVDISFKCVIRSLAGLDSIAQAAGRCNRHGEDRMKQVYVIDHEEEDLKRLKEIRIGKEISRKMFIDLKRNKTCLGGNVLSAQSMEIYFQKYYSELKTDLNYFIPKLRKNMTELLYANRIENTYFQSYCKENETILPLFLANSYRTAADHFQVIEDHTTAVIVPYGDGEKEGKEIIADLNGQQSIEDLTDLLRRAQQFTINIFNYEKDRLDQNKGLVSFLDGKIYALTDGAYDDSYGLNLENDSLHSRFIL

SEQ ID NO: 12012 - protein, 707 aa, Pseudomonas sp. TKP
MPVLVHADQDVIIAAATAAGKTEAAFLPILTNLLNNDDPPGAVLYISPLKALINDQWDRLSRLCEQLEIPVVAWHGDVSSSKKHRFLKSSEGVLLITPESLEALFVNRGSSLGGVFQHLRYIVVDELHAFIGSERGKQLQSLMHRVELAAGRRLPRVGLSATLGDMQMASAFLRPANADNVTVIESKNANQTLQVQVRGYIQPPMSELKKKPAQPNEHEGNEDETENEASPDFAIAEHLYQVLRGSNNLIFPNSRSQVEWYADQLRRRCEKDGVPNEFWPHHGSLSKDLREQAEHALKAGDRPASAICTTTLELGIDIGSIKTVVQIGAPPSVASLRQRLGRSGRRPGEKATLRVYCKESPLTDKSGLSDQLRQGLVQTIAMVRLLTRGWFEPPRAQGIHASTLVQQCLSIIAQCGGASAADLWKNLIAEGAFQGIEKPDFVKLLKSLGEHELIVQDSSGLLLPGTVGERMINHYEFYSAFTSDEEFRLVCDGKALGSVPVSRPLTKDQRIIFGGRRWQVRDVDLQAKVIIVSAARGGAPPQFDGLGAMVHDAVRAEMRAVLADSSPCPFIDHGAKALLEEARKTFALLGLGERYLIESGGKCYLISWLGDYANDALRLLLNHAGLFCDNSGLAIEIDANIDQAKEALAVVGGLDPSDLNSILEDVQNMLREKWDWALPESLLVKSFASISLDISTAVCFAQRQSMS

SEQ ID NO: 12013 - protein, 589 aa, Sulfolobus acidocaldarius SUSAZ
MRLGVDKFWDILNCRDSDKKINDRKLSECKDVNFILNFPTGYGKTTLSLTLAKYLKENVTTTFSRIIHVVPTKTLIWDIEEKAREAQLSYGVQYSFAPSETKTPNFLADFVITTYDSFLMNLFKGSVGEPFSVHGHYDIPRFSIFTSIVHFDEYHLMREGNSWASLLASVSVLARHGVNMILSSASSSKAIDSEIVKNIAKWGKEVVKIEVVRNFGDAEKKYNCREIGERGEEEKDEIREYECDLDNDINFTLVEIADKEFRTPYVPIEVIKKEKLEEIVNAHKDEKILIVMNTVDGAIEVYEKLKQKYEDVSLIHSRFKEKDKRGKGFKRIVVATQVIEVGVNLDYDVLITEQAPIFSLVQRAGRILRNREGEGRIYIIEDDKYYPYSKEEVERTMNEIKGKNGIICFKHPYGCGNAEGYSEIIERVYNTVPFDYKQRELYDKLTHLDFNFFSTKQQLKEILSDYCSLTDSFVVSLATEIPKSHDDLISVDGDYFLRSIEDQECVKAFFEKFSVDEGNGVDTVTVVEDCFPRRYLRDRRCLCSNYTNVFVKKGNGELTPYYGNGKEKYMLVAFHVDPRNYNEELGLRL

SEQ ID NO: 12014 - protein, 750 aa, Marichromatium purpuratum 984
MQAPKDCECFAHSTDSDRVADWQPLAEHLHAVARLAAARAAPFGCETLAEAAGLLHDLGKYTTDFQRRLAGEAVRVDHATRGAQLALERYPGLGQLLAYVIAGHHGGLANGAESGERTALRERLARDGLPPLLEVWRHEIALPETLARPPLVAHSRERGMFQLSFLVRMLFSCLVDADYLDTEAFYDRVERPPGVRRETLRAAPSPSLAALRDRLDAHLQGFAASRPVDRLRGDILDHVRGQAALPPGLFSLTVPTGGGKTLTSLAFALDHALAHGLRRVICVIPFTSIVEQTAASFRAALGELGETAVLEHHSAFVPSATDEGRASRDKLRLAMENWDAPIVVTTAVQFFESLFAARPSQCRKLHNIAGSVVILDEAQTLPLKLLRPTVAAIDELARNYGCTLVLCTATQPALNAPEFRGGLDEVRELAPDPPALYRRLERVRIGHLGEVDDAALVARLQGHAQVLCIVNNRRHARALYQAIAEQPGACHLSTLMCARHRSEVLAEVRARLDRGAPCRLVATSLIEAGVDVSFPVVYRAEAGLDSIAQAAGRCNRHGEDRAEDSPVWVFAPAGDAWAPPPELKQFAQAGREVLRRHGEAPLAPAAIDAYFQLLYWQQGDEALDRHDLLGLLRRSRPDGLPLETLAACYRLIETTQVAVIVPYDEAARGALAALEHVPRCGGVARRLQPYLVQVPGRALAELRAAGAVQPVAENRWGEQFLALMNPDLYSPDFGLWWEEPTFVSTANTII

SEQ ID NO: 12015 - protein, 895 aa, Halobacterium sp. DL1
MVDFTDRPSHIGPDGEQIPLEEHLDDVRERVGWLVPDDAETPEGNSLSELAEVVTRVHDFGKLTAWFREHLLSDDAQPTGPKHHAPISALLAHYALEARGFDGADQLVGFLAVARHHGRLPDTADYVHRASVEQSGRIQTLYRSDALEQAAHIDETVPELAEALVDRATGGAGDWETFHERLADSDAAIELPWVAEAVCSGRRLRPAPEKLPPSFYESVLQVWSALVFADKASATYLSTGIEIGRKAYRSPTPGRLEIDAYIDELQTENAETELDPRTEQMNERREDARQEVHARAKEFVDDDRNVATLTLPTGMGKTLTGLDAALTVLEGSEMASNPNEGRLVYALPYTSIIDQVAEQSRELFGTRERGERLTVDHHLADTLVSPPDEPESVADDAVENVAALLGESWRSGMVVTTFVQVFESLAGPTNARSMKLPSLYGSVVVLDEPQALPLEWWPLVDRLVELLTEEYGASVIAMTATQPELLSAGDREPFSLVADPDPYYDELDRLDFVLHPSAIAMLPGQDSEESDTIDDDAESAALSYDRAGDLVATRADDGDSVLAICNTIDSARELAESIADRTIPVDVNEVYDELLNDADESTESIPPKRTSADAARRRRSGQPLLVHLTTRHRPCDRRHLIDVASDLAEAGEPVLFVSTQLVEAGVDVSFDEVIRDFAPMDSLVQAAGRCNRSYGRNRGRVTVWQLAPPPNRETTPASAVYGRGESLTKLTGQALATVYDGDPMPEPDVTRNAVEHYFDLLDGRDVGADEYVEYLERAEAEELGRLSLIDERLAVDVIVTRTADERETVEEIRRAFGEYRWDDLDDLVESTADWQVSVPVYPGDDDTMEKLAACEPLFPDTDRLVLDGRPGRHDGYFDATDGVVIPDTSVEARLL

SEQ ID NO: 12016 - protein, 762 aa, Mannheimia varigena USDA-ARS-USMARC-1296
MKEHTIQSFYAHSGLLEDYSDWQTLLSHANNVGLLAAEFAAPFASQEIARCTGLLHDLGKYSERYQKRLHSGEKVNHSTAGAKIAVERWGQFGKMMAFCIAGHHAGLANGSGEGKNRSTLTQRLQEQFGYGHKDLPVLDAIWQQELNLPEKLPLPPLKPSKNELFFSYAFFIRMLYSCLVDADFLDTEAFYANLEKRPLERGNYPNLTALHQQFNQFIAQFRERIAIQTPNTQEAQRKAEVNRLRSEILDYAVSQAKQETGLFSLTVPTGGGKTFTSMAFALEHAKQHGLRRIIYVIPFTSIIEQNAAEFRKAFGELGESAVLEHHSTFDHDSLPDKSSRDKLKLASENWDAPIVVTTAVQFFESLFADRSSRCRKLHNIAGSVIILDEAQMLPLNLLRPIMAAIDELARNYQCSVVLCTATQPAIHQANGFYKGFENVREIAPNPARLFEKLKRTTVKHIGIQTDVELQSKLADNSQMLIIVNNRRHTRSLYDSAKHLDGTYHLTTLMCAKHRSQTLEEIRLRLKQNLPCRVIATSLIEAGVDVDFPLVMRAEAGLDSVAQAAGRCNREGKQLAETSYVWVFQPEEQWKAPPELGLLSGCMRSTVQVHADELLTPQAINHYFQAVYEAKGKELDKPNILKACHDVGQSLNFPFQKIAEDFRMITSHLIPVIIPFDQEAENLIDRLRYVDQVGGILRKLQSYTVQVPEKALSELYNAGRVETINETNFGKQFYSLIGMDLYDEVAGLSWDNVNFLDAEKLVL

SEQ ID NO: 12017 - protein, 762 aa, Mannheimia varigena USDA-ARS-USMARC-1312
MEEHTIQSFYAHSGKLSDHSDWQTLLSHANNVGLLAAEFAAPFASQEIARCTGLLHDLGKYSERYQKRLHGGERVNHSTAGAKIAVERWGPLGKMMAFCIAGHHAGLANASGEGKNRSTLTQRLQEQFGYGHKDLPVLDAIWQQELNLPEKLPLPPLKPSKNEPFFSYAFFIRMLYSCLVDADFLDTEAFYANLEKRPLERGHYPNLTALHQQFNQFIAQFRERIAIQTPNTQEAQRKAEVNRLRSEILDYAVSQAKQETGLFSLTVPTGGGKTFTSMAFALEHTKQHGLRRIIYVIPFTSIIEQNAEEFRKAFGELGEEAVLEHHSTFDHDSLPDKSSRDKLKLASENWDAPIVVTTAVQFFESLFADRSSRCRKLHNIAGSVIILDEAQMLPLNLLRPIMAAIDELARNYQCSVVLCTATQPAIHQANGFYKGFENVREIVPNPAALFEKLKRTTVKHIGIQTDAELQTKLTDNPQMLVIVNNRRHARSLYDSAKHLDGTYHLTTLMCAKHRSQTLEEIRLRLKQNLPCRVIATSLIEAGVDVDFPLVMRAEAGLDSVAQAAGRCNREGKRLAVESNVWVFQPEEQWKAPLELGLLSGCMCSTVQVHADDLLTPQAINHYFQAVYEAKGKELDKPNILKACHDAGQSLNFPFQKIAEDFRMITSHLIPVIIPFDQEAENLIDRLRYADQVGGILRKLQSYTVQVPEKALAELYNAGRVETINETNFGKQFYSLIGMDLYDEVAGLSWGNTTFLEVERLVF

SEQ ID NO: 12018 - protein, 809 aa, Mannheimia varigena USDA-ARS-USMARC-1388
MKNEYFAHIRKSDEVIQSVLTHLLETAQIARILATKLDLAEAGELLGLMHDFGKYSEKFQKYIRRVTGMLNQADLDSEDETNGGDHSTAGAQWIYRRLIKYGSNGIGELCGQILGLCIASHHGAGLIDCLSPEGRAVWRDRFNKDDKDAHLSECAQKADKSILERAEQLASESLIQSLRKPIAAILSQQDVPFKIKELYLACLTRFLFSCLIDADRINSADFEREAQKEIRRFNEKPNWQQAIEALENHLSRFEIKYPIDQIRRNISKDCLTRAGDKQGIYSLTVPTGGGKTLATLRYALHHAQTHQLDRIIYIIPYTSIIDQNAQNVREILGDDWVLEHHSNIEPEKQTWQNKVLSENWDKPIIFTTMVQFLDAWFSGGTRGVRHIHAMTRSVLIFDEIQTLPIKCVHLFSNVLNWLAQFGKSTAVLCTATQPLLNQLKKPELGQVKLAENAELMGNQQNLTALFDDLSRVEIHYRSQAGGFSLENAGEFLLEQFKLHSSCLFIVNTKKWAQDLYRYCQEHHIPQDALFHLSTNQCSAHRKVIFEQIKDRLQNKEPVICISTQLIEAGVDISMACVIRALGGLDSIAQAAGRCNRHGEKEGKGQVYVLNLKEPNLEEVLPDITIGQDKAVRVFGEYEGKDILQPAAMTQYFKYYFHDRSDEMVYPLKNSTSGSLLDWLSDNCHNVYTPKNDRRTQPFPLLMQSFKSAGREFQVIDAPTQAVIVPYGEGKEIITTLCSVEDNKKKYEALAKAQRYSVNVFPNVWRKLAEAEALQETQAGSGIYYLDERHYLDEYGLCTDRAGNMTCYDF

SEQ ID NO: 12019 - protein, 820 aa, Bibersteinia trehalosi USDA-ARS-USMARC-188
MSKTEFIAHVRKSNKQLQSVSNHLLETASIARTLAAKLDLADAGELLGLMHDFGKYSKKFQTYIRHVTGILTYADLDSEDENNGGDHSTAGAQWIYGRLRKLGAAKNADGKIIGIGELVGQILGLCIASHHGAGLIDCLSPEGSEKPKWRERFDKDDKLTHLSECEKNADAVIINRAEELVGIDLVRLVDKPIRAILNQKEIPFKLKEFYLGCLTRFLFSCLIDADRINTSDFENERQKEIRNLTNTPNWQKAIDKLESHLSGFSIKYPIDGIRREISESCLERSTDQQGIYTLTVPTGGGKTLSSLRYALHHAKLHNLDRIIYIIPYTSIIDQNAQAVRKILGEEWVLEHHSNIEPDQQTWQNKLLSKNWDKPIIFTTMVQFLDAWFGSGTRGVRHIHAMTKSVLIFDEIQTLPIKCVHLFCNVLNWLTHFGKSSAVLCTATQPLLNSLKNPHLGQIQLADNAELIGNQFKIRELFDKLSRVEVNYCPQTGGYSLENAGEFLLEQFGQYSSCLFIVNTKKWAQDLYRYCQNRNLPQEALFHLSTNQCSAHRKTIFDKIKARLKNKEPVICISTQLIEAGVDISMACVIRALGGLDSIAQAAGRCNRHGENKGKGQVYVLNLQEPNLESVLPDIYIGQQQSERVFNDFEGQDILQPNAMSQYFDYYFYNRSNEMGYSLPNNYSGTLLDWLSDNAQNTYVPKNNQRKTVFPLLMQSFKSAGKLFQTIDAPTQAVIVPYENAKELIATLCGTDDNEKKYKALSQAQRYSVNVFPNVWRKLQEKKAIQETQLGSGIFYLKDRHYTEEYGLSIEETGNLTFYDL

SEQ ID NO: 12020 - protein, 787 aa, Bibersteinia trehalosi USDA-ARS-USMARC-189; identical to SEQ ID NO: 11970

SEQ ID NO: 12021 - protein, 757 aa, Bibersteinia trehalosi USDA-ARS-USMARC-190
MKTYYAHSSEDIDYANWQPLKVHADNVGKLAAKFAYFFGVQEIAYYTGLLHDLGKYSERYQKRLHGGERVNHSTAGAKVAVDRWGALGKMMAFCIAGHHAGLANGSGEGKNRSTLTQRLQEQFGHGHKDLPLLDPIWQQELHLPEKLALPPLKPSKNEPFFSYAFFIRMLYSCLVDADFLDTEAFYANLEKRPLERGNYPHLTALHQQFNQFIAQFRERITTQTPKAQEEQRKAEVNRLRSEILDYAVSQAKQETGLFSLTVPTGGGKTFTSMAFALEHAKQHGLRRIIYVIPFTSIIEQNAAEFRKAFGELGEEAVLEHHSTFDHDSLPDKSSRDKLKLASENWDAPVVVTTAVQFFESLFADRSSRCRKLHNIAGSVIILDEAQMLPLNLLRPIMAAIDELARNYQCSVVLCTATQPAIHQANGFYKGFENVREIAPNPAALFEKLKRTTVKHIGIQTDVELQSKLADNSQMLIIVNNRRHARALYDSAKHLDGTYHLTTLMCAKHRSQTLEEIRLRLKQNLPCRVIATSLIEAGVDVDFPLVMRAEAGLDSVAQAAGRCNREGKRLSVESNVWVFQPEEQWKAPPELGLLSGCMRSTVQVHADDLLNPKAINHYFQAVYEAKGKELDKPNILKACHDAGQSLNFPFQKIAEDFRMITSHLIPVIIPFDQEAENLIDRLRYADQVGGILKKLQPYTVQVPEKALAELYNAGRVEAINETNFGKQFYSLIGMDLYDEVAGLSWGNVEFLRTEELVF

SEQ ID NO: 12022 - protein, 787 aa, Bibersteinia trehalosi USDA-ARS-USMARC-190
MAAKLDLADAGELLGLMHDFGKYSKKFQTYIRHVTGILTYADLDSEDENNGGDHSTAGAQWIYGRLRKLGAAKNADGKIIGIGELVGQILGLCIASHHGAGLIDCLSPEGSEKPKWRERFDKDDKLTHLSECEKNADAVIINRAEELVGIDLVRLVDKPIRAILNQKEIPFKLKEFYLGCLTRFLFSCLIDADRINTSDFENERQKEIRNLTNTPNWQKAIDKLESHLSGFSIKYLIDGIRREISESCLERSTDQQGIYTLTVPTGGGKTLSSLRYALHHAKLHNLDRIIYIIPYTSIIDQNAQAVRKILGEEWVLEHHSNIEPDQQTWQNKLLSENWDKPIVFTTMVQFLDAWFGSGTRGVRHIHAMTKSVLIFDEIQTLPIKCVHLFCNVLNWLTHFGKSSAVLCTATQPLLNSLKNPHLGQIQLADNAELIGNQFKIRELFDKLSRVEVNYCPQTGGYSLENAGEFLLEQFGQYSSCLFIVNTKKWAQDLYRYCQNRNLPQEALFHLSTNQCSAHRKTIFDKIKARLKNKEPVICISTQLIEAGVDISMACVIRALGGLDSIAQAAGRCNRHGENKGKGQVYVLNLQEPNLESVLPDIYIGQQQSERVFNDFEGQDILQPNAMSQYFDYYFYNRSNEMGYSLPNNYSGTLLDWLSDNAQNTYVPKNNQRKTVFPLLMQSFKSAGKLFQTIDAPTQAVIVPYENAKELIATLCGTDDNEKKYKALSQAQRYSVNVFPNVWRKLQEKKAIQETQLGSGIFYLKDRHYTEEYGLSIEETGNLTFYDL

SEQ ID NO: 12023 - protein, 664 aa, Borrelia hermsii YOR
MNDFCLPIYKYKDELIKKLKTNNVLIVESPTGSGKTTQIPRIIYEAGLAKLGKIGVTQPRRIATISIAEYIAKHIGVNLGEEVGYKIRFQEITSPKTKIKLMTDGVLLQELKKDTLLYEYDVIIIDEAHERSLNIDFILGLIKDILKKRNDFKVIISSATINTKVFSKYFNNAPILNIETITYPVQIIYNPPLLNTSKSMILKIKEIISGIIKEKKEGDILIFLSGEKEIKETIKAIYELNSKQDLVILPLYGRMAKEAQEQIFMPTPKNKRKIIVSTNIAETSITIENIKIVIDSGKVKTNKFQMKTHTYSLQEVPISKSSATQRAGRAGRLSKGTCYRLYKRDEYQLRDEYQKEEIYRTDLSEVILRMADIGIRNFTKFDFISKPSIKSIQTASDILKSLDAINEKNELTEIGKYMIIFPLIPIHSRALVEAMMKYQKAIYPTTIGLSFLSTSGIFLLPQNEEIEARQAHLKYKNPLGDLIGFINIFEDYKKAINKEAFAQENYLDLQGLEEITNVQRQLENIVSSFNIPIVHTHEIDQEGYLKSIMRGMKDYICFKTLKTKYKTIKAQNVVIHPGSLINTDSVKYFVAGEIIETSKRYARSIGVLKKEWINDIQFEENEHKNTQKENKKLNNIHKNITKKDKKPVLENEITIGGKKFKTQK

SEQ ID NO: 12024 - protein, 828 aa, Borrelia crocidurae DOU
MNDFGLPIYKYKDDLIKKLSTNSVLIVESPTGSGKTTQIPRIIYEAGLAKLGKIGVTQPRRIATISIAEYIAKHIGVNLGEEVGYKIRFQEVISPKTKIKLMTDGVLLQELKKDTLLYEYDVIIIDEAHERSLNIDFILGLLKDILNKRNDFKVIISSATINTKIFSKYFNNAPILSIETITYPVQIIYNPPLLNTSKSMILKIKEIIAGIIKEKKEGDILIFLSGEKEIKETIKEIHALNLKKDLIILPLYGRMAKEAQEQIFMPTPKNKRKIIVSTNIAETSITIENIKIVIDSGKVKTNKFQMKTHTYSLQEVPISKSSATQRAGRAGRLSKGTCYRLYKRDEYQLRDEYQKEEIYRTDLSEVILRMADIGIKNFTKFDFISKPSIKSIQTASDILKSLDAINEKNELTEIGKYMIIFPLIPIHSRALVEAMMHYQQAIYPTTIGLSFLSTSGIFLLPQNEEIEARQAHLKYKNPLGDLIGFINIFEDYRKAINKEDFAKENYLDLQGLEEINNVQRQLENIVSSFDIPIVHKNEIDHEGYLKSIMRGMKDYICFKTSKNKYKTIKAQNVVIHPGSLINTDSVKYFVAGEIIETSKRYARAIGVLKKEWLNNIQFEENKNIPQKETKQSHHSHKNDILHKEKKDSIKKEIKIGGKKFYIQNEYKNQLTFSLKEIKQLISKGLKNKEEKAIKNVLAKLTYENLVIFKNKKLIEIMRIVNGMEPNWTLLKTYENTNVNINEIDKIKNILECTMNFIQHPNKKSVLFLSLRSDYADNFWLKPQKSFIVAIEESMDSIKSLIDNQDNITKLTSIKKTINKVYKKLNFFF

SEQ ID NO: 12025 - protein, 573 aa, Kutzneria albida DSM 43870
MGGVSSIGFDELVGRAFKQDVEPYAYQRALAVEGFPQVLRVSTGAGKTAAAVLPWLWWRRFHPDKSARDATPRRLVVVLPQRALVEQTVDKATSWLDNLGLTGVEDGVGVHVLLGGASTDEQAWMMAPERDAVLVGTQDMVLSRLLMRGYAQQRASWPISFGLLHADSLFVFDEVQLMGPGLPTSLQLEGLRTVLDTGLKSRSMWMSATVDPAELATADHPVPTTVLGLSEQDKAGSLRARLEGTRWVEHAELPTQPARYPRTVAELALARHRPGTRTLVIVNTVDRAVAIHRALTTLGPAPSVVLVHSRFRPGDRATHLDAVLAAPTGAGTIAISTQVLEAGVDTSAAVLITEVASWPSIVQRAGRCNREGTDHDAQLLWMRPPGKGFAAPYREDDLTHAEEALRAWEGVAVTAGQLMEKDVPQYRPVWSELRRWDLVELFDTTPDVHGNDVDVTRWIRDAEDLTVSVAWRPIRDTDISEWRFPAREELCPAPVTAVRERLARPGQLARVYDRTDSTWRSATAADVRAGAVLVLDAGQGGYDPQTGFAATSTTPGARTHTALRGRRLTSVIA

SEQ ID NO: 12026 - protein, 809 aa, Lactobacillus helveticus H9
MNEYLAKSLDQSEGNHCETIVEHTNNLLKQYSLLKQAYPDIFQNFWLSQDRFNDMTKQVDIRSKDDWRLLEIACSYHDLGKMNLRFQKKVKAGQSFCKGEIPHALLSITMLPIDELQKHYTKDQIIALIFAIKWHHERNFSEIDEKHYEDEIEALKKEFASFDYSKLSFPIPPQEPAKVDSKYLTGNLSHRLSPNYEPKIYDEFVILKGLLNRIDYAASGHYEIESKSRVCLSQNILQEWHKKNPVADWNELQKYTYDHRNESIVVVGQTGLGKTESALRWLDNSKSFFVLPLKSAINSIYDRISGIVFQNKSHENLALLHSDMMAKALSEKFDDEDNFEEFVNEERSWSKQLSVATLDQIFNFVYHYKNYEPKLATLAYAKVVIDEIQMYSPDLLGYLIYGLGEIQKFGGKFEIMTATLPPFLIDLLESNGLEFKQAPHPFLDPKVNHRHKVKVLHKQINSDDIINLDRHQKTLVVCNTVKSATELYSELKQKGVSDVHLIHSRFIRKDRNEREKEILEFGQKENHSSGIWIGTQVVEASLDIDFDMLITELSELCGLFQRMGRCYRKRNYEGKEPNVYVFDGGDKLTSGIHESKQEYDDKRYHSVVDYHLFEISKRALAQVDGYLTESDKLKLIDENYTTDKLLDENCQLIDKVNDCIDYLNDLTFLDNLKTKEEVVNTFRNINTIDIIPEQVFLENEDKLEAAAKALNNYIRREDFLDQTEYKKQHQILVKEKIKAREVINNYLVGIPLYIINKVSKQDRWIKDKALNEVGYNILPADFNYDSMTGLSYNDNKNKNAEIDDDDNIF

SEQ ID NO: 12027 - protein, 810 aa, Sulfurospirillum multivorans DSM 12446
MFYLVRATIMLLSDFGIDERFFAHTRGSDKEMLSTHLNLTCNYYQKIVTCKNLEPLIDSIIHTIDSANAVLIKEMFENAIFLHDLGKKNPCFQAKKMLNPLFKEHLNCGDSSHSRTGALEYISYYRPTINQIKDDTSFYRLTYILYNFAYHIDKHHGYLGNIESYCSKTTKEQNDHPDFNNIKNNIDEYLDNKFEFYILNKLLFSLLVSSDYYATTDYIAGLPIDDFGVFSSSAKQRLNELFSTFTCKLENPVGINKLRIELFQEAEQNLLKNLDKNIFYLEAPTGSGKTITSINLALKLLESNEHINKLFYIFPFNTLVEQTKNVFDEIFKNKLTIEVINSITPISTKDQEEEETKYEKSYINRLFFHAPAIITTHVALFNILFGTSKEDNFPLWQLANSVIILDEIQSYNNHLWHYMVEFFDQYAALLNIKIIIMSATLPKLDYFLKEKNNFVDLISKEKREYFFTHTLFKDRVQADFTFLNETMTFEHLEEILKAQPKSKKILFEFIKKKSAREFYTRIKATYKNVYELSGDDNKAYRQLIINKSKEDMPLIIIATQVIEAGVDIDMDIGFKDISTLDSEEQFMGRINRSCKREGKVYFFNMDEASEIYCNDHRLNFDLTHEIYRDILANKSFGVYYQEVLAEIKKSSDRFENGLLTNYDNFTTLLKKLNYKEIAKTMTLISSNNFTLYFPFKIDIAQYKGVQEFAPKNLEERFLSDGYLDGQKVWDAFLALNEIDGFAKKEVAKSRINALMQFFTFTIFKNHEGQRPSIGDEMYGYYFVQEYGNFITSEGKFDREQYNAIKNSHFL

SEQ ID NO: 12028 - protein, 807 aa, Bifidobacterium breve JCM 7017
MPKDLLLARKDDDGNTQTLYDHLHNTSKLAAGFEKRSSVTAFAAGLLHDSGKATDDFKRYLLTGNRKRGEVVHAKQGAFIVDDCAADFPSSAASMITAEVLELAIANHHGHLPDCLDACGGTAYFRKLTGENKKAEQYHYQEVLSHVSSLNLDINTNFANSVAETNRLLETVDSCGISPRNTRNSRSFFLGLYAKYIYSRLVDADRVDAANFTAHQPYTSQTPNWEELTRRLENAISGFDTSSKISKIRMRISEDCLAASTRDTGIYRLGVPTGGGKTLASLRFALHHAQETGKHHIIYITPYLSITEQTVQVFRNVLDLDKDDEILLEHYSSVVPDKDDEKEQQRRLAAERWDKPIIVTTMVQFLETVMSAKATKLRKFHNLADSVIVFDEVQALPTNTINVFNEVVSFLSKILGSTILLCSATQPLLEQTDRRNLLLSDKPDLIDPDNDYAEQLRRTNIVASSQGLTLDDFAAEIYSKALDNGNCLAVVNLKGEAKQLYQLVKELDVDHRFTLVHLSTAMCGAHRKNQLAVLKKCLPKKTGDSGQPVICISTQLIEAGVDISFSCVIRAMAGLDSILQAAGRCNRNGESQMPRNVYVYPIKDESGLRYLPEIQLGKEITDQLIHDYPEQDLLSAFMIEEYYRAYLIRYPKLVDSKSRNIGTMDYSILGGEETVYDLLSFNRRRRGLYCNRVGEQYPYAFAQAFQTVGDNFHVIPGGTTDVVVHYGQAMELIDQLNGEGDFASKIKILRSLQEYTVSLFDYEFKALDKSKSISEANGDFGILVLNEENYSQDFGFLLKAEMPLLMK

SEQ ID NO: 12029 - protein, 800 aa, Bifidobacterium breve JCM 7019
MCATYYARTSDHGYETCAEHLAMAGCLAGGFAKGFGYLDDGLLAGLVHDLGKYSDAFQRRIRNPDHCGPVDHSTAGALLLMRHACPLAAMAVAGHHAGLPDLGSYGELEGPTFMSRMNRARRAGDCNPLALAQAGEAQLDIPQSAFLHGTRSAKPMTSGKRSERWSLYTDMMLTRMLFSALVDADRLDAEFFTSNRIDRAEHHILESLKKHLGPQNLASGRVPAFDALREASLTVSAERDAEDRSWIDRLAAIMEDAADGYLAAPDKRPIDIRRCELLERCLACGKDPSYGTGLYTLTAPTGSGKTISSIAFALEHARTNNLRRVIYVIPYTSIIDQTVGQFEAIFGTDAVLPHYSEAPYQFKNESDMDETDLKRALAAENWNAPIVVTTAVQFFESLYSNATSRCRKLHNIADSVIVFDEAQTLPVPYLRPCVRAIAELVERYGSTAVLCTATQPELQPLFDESFDGDHVRVPEISPFTRDDRDSFRRVTIERLGDIALDALAERLGNHKQVLCVVNTRSKAQYLHDRLAEDEAEGSFCLTTLQCAADRQRLFAEIRDRLDAGASCRVVSTSLIEAGVDVDFPIAYREEAGLDSVIQTAGRCNREGRRSASESVVHVFSTEGGCAPFLRQNIAAFRAVADRHADLNTDEAVRAYFAEVLCLRSGGVARANVGNDALDRKRILPLHGRDANWPFADIAKRFRLIDTPTIPVYIPLPGDGALLCERLERGDMDRTLFRKLGRYAVNVWPRHLEQLKSVGAVSTVGPGKNDEEDCFVLRDMGLYSSRLGLRLDGATADGIFV

SEQ ID NO: 12030 - protein, 807 aa, Bifidobacterium breve NCFB 2258
MPKDLLLARKDDDGNTQTLYDHLHNTAKLAAGFEKRSSVTAFAAGLLHDSGKATDDFKRYLLTGNRKRGEVVHAKQGAFIVDDCAADFPSSAASMITAEVLELAIANHHGHLPDCLDACGGTAYFRKLTGENKKAEQYHYQEVLSHVSSLNLDINTNFANSVAETNRLLETVDSCGISPRNTRNSRSFFLGLYAKYIYSRLVDADRVDAANFTAHQPYTSQTPNWEELTRRLENAISSFDTSSKISKIRMRISEDCLAASTRDTGIYRLGVPTGGGKTLASLRFALHHAQETGKHHIIYITPYLSITEQTVQVFRNVLDLDKDDEILLEHYSSVVPDKDDEKEQQRRLAAERWDKPIIVTTMVQFLETVMSAKATKLRKFHNLADSVIVFDEVQALPTNTINVFNEVVSFLSKILGSTILLCSATQPLLEQTDRRNLLLSDKPDLIDPDNDYAEQLRRTNIVASSQGLTLDDFAAEIYSKALDNGNCLAVVNLKGEAKQLYQLVKELDVDHRFTLVHLSTAMCGAHRKNQLAVLKKCLPKKTGDSGQPVICISTQLIEAGVDISFSCVIRAMAGLDSILQAAGRCNRNGESQMPRNVYVYPIKDESGLRYLPEIQLGKEITDQLIHDYPEQDLLSAFMIEEYYRAYLIRYPKLVDSKSRNIGTMDYSILGGEETVYDLLSFNRRRRGLYCNRVGEQYPYAFAQAFQTVGDSFHVIPGGTTDVVVHYGQAMELIDQLSGEGDFASKIKILRSLQEYTISLFDYEFKALDKSKSIGEANGDFGILVLNEENYSQDFGFLLKAEMPLLMK

SEQ ID NO: 12031 - protein, 812 aa, Bifidobacterium breve S27; identical to SEQ ID NO: 11831

SEQ ID NO: 12032 - protein, 1434 aa, Drosophila grimshawi
MDDLMDFFDSSKNFKRGTLPRGCISGDPNAYTSESSDSKPIKREIIGTKDVNEIVQKEQQLMNQLVGGPSNTKRTKTLDELESDDDDKMELNEAPTVRSDEAFYEKYHFDLNRNRSLPIYAQREQIMKAIKENPVVILKGETGCGKTTQVPQYILDEAFKKREFCNIVVTQPRRIAAISIANRVCQERRWQPGTVCSYQVGLHKQSNSADTRLLYCTTGVLLNNLIRLKTLTHYTHIVLDEVHDRDQDMDFLLIVVRRLLALNSRHVKVILMSATIDTREFCKYFASCKSMPPVVAASHGRKYPLVKYYRDQLKNINWKTEPQQREPGITHEGYRDAVKILLVIDNMERKAEGQSEQSYEEAKRTGSVLIFLPGVNEIDTMAEHIEHVMNESPNIKITIVRCHSLMSSDSQEDVFQPPLSGHRKVILTTNIAESSITVTDVSYVIDFCLAKVMHIDTASNFSCLCLEWASKVNCRQRAGRVGRTRSGRVYRMVTKAFYMEEMQEFGIPEMLRSPLQSSVLKAKELDMGGPSEILALAMSPPNLTDIHNTVLLLKEVGALYTTVDGVYEQLDGDLTYWGTIMSRFPLDVRLSRLIILGYIFNCLDEAIIIAAGMSVRSLYLSGQRQRTSDAFWMHYIFADGSGSDLVGFWRVYKIYVNMCQNLPMKDSEVQWARRYNVSLRSLKEMYLLVQELQKRCAALNLVSLPVGASHMWHDREKSIILKVIIAGAFYPNYFTRNNKTIPDYDRDVYHSICGNDPCRTVYFTQFVPRYMGELYTRRVKELFLEARIPPEKIDVTFQQGSEKIFVTFKGDDDDYMNSTDVVQVPGRVTTEVYKAIRMRMNNPNRSLRVMDQNSALKYVQQRNIGVVQDSKWVPPSKQWNVELLTLPSVFDKKITGLITYIVNCGKFYFQPRSLAERIASMTEIFNAPEQLSYHVRNASAITKGLQLLARRGSKFQRAVVLKVEPQSNAIPQFLVRFIDYGDWALLAMDQLRLMRHELRRDLEELPPRMFECRLALVQPSSVTSYSNRWPQKANEMLSKLASCGPLELEVYSLVNNVAAVLIHMRDGVLNDKLVEHQLARRADEDYMSRKDHDFRIRKQKMKRYVPAAEQQQVNEEYLRFNQLPQDADLEPPPLDKCHTSIRLKGPYSPLENSMNSMLRIGMYKSVAIEKESVNAVLLDADPQDRHDQMIVAASVTESDGNDKLVARGTTLMPNIHGFGALMAMLFCPTMQIKCNPERTKYVCLLAGLGFNPDTLEPYFQEHDMVINLDVGILKDDIRIINQMRYNIDSMFFNFDANELPAVGVEGRLVIFNQLRNLLTRLLGKDRSFIERHVWNSKYVWEDMSDLEPPSEPYGKRAIFPMHGSYDLESEDMGNLLALQENCSELYDWQNFDGVMQPRNCRLCNETLESVTQLRLHLLTQLHRDREKQVGWKQQ

SEQ ID NO: 12033 - protein, 526 aa, Pyrococcus horikoshii OT3
MGGTLGGAPLRAFEDALQKLAKAKGFKPERRPLLEGAFHFITSSEKPPFLILQAPTGYGKTLLSYALAVHSLYDAKLFDRIIHVLPMRSIIEDIQKTAEEAFGFSRTKMMGSSGEFLHLFPLNITTADTFTWDLLKLNTKRRHRIKAGKEFGYDYLTQASILTSLVIFDEAHFLLEDKSMVTAFLSVIEFLTSQKVPIVIMTATLSEAHKKIFKKYANKNNYNFKVLDPENDDPFIKRELKKDIKIEFNRGDPLNFIEPGRRNAIIVNSVKRAVEIFDRAKNIWPERDRVMLIHGRMTSSHKRDLINCLRKWQKEGDFLLIGTQAVEAGIDFSVDLMITDRAPINSLIQRFGRVARYKNEKEGEIIILEDAPYGPYPEDKVEKTLDLMKRGQILPRIPETYQTIVTEVHRSITKNVNRELKGELVRLMKDPSKRAPDVLSAVESLTVRGISIMRDFLIPLLVEDDMVLITPRKLLELYSKELVEIKGFNKEIKSLEDAYKVAKSVALGENIEIIFIGNYDWERGIP

SEQ ID NO: 12034 - protein, 719 aa, Symbiobacterium thermophilum IAM 14863
MSPIPCYAHSPGPRGWHDLYSHLTEVARMACQFAAPFGAGELAYWIGFCHDLGKINPAFQQYLETVNCGQPHPVVPHAIWGGALAYWLLWKHKQDAYMWKLLALPIYGHHAGLPNGGTISSVLEHFVQETPVALDQMMAYLQEHKALLPRLRAPALTGTRLELFIRMVYSALVDADYLDTEGHFNPAEASKRGGWPRLEELLEQFKRNQQEFMARVPDTLVNRVRREVYEACWHAAERPPGIFRLTVPTGGGKTRSGLAFALRHAVIHGLRRVVVAIPYTSIIDQTATEYRKILGNAAVVEHHSQLQPPEDESQSELALRQRLATENWDAPLIVTTTVQLFESLFSARPHQARKLHNLARSVILLDEVQSLPPEILAPTVDVLRSLVENYGVTVVLCTATQPALDRVPALSDFQEVGISEIVTDYPRHFTLLRRVQYERRAEPMTWAELAREVANRSQIMVVLNRRRDALALLEVLKEDPDVFHLSTLLCGAHRREVLNEVKQRLKDGKRVRLISTQVVEAGVDLDFPEVWRAVGPLDRIVQAAGRCNREGARHFGRLVIFEPAEGGSPSGPYKVGIEKARQILEHYPPDALHSPDIFREYFAELYSTVNLDAKNIQQLREDLNYPEVASRYRLIAEDTVPVVVDYKDGFRRLDDWLRRPTLEAWRALQPYVVSIYRREVHQNTEWLEPVFGGLYRWSGGYDPKRGLVQSFHDPSDLIA

SEQ ID NO: 12035 - protein, 936 aa, Symbiobacterium thermophilum IAM 14863
MSFTPPQDWNDYLHPEIWAKTARGVELAEGEGHYHPLCCHMIDTAMVAWRMWRYVLPQRLRDQIRRQLGLQTDDEAGRWIAFFAGLHDLGKATPAFAKQWPEGWRLLTEQKYGAASGSESKPHYVLTTFLLESLLEELGLPGAVAVPVAAVIGAHHGLFPTATDLRHAERYAGKAKWQEAQAHLVRLLAHVLGVDRLNVPTGDLWQANSLLVILAGLTSVADWIASNHTYFPFAGDRVRLPSYARQARWRAWMALHQLGWFHRPVAMAPRSFTELFDKVPNHLQKQVLAIADRLSGPSLVLLEYPMGGGKTEAALYLADSLAVAAGQKGLYFALPTMATSNQMFGRVNRYLVNRFPGSRINVQLLHGHASLNAEFELLRAAHLQELERRRAGREQELAAVGESTAATVLAAEWFTYKKRGLLAPYGIGTIDQALLSVLQTKHFFVRLFGLAGKVVILDEVHAYDTYMQTLLTRLLTWLAACGTSVVLLSATLPAHTRKALVAAYAAGRGLPAPAEPEVTYPRVTWLTDMESNAVHIEGAATRTITLRRYAQDDEGWMRALQEALVDGGCAAVIVNTVSRAQAVYQKLQDYFPPEELCLFHARYPFDDRMAREREVLTRFGPGIADRPRRAVLVATQVVEQSLDLDFDLLVTDLAPVDLVFQRSGRLWRHRREWRPPGFTEPTLWLLMPPLDEQGVPQFERGSRLIYDHHTMLRSWLVLAQQDHLCIPDQLEPMVEAVYRPADPPEELPEPLRALWLQTRAVLEAEQARDQQEARRRYIPDVHQNLLEMVLTDLEEEGESHPAVQALTRLGGIAVTAVCLVEADGRLWAPGPEPREIHLQRRPDKEDVRALLGRAIAISFDPGLARQILALDPPEVWEGSAYLRRCRLLTFDPAGNCLTAGLPLRLDPELGLLKIPGGEEEEEECRDFPSGKTRGSR

SEQ ID NO: 12036 - protein, 719 aa, Bacteroides fragilis YCH46
MGSRYDYILAKSESNGATSLKSHLESVAFWAQTAARYAGMDENVVRIGALLHDIGKASPFFQIRLQVKKKTNEKVFRHEVASLFFLKLIDRSLWPEVIDMIIAHHKSVYKDRSCNGLLDLKEYYGEENTFRDHVSGFSSWSIDAIGILRELNFPGVSADSLLSEEDALEAYRYAIEHCRRKPKGWSKWKGLLMGVDHLASATEEFKERIPTLFSIPDVGFYNRQHPLYPLSQVLSEANKKHTFVKAPTGAGKTDFLLKRCQGRIFYTLPFQASINAMYERIRRDLNGVVEDVRLLHSMSRLVIEGEKAWEEKVIQDKIGASIKVLTPHQLASVSLGTKGYETLLFDLCGCDIILDEIHTYSDIMQSIILTMIEVLVHIGCRIHVGTATMPSELEQKILDILGRDQTQQVELLSSVLDSFNRHIVHKVTDFYSVLPVLREAIENDQKILIVCNRVRNAQILFERIDELYPEVDKMLIHSRFKRKDRNRLEKELQDIYNKVLQACIVVSTQVVEVSLDISFDMMITETAPIDALIQRFGRINRKRKPKEERTLKHIYVIAPPDKKEDCLPYSQEILQRSYDALPQDSLLEESSLQRLIDQVYPQVNVIDLSLDAAFADGKWRLKELFHLPKSAFIEKLDIDSVSCITQEDADTGKYREATAEERVLMEIPMRYSSLRWKNLETFPYGSHPFVIPDIAYSSDRGLDITRMGTENYDTNYQIL

SEQ ID NO: 12037 - protein, 914 aa, Nocardia farcinica IFM 10152
MLGTATLSAWAKSDREGGSLSLVRHLADSGEVAKLVWDRWLPTHTRQRISVGLPGGEADGRTLLVWLAATHDIGKLTPAFACQVPELADAMHDRGLRMPDALGDRKALPHSLAGEVTLLEFLTGLGWDREVAKTYAVVAGSHHGVPPTVREVRNAPARTTLFGEGQWSRSRDELLRFVTERTGAWELLERLRLIPLTVTQQSLLTAAVIVTDWIASNQDLFPLDEARVSSTAAPAVWELLGLPHPWQPSASELHDDPSQRRFFCDRFGWPPSIHPRPLQLECLRVADVTPVPGLMVVEAPMGEGKTEAALAAAEILAQRFGLGGIFVALPTMATSDAMFARVRKWAENLPVPPAAMFLAHGKAALNAEFTSLHRRGFVSIGTDCADSGVVAHAWFVGKKGPLANVVVGTIDQILRAALKTRHLMLRHLALANKVVVIDEVHAADSYMSTYLCRSLEWLAAYRVPVILLSATLPPSQREALVLAYARGYGTGDDEVCLTDHGYPAITHWPNPELSTTVAASGRSIAGIEIAHVADDLDVLAERVRQALADGGIAGVVCNTVARAQETYLALERAGFPEDELLLIHSRFVASHRAELEARLRAMLGPPDGGTVRPDRLVVVGTQVIEQSLDIDLDLLITDLAPMDLLLQRIGRLHRHDRPARPPKLVRPSCWVRGADWNEEPPQPVRGSQAVYGLARLLRCAAVLRRRAALTVPDDVPGLVADAYHEQLEVPTDWLAAYHLAEKQWHEHVDRQREKARTYLLSAPYGDNRTLHGWVATGIPDDADGVGGQAQVRDAEDTIEAIVVQRCGDHVRALPQVPEIGGTTVPTDAEPPVWLAKKLAACTIRLPAMLTRYGRSGTVIRALEDTWYPGWQRVHWLAGELVLELDEQCTAELAGHHLEYDTRLGLLVAPAKEGK

SEQ ID NO: 12038 - protein, 817 aa, Thermus thermophilus HB8
MGEGIGRVFFLKDEVGFQPLSNHQGLVVKLLESWREGDEPLALSPKTKERLLLAARYHDDGKRFTFHIVPDGKGGLTYSFRGHRFRVAQAVQDPYAQALIRGHHDYSTREVVNLAADFLEEGLGHRFPEDLFLLMMADQLEAELAVRLWQRRAGEVRPFVEFDLLPDGEGGFLLDPWPFRVDEVALDFLVYFHPYRGEEAKVVEGWGRALVGALEEGKVPEAFREEKRRVRLRPWAAGARKADDPEAFYDRFGLKPTPFQREVFKVAEGDPAHLLLAPTGTGKTEAAAFPALARGERLVFVLPTRSLVDDLEGRFRCYLKILAQEEGRPKALVVDTGHRQARFRFSPDGQEEATKERHLYHADVILTTLDKLLYRYFGYAEGVKSYTFPRRIHDRRTLFVFDEVHLYEATAWVNFRHLIASLYKAGVRFLVMSATMPGTYREELLLEGTLEHPAAKRPSRVLRYMPQGNPMEIIQSHRGKRVLVVLEEVKEAAELYKRLKGEGVFLYHGRLAEGQRRRVFGEVKRRDKAQEPYLLITTPAIEVGVDLDAEVLVTTLCPPENLLQRLGRVNRRGGGQGEAYVVGETYPDYLGSLPEGYLELLKALDGQDLAQGGEERLRQAIRYPKYLDPRAETFFEALQDYVYGLDLTQEPLHRKGFVATRGWTPSVRLRQGEDEVEVPIDRLVGRKEELTPVRVVERLLTDGETGNRRREEVPLRSGELYGRELVLNYPYPYDPELGFVELPKVFQRLRHPDPQRVQLLYAPEKDAGEAPEGVMDTDQVTGGGRRVLWYLGESAWAEPAKSGEVAEETEEEEEEGD

SEQ ID NO: 12039 - protein, 533 aa, Thermococcus kodakarensis KOD1
MAGTPGGASLRAFKKALQKLAEAKGFKPEKRPLLEEAFHFITPSENPPFLILQAPTGYGKTLLSFALAVHSLWDASIFDRVIHVLPMRSIIEDIQKTAEDAFGFSRTKMMGSSGEFLHLFPLNITTADTFTWDLLKLNTKKRHRIKAGLEFGYDYLTQASILTSLVIFDEAHFLLEDESMVTAFLSAIEFLTSQKVPIVVMTATLSEAHRGIFEKYAKKNGYNFYVLCPQEDDPFIERELKKEVEIEFREGNPLDFIEPGRRNAIIVNSVKRAVDLFNEAKNNPEIWPESERIMLIHGRMTPSHKRELIKRLREWTKKENFLLIGTQAVEAGVDFSVDLMITDRAPINSLLQRFGRVARYGSDMKANIFVLEDAPCGPYPKDKVEKTVNLMKEHQILPRVPDTYQAIVTEVHGKKPISVKKNVNRELKRTLLKLMSDPTKRAPHVLSSIERLTASGTPIMRGFLIPLSVGGEAVLISPSKLVELYYRGVVEIRGWKGNIRSLNDAYNVAKSVALGKNVEVVFIGEYDWERGIP

SEQ ID NO: 12040 - protein, 900 aa, Thermococcus kodakarensis KOD1
MSLFEVLKPLKSEIARVHVFPPREGEFGEFAFKNPEINALVEELGFSLYRHQVEALEKLYAGKNIVVTTPTASGKSEIFRLAIFDSYLLDPRKTYLLVYPTRALINNQLEKFQRANLSFYRITGKLVPAKILTGDVPWEERRRLLRERPRVVFTTPDMLHYNILRRWREYEWLLRNLRYLVVDELHVYRGVFGSNAAWLFRRLSFRLKRLGVKPQIIALSATLRNPKEFAEKLFRTEFEPITHATNPFPRRYLVLFEPKNLGDKQLLRAVIERLVSKRIKTLVFFDSRKGTEKTLRFLLNSPVFSKVTTYKGTLPKNVRWEVERDFRDGKLLALLTTNALELGIDIGDLDAVINYGIPPDGLFSLIQRFGRAGRSADREALNGVVLRKNGLDYYYREHFNELVERLEKGIIEYMPVKTDNERIAEKHLHYLLTELGIVDWDELDEFERRIAEKLVVERKADLKKNPLTGKLEVRVRRPAFEYSSLRTASDESFFLVKDEPWIRAKLMEKSSLRELLNFINWLKMKGHIIEEVDEDEYHRSLLPGMAYFSRGELYMAMERLSIGKFHFVFAKQLNRLWDVETFARKLEEVEILEERAKKAYKGVEIGLGRLRVRHVYTGFAVKGLDTGNYVEELVRLKEAGILKGEISSPATGERVETEEDFSILNWEKFAKVEFEEPYVREFETEGIWLVFPEEIRELTEEEFREFFGRATEKGFEDLAFQIYESLDRRKLFPLYLGATSFIIRKAIGDALQKAGIQNEELAFAVKKMVDSKDGIGSALHAIEHNMIKIAPIFTYVDSRELGGYSYESFPGTPYFGKPVVFIYDGNEGGAGLAGIIYENAEKLMEKSLEHLKSCKCQDGCPVCVLSPKCGTFNEFLDKWAAIKVWERILKGNKADAQDPF

SEQ ID NO: 12041 - protein, 763 aa, Xanthomonas oryzae pv. oryzae MAFF 311018
MAFYAHSTQRRDHSDWQGLAEHLNGVGERASVHAEAFGGQVMARVAGQLHDLGKYTEKFQARLAGDPTRVDHATWGARKACELYRSGGTLLAYGIAGHHAGLADGRRDDLTSRPSLHERLSDEYCAHALPPLLPDWEREVMLPAKLELPTGFRGHPRTERRAFQMTVLARMLFSCLVDADFVDTDDFYRRVEGRKTRAEQAGTRLTLEELRERLDSHLAGLSSEHGINPIRATILHQARSKAHARIGLFSLTVPTGGGKTLASLAFALDHAIAHGLRRVIYVIPFTSIVDQTAQVFRKALGVQDRDDVVLEHHSAFFDDPAKALQAIDKRKLAMENWDAPIVVTTSVQFFESLFADRPSRCRKLHNIAGSVVILDEAQTLPQTLLRPCVALLDELARNYRVSPVLCTATQPALRQDQGFPGGLEQVEELVAEPKVLYAQLRRVRVRHVGALEDDALAEELRQRTQVLCIVNNRRHARALFDAIAEQPGAHHLTTLMHARHRSAALTRVREELKAGRPCRLVATSLIEAGVDVDFPTVLRAEAGLDSVAQAAGRCNREGRRPTDASEVLVFSPVNWQPPQELKVFTEVFREIERTHSGDLLAMEAIHAYFQRLYRRLGDNLLDDEAILTQLRTADLGDLPFDTLAQKFRMIQTTMRPLIVPYAPYVTDRNAAEREVAEVNEVLRQLEHADRIGVAGAARRLQPWLVQVPEQAYRALWQASAIAPIAPERYGEQFVCLRNSRLYDARFGLHWEDPQFLDAQALCP

SEQ ID NO: 12042 - protein, 805 aa, Bifidobacterium adolescentis ATCC 15703
MVLLARKDEEGNTQTLYDHLHGTGRLASGFEDEFADISRTAAVLHDVGKVAQQFQTYLLSDDGHRGDVQHARQGAFVVNDFFESKGEIEEIAKEILELAISKHHGGLPDCIDESGNRAFLLGFTESDKSNEKYAYQEIKRGLNGLALDLQSNFRGSAEDIACFLKKIKSLRLSKDSIYFYLGLLVKLIYSRLVDADRTDAACFETRKQYRPNAVDWQNLISRLDKSMRSFDSSSEINRIRHQINEQCCLAGARETGIYRLSIPTGGGKTLASLNFALHHALKTGKHRIIYVIPYLSITTQTAKTFRDVLGLSADSDVLLEHYSTAGMQRSADVADNASSEFEDAGEHQRKLAAERWDNPIIVTTMVEFLETVMSARGTKLRKFHNMADSVIIFDEIQSLPMNTINLFNEIVSFLSKITNSTILLCSATQPLLEKTKRENLLLSEKPDLIAETESYEDKLRRTRIVASTENKSCDELGQIIYQQARENGNCLAIVNLKKEAREIFQCLERLDVNHEFELIHLSTAMCGRHRTDCLNRIGALLDPGNPKPVICVSTQLIEAGVDISFACVVRAMAGLDSIMQAAGRCNRNGESVEPKNVYVYPLKAEDSMERYLPDIAMGKQLTLQIMENYPGKDLLSSNILEQYYDMLLRKKDGNGKGGYTDCPIRGRAEGATTAYDLLSFNECDRSQFTNTTGGKYGLCFAQAFQTVSDNFHVIPDVTHNVVVPYGQATELLDMLHRGELPEKISVLRRLQEYTVSLFDDDYRGLARKHAISLANEDFGVFLLNEEYYNDKYGVVREAEMPLLLM

SEQ ID NO: 12043 - protein, 805 aa, Pelotomaculum thermopropionicum SI
MPVVKGFPLEECIARPADGGKTYPLKEHLLAVAEACGSTAGDRPERLRFLAGLLHDAGKSSRPWQNYIQGKTKKGMPHAFAGAMLFAALFADLLEVWQPARQERKRLCHLAVNLTQFLYNHHGRIEDVNGDFPPWTGIIAPTEIMEVDVPGLLNLVALYFPEIDDRLQMYNKKPQSLVEKISSIAGPDCWPRWATEMATWVEKLLKEGNPYEIGARLCLQQENSRLITADRLHAGDFLADDNNFLTPARAVSALDSIQRYCSGRRSEMTGQADRSILEVREKWRQIAVESFLKEEREKMFTLELPTGYGKTMAALSVALRAVARGLCRRIIYVAPYLSILSQAALEIKRASGLPVLTHHHLSVLQGLVEHELAEDLLLETWQAPVVATTFNQLFLALFPYRAQNTLRLVGLRNAFVIVDEPQIINADAWNLFLALAEAATAELGSKFLFVTATMPRTDGGVFGRVVSLGRAEPVSNRYQVEVGDTEDENSLAEKVLKSYNTCGSTAAILNTVRDAAEVYRRLCGEVHEGELYFLSGRMTPLHKKEKIAAIKSSLKNGRGALVVCTQVLEAGVDLSFRELFRALPVIPSLVQAAGRVNRHGEGEKGKLFIFEFLRGGEKKTRPYVYRGGEQREVTDICLAENRVFDEATAGRLVHRYYQMCFQRNTRQTPLEKILEGARGYYTAPAGLSPFGRQVPQYGIFVPLVFGELPPEVDLAMKRFGCHNPDEIWDRYAAKGFLSSLEYTDKKQFMGLMQHFIVQLPEETAREVGEPVEKRAILRIKGESLYSRETGLSYVATDDEKEIWFI

SEQ ID NO: 12044 - protein, 738 aa, Pelotomaculum thermopropionicum SI
MFNGQYCSHSKNGLGNRHLLDEHLISAAEMASRFTAPFYRGSFTFLGWMAGLLHDLGKCHPGFQEYLKVVDQGGRGEKVPHSPWGAALAGCLQLPQQLRCLLGLIIYGHHSGLTEPGDYSSKISTYTSKEMLTRMHLFLQSLYNECLLQVPRAASWPDLDAIQLEMLGRMVFSALLDADRLDTEAHFYPEKRRLREKHPSLEELAERLKQDQKLLLEKAARNPTVVNRVRKEVYEACLAAASKKPGFYRLTVPTGGGKTRSSLAYALGHAIFHKKRRIIFVLPYTSIIDQNARVYREILGSEAVLEYHSQTAVPAVGDEEADDPQLLRLQLAEENWDLPVIVTTTVQLLESLFSNKPSRCRKIHRIADSVLIFDEAQTLPPLLLKPTLDVLKDLVENYGTTVVLSTATQPAFNSEFLPDVQGMEFTEIVPDYQKHFELLKRVEYCLLPGQVSLEYLAEELAGHEQVLVIMNTRKEAIRLVDELVRRGRECFHLSTLLCGAHRRVILDEVRRRLDLNKRPGPKSPLLLVSTQVVEAGVDLDFPLVYRAVGPLDRIVQAAGRCNREGRAKSGLVKLFILEGEKAPSGPYKAWFELARVILSERGGAGALNYPDIFKEYFSRLFNLLGGNLDKHGVQELRAELNYPAVAEHYRLIESDTVPVLVKYGEWDKAFRRFELRPSREEWRQLQPYIINIFRREAETYLKDGLITDTGKGVYLWEGLYDETKGISGVFRDPADLII

SEQ ID NO: 12045 - protein, 907 aa, Microcystis aeruginosa NIES-843
MSKSNPQPFFKFGRVFFPGEPTIAPDKILFQPLGNHVGNVRQLARKWQDGNFSLERVIEGINLHDKAKPQTFKIRVETNKQGEFTKYTYSFKGHRFKVDEPQNLWVQALARGHHDYSTKEIIKDTYQLKKDPKYQKIFSKDPLQYAKELYILEMCDQIEAELACRVIGDDEQAKSRTFMDFTITKGTSEDSNHRVFYLDPYPFKEPTITLNFRSWTYNLSDEDKNQLQQLRENGKDKELGGKLNTLVKEWWKKNEHTISEDRAITAIIKPDNSNTYSPSEKSENAILWWYRELANFQPNPMQEQVFQTMVENKHPAFILKAPTGVGKFEAIIIPFLAMLSTKEDRPRLIIPLPARSLLEDQKQRCDKYLKQFSLLHKGREVSLVIDTGTEMNRYVYLDGEIKSSNNSRRHLYKGDIILTTIDKFIYRYFGYGDKQKSFIFPYRIYHGNTLICFDEAHTYDDISFTNFCSLVKALYEAGRSLVLMTATLSQNHLERFDYLADNMIDYIDVQDNLEKLNNFYQQILKQDYSNLKQFEWVDDIVYDVKEPTNLQQKLTSIALAEWNSNPSHRIIVSVETVKDAIAIYEKIKQKLNIKSSGQNEFLFLYHGRLSDIPKTSHYSRTNLYKRLKERDENDQAYILVTTSAIEVGCDLNSTRLITQLCNPESLIQRAGRCNRKGNVEDAKIIVIGNNIPEFINTLSEAELEDYKTILKGLHARNFDPKAIMNCVSTKQKIDDYRVVELFSLLQDYVYNADLTCQSAHEKGLVITRSWTPSVTLVYDDGKQGDSLEKIVKESPQIQVPIDRLINNEGNYTNQYANVSVYEWIYDKEETRYKLEPLKYWGCAYSKDMVIKVCAVQEGAIYDHELGFKDLPRVFIKCRSNGYQERLRYNPTEDRSVVINYTSALTQD

SEQ ID NO: 12046 - protein, 706 aa, Porphyromonas gingivalis ATCC 33277
MSRYEHIFAKSDGTPLLQHLQDVAKAAEVMAQHWGLSTDMARKGAHLHDIGKASPIFQSRLKAEDNLGGDVFRHEIASIFFISLLPDEVDRRAIIEMIAAHHKSICNDSRELGLLDLDENESRCFKLHSKGFEQWSQEALGILHELGWETHPITMDEARSNYQEAVDYCSSLGRNCSQWKGLLMAADHFASSLDGQTEDTLRKLFVTPDLSYYRNRRSELYPLSLLSADDERQHTLVTAPTGAGKTDFLLRRCRGRVFYTLPFQASINAMYDRLKADLRDTDAQIYPLHAASILKLNGGYERILSRHVGASIKVLTPHQIAALAFGLKGYEVTALDIRGCDVILDEIHTYRKETQAMVLKIVEILVALGCRIHIGTATMPTDLYTGLLRLLGGETAVYEVKLPKEVLKGFDRHTIHKAGSMEDVEPVIQKAIEQSQKILMVCNQVKRAQQLYQEVVGKYPAIPTLLIHSRFKRGHRAQLELELKERYNQCQGPCIVVSTQVVEVSLDISFDMMLTECAPIDALIQRFGRINRKRSLETIGQTKPIYVIAPPENEKEALPYELEILQRSYSSLPHCEVLHEADVQQLLDAVYPEVMALDINMHTIFQDGEWVMKELKHNSKSALFKILDINSACCIMESDREEYENGNYINRTPLEIPVPQSIRFKQLVATNCGAHPFVIPDRAYDSKLGLMEEFADSRYYKSFEIF

SEQ ID NO: 12047 - protein, 768 aa, Desulfovibrio magneticus RS-1
MYDKKNRLSVLAGSGWRRGCAMAESGRVAGQWFAHSMVGEPKETWQTLEAHLGGVSRQAREFASRFMAGEWGALAGLLHDVGKYTEAFQRRLAGAGVRVDHSSAGGKLAVDRFKGAGKFLAYAIAGHHAGLPNGRDNDLACLSARLQAAVVPEPALALAVGPAPAALPFAQALGRTGFQCAFFIRMLYSCLVDADFLDTEAFLDKEKSARRGGYPTLGSMTERLTAHLAGFSNKAAPSPIDPWRAKVLDWCREAAGEKPGLFALTVPTGGGKTLSSLAFALKHALAHGLDRVIYVIPYTSIIEQNADVFRRAVGDDAVVEHHSNFDPWKERDSGASESEPAGDEGLAKRHELAAENWDAPLVVTTSVQFFESLFAHRASRCRKLHNIARSVVILDEAQMLPPSLLRPCLEALRELHESYGATVVLCTATQPALTRRDGFAFGFEPGLVREIVRDRSGLFKELKRTRVTHLGQLADDELALRLRGHEQVLCVVNTRAHARRLHGLLGKGAGVFHLSASMCPAHRTEKLKHIRAALTAGEPCRVVSTQLIECGVDVSFPVVYRAEAGVDSVAQAAGRCNREGELPQGAVYVFAAEKAPPAGELRRAAEEGQVVLRAFADPLSPQAVTAYFEALYWRVGPEALDKRTDRIAGIFAALQAGANTLDFPFRTVSQEFRMIEHLCEPVIIPWGEEGEDLVRGLEHAEHTGRLARRAQRYTVQVPARVRAALVADGDVECVQERFFVLRRMSRYDDEEGLSGEGAGVFRAEDWIQ

SEQ ID NO: 12048 - protein, 768 aa, Hydrogenobacter thermophilus TK-6; identical to SEQ ID NO: 11770

SEQ ID NO: 12049 - protein, 778 aa, Deferribacter desulfuricans SSM1
MKYINSKLHSHPDRLLEKHTSQVIELANKYYSEISINDKILKDILTIITFSHDIGKSTQFFQDYILGDKELKNKLETKHAHLGGIAGLFLTDRYLKSKNIDNPFLLSLSYILPKRHHSNLKDFLNDLVIEEEDIKILQTQINSIDKEKFKNFLQNVETCDKNLINFSFEEIDFQQIKQTLRKIRRFIRKLKDEKSIDYYINTVFMFSLILDADKSDVGIKTDKNILFKDIQIKPEIVDNFVKNLSFEETEIINLRKKAYKEVAEKEIDINQKIYTLTLPTGLGKTLISFKTALKIAEKLKKEKGINLKIIYCLPFLSIIEQNFSVFENVLKENDINLDSSILLKHHHLTGFSYKSKVDEFDYNTSRLLIEGWNSKIITTTFLQFFYSLIGNKNKMLRKFHRLANSVAILDEIQSIPHKYWLLIKEVLCRMAEKFNFYIIFSTATQPMIFEKKKYIELASKDYFEHIDRYDVFINKTQQTIELFYSNLNIEDNKTYLFIMNTVSSAKMLFEFLKKDFKDEIIFLSTHIIPKERLKRIKELKNHNKRIAVSTQLVEAGVDIDFDIVYRDFAPFDSLNQSAGRCNREGKKEKGKFYIVKLFDDKNNRSYSSYIYDSVLINATDEILEKEIYSEKEFIGLVNKYFEKIKQIKSDKVSLDMLEMLYTLKFSAEKEKDKIKSIEDFVLIKEDYYKEDVFIEIDNEAKKVWEEYTKIWQLQDLFERKKAFDSIKSDFYKFVVSVPIKDNPPPIENNFYFVPYENIHEYYDLETGFKVKGGLFFSF

SEQ ID NO: 12050 - protein, 801 aa, Deferribacter desulfuricans SSM1
MATKSGLLSHPDKQLEDHISNVIKLVNNFYDNTKLNDNILKNILTIISFAHDVGKATTAFQEYIKGNSELKNKPETTHSLFGACISLYLTDRYLKSINQNNDFLLFLSFVIPRLHHSNLVDVYQITLLDENQIELLTTQLNLLKINQDQFYQFIENTKINNKDLIKFNLNEINFNNIILLIRQINKFIKNIRTTVNGLNKTNILLKSRINSKPINIDYYIIVSLLYSILIDADKSDAGIKADKNILFKRDNLSSEIIDNFINTLKFKKTDIVKLRQQAFQEITTKDIDINNKIYTLTLPTGLGKTLLSFKLALKLSNKIKEEKNVIPKIIYCLPFLSVIEQNYNVIKSVLETNNIKVDNSILIKHHYLTDMTYTYQNDEFEYDTSKLLIEGWNGQIITTTFLQFFYSLIGNKNKMLRKFHKLTNSIVILDEIQSIPQKYWLLLKEVLNKMAEKFNFYVILTTATQPMIFDKKQYIELASNNYFDKLDRYVVNINKDLKTVDEFYYSLNIEKNKTYLFIMNTVNSAKRLYELLKKEYKNDILFLSTHITPKERLKRIQQIKNNDKRIVVSTQLVEAGVDIDFDVVYRDFAPLDSLIQSAGRCNRNGEKTTGIFNILKLYNENHQGRLYGSYIYDTLLLTATEQILDKEFFTEPEFIQLTNKYFQKVNEIKSNSDSLELLKILSELKFTYEKDNNKITSVEDFKLINNNYPRIDVFIQLDDTAVTIWKEYIKISNIKDYLERKRLFNNIKKDFFEYIISVPIKDNMNIPPIENNFYYVPIDNLDDYYDYETGFKTDSNLYIAL

SEQ ID NO: 12051 - protein, 537 aa, Candidatus Caldiarchaeum subterraneum
MHCPESKIYRTLVERGFYSAKRPLIEHVLENLGPGVNVVQLPTGYGKTSLSIACGLKSIVEPREYLRSIHVLPLRSIIDDAYKSTVKNLQRIGITNPEEIVAEQMMGAPGSPFLNKDIVFVTYETFKFHMMKTPPHEIKNMFCSALLNSGWRTYGHFEISRGAIFESAVFLDEPQLMIDENDSTLPSILYALACHGGFMTLMSATVSKSLRNLAREAASAFGVEYREMIYGENMFDKDFENTMKSKKIETYLEEGSLEDVVRNRLRDAVWDRVLIMANTVEKAKHLYRLLSDADAVLLHGRLTKKDRQNVLDNLKNGKKWVVVSTQVVEAGVNISSELMITELAPASSLVQRAGRVARYDNEQEGMIVVVKAEPAPYSGETVEKTYEVLRNALNDGGVSWRVPSPERGIGYSQLVDMVHGDQVFLTNNTLLNQMINPVSTPHQAQNLIRDTVTTVYVADDIDKLEKDNSFTTDLQQLAYKFPQATAIIQKKEGLTEDKSLRAKDVNRSPSPSLFMLCKDIVGFLISEEEYRNEAYGI

SEQ ID NO: 12052 - protein, 537 aa, Candidatus Caldiarchaeum subterraneum; identical to SEQ ID NO: 12051

SEQ ID NO: 12053 - protein, 537 aa, Candidatus Caldiarchaeum subterraneum; identical to SEQ ID NO: 12051

SEQ ID NO: 12054 - protein, 1068 aa, Anaerolinea thermophila UNI-1
MSGRTKAERLDEMKRLYIQGIYSDSEMAERLGVNRSQVFRDRRDLSLTYPIEEVERGRYHIPRSKLISEVKVNLPEALTLYLAVRRLSRQTRFYHPHAANAVEKLAIVLHQPMAKRLLQTADRLLHQEKKPEKIKIFETIAQAWVEQRKTRIEYQRLGHEGITRHTISPYLIEPSIWSDSIYVIAQSDFNDKIYPFKLERILSAFLTSETFEISESFNEESLLRHAWGIWFAENPPVTVKLRFFPNPTAIQRLEESVWHPLEHIEQTEDGGRIWSVEIADWREMLPWIRGWGADVEVLEPMELRETLNKEVERMGRIYGSITKHTPQPRFFAHRREDKDREDWQPLIDHLRKTAEMARDFGKDANVAELAYIAGLFHDLGKYSAEFQKRLEGGPRVDHSTAGAKELNALLSGTPQEGFAKILAYPILGHHAGLPDYGSEVDLESSTVCGRLKNNIPNYSEYKKELNLSALSFPQQLHIRPLRFEKPFKNYLGFSLSFLTRMIYSALVDADFQETEIFMKGVKPRGEYDDIPTLQRKLDTYLKQFENPTSDINRKRNEILHACIEKGENEKPGFFSLTVPTGGGKTLASIAFALHHAATHGLKRIIYVIPFTTIIEQNAQVFKEIFGEENVLEHHSNFDWNDGKREDADNRTNSILAKLKLAAENWDIPIVVTTNVQFFESLFDNKSSRCRKLHNIAKSVIIFDEAQMLPKEYIRPAMAAVWELVTNYGASAVFCTATQPGLERFLPETTEIKELAPDPIMLFNFYKRVEVKHLGTLTDEDLLSRLNKHEQVLCIVNTRRHASGLYSGLQGEGNFHLSTLMCPAHRRATLEEIKERLSNGKPCRVVSTTVMEAGIDLDFPIGYRALSGLDSINQASGRINREMKRGVSEMFIFEPKSKYIRRTPAFLKQTAEVTRMILRDYDTAPISIPAIQAYFEQLYNVQDPQAFDIKKIMECFDSPEGKFMFETAAHSFKIIEDPTVTIIIPYNGEAVRLIEELKYNLYPASILRNLQPFTVSIFESEFDALSSKGVIFTIEDTYHVLNPDSMPDYYDQHRGLLIPENVGGDGLLF

SEQ ID NO: 12055 - protein, 793 aa, Anaerolinea thermophila UNI-1
MEMPCVPEGLSHLWAKSPLAPGRQAQTLAEHTWEALMRLSDLAHQRPDLPALSRQPRLWHLLFWAVFLHDWGKAAQGFQRLLRGKERRWQFRHEVLSLAFVDWVTAGLSAEETAFLASAIATHHKDFDEIEGYLEEQEADLDPLTAMLGELSREDATALYRWLETCAAPWLDALEMRPLGVTCPALPPLEQALNGLTPQAARRHLHRLERFLHAWEDEPPSVETLRPGIFLRGLLLQSDHLASAGWGALPQPQLSAEAVLHSLALPYRRLYAHQRAAAHTCGHAILLAPTGTGKTEAAMLWAVNQRLPRLFYTLPYQASMNAMFDRLARIFPGQVGLLHGRSTMAQFQRLMEQSYAPQEAARLARLLHNRSGLAYYPARVFSPYQLLKAAFQLKGHEALLSDFTEGAFVFDEIHAYEPARLAMIVATMGFLARAYGARFLVMSATLPTPIRAVLEETLEQVTPIHASQRLLARLRRHRLFLAEGDLLEEGNLRWALEEARQGRRVLVVCNTVRRAQQAWLWMREHLPPEIPLFLLHGRFTGRDRARKEREMLQAAGLNPAEHRPLMVVATQVVEVSLNLDLDVLFSDPAPLEALLQRIGRVNRLGRRELSPVVVFRGMDEVFRRVYRPIEQVTRTLDVLEERFSASRGKGVALDERALPQWLDAVYTGEVLASWQNTFESARADFERSFLQVLQPFRSNPQLAEQFHRLFDSTEVLPEDLYDEYLELRDSERALEADSLLVPLSWGLRAMLAQRGLLHKGDRDFPDVVSVPYDDEWGLNLDVKPDTQILEDSD

SEQ ID NO: 12056 - protein, 754 aa, Streptomyces rochei
MSSRQLYAHSRSSVSGARHTLSDHLRGSAALARRFGEVFGAGELAEYLALVHDVGKGCCAWQDGLLQKAEPEGKPVGIPHKEAGTRLAAEYAGMPFAAAVQGHHGGLPDHQKVKDVLAALKGSGPDAMAAQEATRRVTELIPEITRTDKVTLPSWLLPLRGADFKAETDLLVRMVFSCLVDADFLDTDAHFAGRTAPRLAPATDMRALFERFEKRRAEFLAARPASPVDEIRARVFAQAVAAAACEPGMYVLHAPTGGAKTIAAGGFALRHAAEHGMRRVVFAVPFISITQQNAEVYRSLLDPRAEDGDGEPVVLEHHSSVDLDEDSDESTWARLAADNWDVPVVVTTMVQLFQSLFSAKPSAMRKLHRLAGSVIVLDEVQALPDRLLNPILSVLRGLVERYGVTVVLASATQPDFWSLSKLSGMPRRGMVEDVQGLFAELRRVTYEWQLGDDVTWESVADDIEERAGDQVLAVVNTTRDSARLHRLLTDRNPVCDPVLHLSTRMTAEHRREVIARIRTRLRKGLPVRVVSTSLIEAGVDVDFPWVYRTWAPAESLQQAAGRCNRDGRMAENGTVVVFRPVDGGTPKDLSYIAALEATEEFFGPDPLADPDDLKALAGYYAKRYALQGGDRAMGERIEELRRAWDFPQVAREFQMIDDVYGQSVVVVRDQKTAEEQDAIWADIQRLRAPYTSGPEPLRRLQPHTATLPRHEVTQALRTGLAEPVVGDLVVWRGHYDELRGLDPDDREDSSTFLL

SEQ ID NO: 12057 - protein, 362 aa, Melissococcus plutonius ATCC 35311
MSKRCLDFAKEPTGIYGLAIPTGGGKTLASLRFALEHTRIHEKERIIYVTPFTTIIEQNAQVVRDILKEDRYILEHHSNILQEEIVDQKNKQNQGGLEERREREEVSMKDNWEAPIIFTTMVQFLDVIYSRGTRNPRRFHQLYHAVIIFDEVQSLPVHCTYLFNEAINYLKNFAQTTSILCTATQPALNNLDKKLQKDKDILEKSELQKIEAAFERVEIIDKTTQSAWNIKDTVSLIEEILQERNNLLVILNTKKAVLELYQLLAEQSSEEIELYHLSTAMCPAHRKQILKEINVKLNAKNQQRKLVCITTQLIEAGIDISFEAVIRSSAGLDSIAQAAGRCNRNGEQPNKQPVYIIRLEKN

SEQ ID NO: 12058 - protein, 767 aa, Porphyromonas gingivalis TDC60
MINKESPILAKPSGITLDVHAENVIQEGALLLKGLGCTKEKYFQTTAKQIVQRVELACKYHDIGKRNKIWQDACKKDYKAYLIWKKIHPNKSFEDYTIECREEAGKFLRQTHVRHEFYSIKGLLNNNPPPWLKIAIAAHHRKLSMKHEERWLSSDEDICSVWKDIRRLSNCFFDDRNSVLSDIVIKQYEFAGPRSLLQLADHRASAKEESKDIPDPIAFSYTFPEKWEKRPVQKLVEKHWRDELLLVRAPTGAGKTDAALLWASLQIKHRKADRLIIAMPTRFTTNALALNVSSTLSSTGLYHSSAWTQNFSSKIDNGEIALEQARYYHNQARLLQTPITVCTIDHLLSSLTLCDEEHQTITFALANACLVIDEADFYDQFTQANILVLLEVLKYWKVPILLMSASLPDNIVQEYRKIGYDIKHILEDTSDIERARFSLIEKRDVSEISQMQDLLQLCLDRGSAIIFANTVDRAQAYYQWFLENGHEEEVILYHSRYTETDKIEKEAQLLLRLGRSAWDNDRANGVAILTQIGEMSVNISADIMISDLCPIDRLTQRCGRLCRFSRKIGDLYIIRPMREGNLFPAPYYQNVGPSQKLEPNDALIKTDELLEKGMYSAANLVQLLNKVYANQTVFSTEASCNADRLREMFKANWLINPIEYLDEEIGSTNFWRARNIMPRCRIYIKRPLQSFRNYSDFRRWETDVAIDIPIYVIKKAMRMSDTVCSQVKVCIGKNDYTLIVINAKCYNNVRGLFFSKSVLEEPNFEFL

SEQ ID NO: 12059 - protein, 555 aa, Sulfurisphaera tokodaii str. 7
MREGIRKVLELMDCKDVGENVKGKKLAECNDVNFILNFPTGYGKTTLSITLGEWLTTYTTTNFYRLIHVVPTRALVEDISKRAEGLKYAVQYSFAPSELKSPNFLADFIITTYDSFFLNLYKASIGEPFSDHGHYDLPRFSIYTSLVHFDEFHLMNESNSWTSLIGAVEHLSKLGVNFIMSSATPSKSVEEKIIDHSKNVIKVSVVNEYGNAINGRKCTEVDNGIYECETTKGRKRYKVVEIKEKIDVPNIDVKIVNNIEQFYNIVKDSEKAIIVVNTVDKAILLYDKLKHLKPCLIHSRFKISDRQKRKLDDCKLIVSTQVIEVGVNISSEIMITEQAPLTSIVQRVGRLLRYNEKNEGTLYIWKSNETYPYDENEVIKTVEALSNNDICLKHPYGCHNKKGYAEIIDSIISEPNINQKLLNDLEKISINPFLSKKDLDIILEKYCTLTNSFIVNLAIDKPSRMEDLIPFNGKMIDNAPLIRKDNKIVAYFEKYTPTNVIDKVEVIEDYIEFKDWKDLCIKYRKIFMKGEEKMILLALKADSSYYDSERGLRLK

SEQ ID NO: 12060 - protein, 498 aa, Sulfurisphaera tokodaii str. 7
MRWEENMLSSAKSITDIYEEFIKDNRLQDRLAIRQTVEELEKGHNVILKAPTGYGKTTLTKVLANAVDLGYFARVIHVLPLRAIVQDLYEKLKSDSEKGVIRTKSIAAQDMDFSDSPFFMQRVTVTTLDTFILNLFKLPAVEMGKVFQNFGAHYELPRGMIYSSLVIFDEFHLLGEEGRPLTAGLSAVKSLTDAGVPVIIMSATIDKGLESLIMKYGKDFVTVEAKDFSIERKITVKKIREEEVLSDVLKEYSEGKRVLVVFNTRVGAINFYKALKDKGLNPVLIHSKFNREDRRVLVQKVLKERLVVSTQVIEAGIDTSFDVLITEAAPASNLIQRAGRVARYGGYGEVHVFPFSGKVYDKEEVQEVWESLDRGLPELKEKEYHVDNILLSDLTTIDHSVFADSITAKNLYTSVCNIVRETSIIMGFPRGEYNSEKAIPLTEKEAMEALRKNGAVKDGKEVTDYKPSTNVCLQLDLLMKGIDGVIIAGYDKEIGGII

SEQ ID NO: 12061 - protein, 743 aa, Candidatus Arthromitus sp. SFB-mouse-Japan
MKYTEKLARRIEKEDGKIEYQKLIDHICGVSEFSEEFVSKFFLKNSGKILSILHDLGKYSDEFQDRIRGANIRVDHSTAGAIICDDLEKEFKGRGEYVIYKIFKYIIIGHHSGLLNYGTEMDDEGTISSRLNKRDILCDFSDWENEISIDDIKQINFSEEVLGFFKNNFSVQMLIRFLFSSLVDSDRLDAQRFVEGENSIVNSKKLMSLEEMLNVFNDFMKSKRLQESDNPINLIRNEIFNDCINKSRGDRGFYSLCVPTGGGKTLSSLGFALNHAKQNGHDRIIYSLPFTSIIEQNARVYSEIFGEENVLEHHCNFSFSNEIGEDEYSENQLKYKLAIENWDMPLIVTTNVQLFESMYSNKPSSARKLHNIYNSIIILDEAQVIPNEYLKPCIKALEELVRNYSCTVLFCTATQPEFKKNGLIENFDVVEIIDDTYKLFDDLKRVSGKFIGKKSVEDICNEMNSHKQVLTIVNTKKHAKEIFENLGESEGNFHLSTNMYPNHRKEVIKIIRERLKNGEECRVVSTQLIEAGVDVDFPVVFRSIAGIDSIVQAAGRCNREGKQKNSTVYVFKPEEESHLGLGYLKLTSQIGEGIIDDFEDFLSIDAISKYFFELFIDTDHRQDKHKILKMINKHKKLEINYDFREINDEFRFIENLGAQVIVPINEGEKFLNILKYSNRGVKSVLRKLSGCSINIPNYILRELLRDGCVEQFSDDIFILKNIGMYDLKIGFDKDNLKNYEYII

SEQ ID NO: 12062 - protein, 783 aa, Sphingobium sp. SYK-6
MIYAHSISSKSENTWEPLSHHLSSVSNCAEAFAERFGVGVLGRIMGALHDIGKCSAAYQHYIRTPQQGDGRARGPDHSTAGAKEALRLYGVAGRLMAFGIAGHHSGLMDGPSLTERENKAVEDYVGWEGQAPPLPDRRTWMASMTSPQPNAIEPAFRGFFLTRMLFSCLVDADFLETERFYAVAEGRSPPERGGRIDRRHRDAVRTYMAKYRREDTPVNTLRSQILDHAVVKAALTPGLFTLTVPTGGGKTLTSLSFAIEHALRHGLERIIYVIPFTSIIEQTAEVFRTALGAGLAGDVLEHHSSFDWDARQPTEEGDEEGEGASGLAKLRRDAENWDVPIVVTTAVQFFESLFAARTSRARKLHNLAKSVIVIDEAQSIPVHLLRPCMAAIDELAKNYGASVVLCTATQPALRKQDDALPRPVRAPSDAGPERTDGLDIPDERELAPDPRGLYRRLRRVRVEWSQMPVPDAAIAARFAERPQMLCIVNSRAHARELFEAIRHQPGARHLTTLMCARHRRDVLASVRADLAAGQPVRLVATSLIEAGVDVSFPEVWRAAAGLSNIAQAAGRCNRSGELGPLGEAHGRTLVFEPEMVEGRRPIPRDLMPFYDAAREVLKNPALDPLSLEGVTDYYRWLYWKKGYAALDQAKGTGSDYPILSAIHETVGRGGVNCPFRTISDAFQMIDQAMDPVLIPYDADAEEALRVLVHADRPPAGTLRTLQQYVVPVPKQIRAAMLANGDAAVVREDYGDRFVRLGDMFLYDRSLGLALSTPEWRASEQNIM

SEQ ID NO: 12063 - protein, 726 aa, Arcobacter sp. L
MLAKSDGLSLEQHIQDLLDVSLDFKLAFPLLQIYFDDVDFWDYLNYSILFHDLGKATKGFQSLMQNNKPYRFRHEIISALVAQNYTNDELIINAILAHHKNFEKLKELLNEYENNKKYNQDRWIDKEFEELDLEWVQQFLSEKKFEKKDSLVNNIDENIKKWTSRRARKKISELEKFQNIFLSASLSICDHNASAGIKNIPIIEQNNFNFLYNKKHKPYHHQEVSWREDGNALLIAPTGQGKTESSLGWLQNQLKNRQGRAFYILPFTASINAMTKRVSSVQDGFGNEELVGLLHGKAKFFIDEYYEKKDGQSLKDLLDINKKIIKPFKVVTPFQILKWAFGVKGFEKGFTELAGSYLIFDEIHIYDKELFRRILFFIEWLIDKLHVKVFIMTATMPTFMQNHIKQILNIKNEIRPSKEDIATIQRHKIKLLNFSIDEQKDFIQTKINDGKTVVVVCNTVVKAQEIYASISCDYKTLLHSGFNAKDRTQKEKEVQSKNKPQLLVGTQAIEVSLDIDYDLIVTEPAPLDALLQRFGRVYRSKSRLLQESDEANCYVTTMIEDVHKIIYDNTLIKNTLKVLEKIQNIVINEDMVQDLLDEIYEPFALNEDNLREDFRSLLDNLYPFNVYEESEEKFFEQFDGVEVLPIELFDEFNEYVKDQQYLEAEKLFVSISKNKYKKYRYKKDLIKFVEPHNYGKAFPLIGLKYSCETGLLDEEVTDISNKSMFI

SEQ ID NO: 12064 - protein, 743 aa, Candidatus Arthromitus sp. SFB-mouse-Yit; identical to SEQ ID NO: 12061

SEQ ID NO: 12065 - protein, 743 aa, Candidatus Arthromitus sp. SFB-rat-Yit
MNFNEKLARRIEKSDGQIKYQKLIDHIHGVSEFSEEFISKFFLENSGKVLALLHDLGKYSDEFQERIRGKNIKVDHSTAGAIICDDLESELKDKHESVIYKIFKYIIIGHHSGLLNYGTDIDDAGTISSRLNKKEELCDFSDWKDEISIDEIKQINMSKEVYRFFKDNFSIQMLIRFLFSSLVDGDRLDAQRFSEGENSIINSKKLMSLDEMTEKFNDFMELKKLDGTNNPINSIRNIIFNDCVNKSNGSKGFYSLCVPTGGGKTLSSLAFALNHAKQNGHDRIIYSLPFTSIIEQNAKVYSDIFGEENVLEHHCNFNFSNEIGENEYSEKQLKYKLATENWDMPLIVTTNVQLFESMYSNKPSSVRKLHNIYNSIIILDEAQVIPNEYLKPCIRALEELVKNYSCTVLFCTATQPGFKKNGLIENFDVVEIIDDTYKLFEDLKRVEGKFIGKQSVEEICNKMNSHKQVLTIVNTKKHAKEIFESLSESEGNFHLSTNMYPNHRKEIIRIIKERLKNGEECRVISTQLIEAGVDVDFPVVFRSVSGIDSIVQAAGRCNREGKRKESTVYVFKPEDSLHLGMGYLKLTSQIGEGIIEDFKDFLSIDAIDKYFSELFIDTDHRQDKHNILKIINKRKKFELKYDFEKINDEFKFIDNVGTQIIVPIGEGEKLLNVLKYSEKGIKSVLRKLNGFSINIADNVLKELIEGGCAEQFSDDIFVLKNLSMYDSKIGFDKDNIENYDYII

SEQ ID NO: 12066 - protein, 470 aa, Tetragenococcus halophilus NBRC 12172
MLEETLYRYFRYKSFRPGQKETINSLLEGNDSLAILPTGTGKSLCYQLPAYLREGTVLIVTPLISLMEDQLASLQRNGEKRGVLLNGNLNEQEKMYVLDHFSSYKFVFLSPEMLMQEKILSKLQLYHIALFVVDEAHCISQWGIDFRPEYRNLKQAKKRLHNPVTLALTATATDEVKTEIKNLLLSKNTVEHCYSVDRPNVSLSVIHTQAKLTDLKKLLDKAYGSVLIYCATRKKVEEVYDRLKNDYIIGYYHGGLDSSQRRLLQEQFINDQLQILVCTNAFGMGVDKSDIRLVIHYELPDSLENYMQEIGRSGRDQKPSNAVLLYQEKDEKIHHFMQQQAQQERQFFEFYLDQQLLSKLTELQEKWLQQIKVSDQDSFLTQLRQNETEKQKKLKQMLDYIYFDGCRREFLLSYFGETLTKIPERCCDFHGIKKVIDDKKEYCFSVNKTHWQEILLKMFKEENSQQFRKT

SEQ ID NO: 12067 - protein, 726 aa, Acetothermia bacterium
MAELLAKPDTGLLTHLVEVTQLGEKIADRLGLSDPLRTKVLLACTLHDIGKATTDFQEYIRGQRKRAYPHALASLPFALLLEGVLNPKLGLEPTRYEATTAVLTHHSPLSPNLYKGYEKPDYHPELWQALQEIWTLLEEVGVRHVPPLEGFQRNVRSFLNDSPAALLDASFSGQDASKTLRGIFQRLSTEDFARVKAVLHLADWLASAKQPKPEILFLQSGSEPVRQHTQKLKPLRKFQQDAQTAHNAKILWLRAPTGTGKTEALLLWAGATERLIYLLPTQATTNAMWHRLRRIYGDDAVALAHGRAIYILRQESDEDPVDARLFGSVFAKPVTVATLDQYLLSHLNGRHWEERRTLARSATVILDEIHSYEPYTLGLLLEALKREPPARLALASATLPEPLLSLFPPGQLIEAEDTLWSRTRHRLKLCDGMLLEEGVQTALQEARQGSSVLVVANTIRDAQEFYKRLRQAGWENIELLHARFIFRDRQAKEARISKPEPGRIVVATQVVEVSLDISYDVLVTEVAPMDALVQRMGRVNRQGEKPPAPVMIYRQWSEGSQRVYGRELLEWSAELLLRLPAKPPDAELAQATHELYKRVVATPEWERELQDGQKTLGEVQRILGCYTIDLADEELRERFTARRGMVTVEVLPARFLEEAYMLKECDEGWRLPELLVPVPLWWFRQFAQHFRPVSDLNVVQTTLSYNDEFGLHPPHHQEQSVEAAIL

SEQ ID NO: 12068 - protein, 726 aa, Candidatus Acetothermum autotrophicum; identical to SEQ ID NO: 12067

SEQ ID NO: 12069 - protein, 820 aa, Melissococcus plutonius DAT561
MKFIAHYNQVTGEQQLLKDHLLETAALSKRFGEKLNLETVCYLAGLLHDLGKYSDKFQNYLKQAMSDPNSVTRGSVDHSTAGGKLLYEYLHQKNQCPYQKLVAELVGNAIISHHSSHGLQDFIKPEEDFSLDYLKRVRDKELPEYGTIKKRFFEDCLSESEFLAYLEMATEELKAFFISENKPTENQLFFIAKMIYSCLLDADRTNTMNFETRTTYEPIQQKPLFLKYSQRLEQKLKTFEEGNPTPINQLRNQMSKRCLDFAKEPTGIYGLAIPTGGGKTLASLRFALEHTRIHEKERIIYVTPFTTIIEQNAQVVRDILKEDRYILEHHSNILQEEIVDQKNKQNQGGLEERREREEVSMKDNWEAPIIFTTMVQFLDVIYSRGTRNPRRFHQLHHAVIIFDEVQGLPVHCTYLFNEAINYLKNFAQTTSILCTATQPALDNLDKKLQKDKDILEKSELQKIEAAFERVEIIDKTTQSAWNIKDTVSLIEEILQERNNLLVILNTKKAVLKLYQLLAEQSSEEIELYHLSTAMCPAHRKQILKEINVKLNAKNQQRKLVCITTQLIEAGIDISFEAVIRSSAGLDSIAQAAGRCNRNGEQPNKQPVYIIRLEKKLEDLKYLKEIKAGKEITLKMLENLRMDSNLYSGKLLSFEAQNTYFKQFYKHSDIEPNLKYPAAKNSLELFSLLGKNENTIYQYKNKYGKEQFPDLLLHNSTKTIGKYFNVIDTPTTAVLVPYEEGKDIIQRLNGDELALNELGPLLKKAQQYIVNLFSYEIEDLQKNGYIRPLYHGEIFALCERAYSNVFGIDKTGSVANQTIVL

SEQ ID NO: 12070 - protein, 790 aa, Caldilinea aerophila DSM 14535 = NBRC 104270
MRPSRWPDWLEDVWAKSAEKGAGGSPESLAQHTWLVLERFSDLVRLRPDLPQRIGVPRLWHVLFWAILIHDFGKAATGFQARLRGGPRWPYRHEVLSLAFVDWIAGAFTADELPWVVAAVASHHRDAEEIQTRYTPPDDPDEEDIVASLIAELPDDSLRGMWRWLSECSEDWIRSLELHSVGVQVAPLPEIERAVQLVRQKGSRQIYHWLRVYRRFVKQLAQSDDYRLLIGTLTLRGHIVNADQSASAHVKRLPRVDFATATVLERCGIDFGRLYRHQRLAEKTSGSALLIAPTGSGKTEAAQLWAARQAAEGRLTRLFYTLPYQASMNAMQRRLAQTYGEARVGILHGRALSALYRLMLEKEYGPEQAAKEARWARNLAQLNHQPVRVFSPYQMLKGMYRLKGYEALLLDYHGAAFIFDEIHAYEVRRLAMILKTVEYLARHYDARFLVMSATFPGLIRQKLQAALNAPAEIWADEEVFTQFRRHRIHLIDGELTDEKNLQHICNDACNGKSVLVVCNVVARAQNVYALLKERLADLAIDVILLHSRFAIRDRLHKEELIRQAVGSRSSGRKPVVLVATQAVEVSLDIDLDTLYSDPAPLEALIQRFGRVNRRRLQSNFAPVHVFCLPNDGQKIYEEDLVRRTLDILNRENEKPIDESLIRSWLDEIYTGAIAERWEREYARAAEEFEAICIRTLRAFESDHLLQEEFYKAFDGLEVLPNDLYDEYVQLQEEEPLRAHDLLVPISWRGYHVLARQGLVKAGDHRIPPVVLTPYTSNQGLLFDLSYGIGE

SEQ ID NO: 12071 - protein, 436 aa, Amphibacillus xylanus NBRC 15112
MKKYDFKAINLNPWLEEVVDQLGFKQPTPIQQQVIPVALTGESIIGQSQTGSGKTHAFLLPLFNQLELNKKEVQFVVTTPTRELASQIFDQVKKILALSGLEHQIQAKLFIGGTDKKRTIEKLTEQPDIIVATPGRLLDLMNEGAISIYTARSFVVDEADLMLDLGLINEIDQILVKASPSIQLLVFSATIPKRLQPFLKKYMENPTFIEIKDQISPNLLENRLVPLRHRNPAEIISQIAQTIHPYLAIIFANGKEACDELYHELSQRGLNVGILHGGLSARERKRVVKDIQSLKYQYVVATDLAARGIDIEGVSHVINAQLPKEVEFFVHRVGRTARAGMEGTAIHLYTDQDRALLSKLTEDGIEFSNYDIIKGEWREVKAWNNRKLRGNQKDDLDQEAWKRVKRPKKVKPGYKVKLRKEQERIKRKLKKDKYRK

SEQ ID NO: 12072 - protein, 375 aa, Bacillus subtilis BEST7613
MMGRVSEEVPLYSWKEENESNWKSIKLTWDGKLSSGQQKAANVLIEAISKKEELLIWAVCGAGKTEMLFPGIESALNQGLRVCIATPRTDVVLELAPRLKAAFQGADISALYGGSDDKGRLSPLMISTTHQLLRYKDAIDVMIIDEVDAFPYSADQTLQFAVQKARKKNSTLVYLSATPPKELKRKALNGQLHSVRIPARHHRKPLPEPRFVWCGNWKKKLNRNKIPPAVKRWIEFHVKEGRPVFLFVPSVSILEKAAACFKGVHCRTASVHAEDKHRKEKVQQFRDGQLDLLITTTILERGVTVPKVQTGVLGAESSIFTESALVQIAGRTGRHKEYADGDVIYFHFGKTKSMLDARKHIKEMNELAAKVECTD

SEQ ID NO: 12073 - protein, 375 aa, Bacillus subtilis BEST7003; identical to SEQ ID NO: 12072

SEQ ID NO: 12074 - protein, 804 aa, Methanothermobacter sp. CaT2
MPMLDLKDFVSDHRARFEELYDIDSSFFEENLIAKTNDEKSFTLEGHTRGALESLRKFLNENTETFDSFAKRHKIEKQLLLDVLFFAVFFHDIGKGTLEFYNDKILKKQKSYHPLYSVYFTYNLEMPKIGDVDYITLSILTHHTLLHDDIYSDERFAELEPPTFFKETLKFAKEYKRYYKEFFNRPCPYEFKFELPSKKPYNLLRDTFSWSSWGEGIIDNLNTMLSQATPSKKKEVKEIYGFITGNLIRADWFSSGSYELDAELISKDELIDKIRSRADLRGHEFHGLKRFQEVSSKSSDNIFIKIPTGEGKTEAALLWALNNLKNRHTKIIYTMPTQVTSNSMYKRLKDYFGKDKVGILHGSSSIILAEEYNDDQEKIWKEKIINKTFSKPITVSTLDSFLLSFFNVYKWPLSQLNVENCLLIVDEVHSYDWQMMGVLKRILCELNNRGCKFAIMSATFPVNVENILLEDLDYNMITEEGLFEHRPFSLKVENSSILDKIDSIINKFNNNKKVLVVLNTVNKAKEVYRALEESGSFKTSDSFDRDSNLILYHSQFTKAHRKQKESEIELKEKWKNRGLVVVATQVVEISLDIDFDVLFTEIAPIDAITQRLGRINRSKDPHKKGEVYIETCIEAENGNGRWVYPYGREVIECSKNIIEDGEPSLGEMSEMVFNLYTSLLEIESINLSFNKKLEKGYNKYDEIINKRGPYTIRFKTENMEEVSRLLSIRDVDERFEKIDVVPAAFFDEEDPDKFENTVGIYKWLFLKMLREGKVDDMKMFYLIHGVYSYECGFEVVDADDWNII

SEQ ID NO: 12075 - protein, 793 aa, Taylorella equigenitalis
MFIAHTRTKDSVTQTLDTHLSNVGLLAEKFAQKLNLGELGALLGLLHDLGKFSDKFQKYIQNNPLDFDKDDSENNPQSISRVDHSTCGAQLIIDKLNQSHPLIAQILSLSIASHHGKGLIDIINNNNEVWLNRLQKDRELTNFNSAIENATNSNCDALNKTNKLFTSSFESFYSYVNQLNADISLSFIEKKFYLGCLTKFLFSCLIDADRIDSADFESNTSTSDRNIFSPYKWEIALNALETHLKNFSSESNIQKIRESISNKAFACGSKPKNIFKFTVPTGGGKTLSSLRFALKHCLEHKLDRIIYVIPFTSIIDQNAQVVRKILGDEWVHEHHSNIEPEQITLKNKLISSNWDKPIIFTTMVQFLDSWFSLGTRGIRHIHPMTNSVIIFDEVQSLPLDCTFLFCNVINWLKHYGNSSIVLSTATQPPFELLEPKENGPLRIDDNSEIVGDLKEVENLYEDLSRVNIHFDKTKKDHDQVFSFVEDVYNKENKTLFIANTKKTVLDIYNKFKEKNYPVENIYPLTTYQCPAHRKTIIDELKDKLKSNKKTICISTQLIEAGVDISFNSVIRVLAGLDNIAQAAGRCNRNMELKEGNLYIIDILENLDKLQDIKEAKICARPIIIGEKDNLQNILKPDVIKNYFNQYFDSQNNRLTYQIYEKKITMLDLLSTNSNCTHNDDKYKGYLTQSFRTAAENFKSIDAPTKSVICPYEKGVNLIAILCGEWDPKKFRETLIEAQQFSVALYPSTWKMLLDEGAIHPINDTGIYYLDEKYYDSKLGLNFEGNAQMGEFYI

SEQ ID NO: 12076 - protein, 872 aa, Pyrococcus abyssi GE5
MIDVFKGLESEIVNLHEIPPRKGSYGSFKFRHEEVNKLVEELGFKLYSHQVEALKLLYSGKNVVVSTPTASGKSEIFRLFIFDEFLEDSSSTFLLIYPTRALINNQLEKFERENEIFSKITGRKVGNSILTGDVELSERRRIRREKPNVIFTTPDMLHYNLLPRWLDYKWLFKNLKLLVVDELHIYRGVFGSNVAYVFRRLFLRLRRLKVNPRILALSATLKNPKDFAEKFFGFEFEEVTEAGNPSPKRYIIMFEPTRFSGEQLIRQIVERLVENDVKTLVFFDSRKGTERIMRMFLGSKVFNLITTYKGTLTKLERWRIESDFREGKLKALLTTNALELGIDVGDLDAVINYGIPSDGLFSLIQRFGRAGRDPNRVAINGIVLRRNGLDYYYKEHFEELVEGIEKGLVEGIPVNLDNERIAKKHLHYLLSELGVVDVNEIPEHWRIALRPLKEEGIVEEYLNPLTNKVEIRIKKPAIYSSIRSTSDESFFLVKDEGWIRSSLVRKSGGELLRFVNYLKARGFIIEEVDEVEFYRSLLPGMVYPSRGRLFMVIDKINVDKFHFVFAQEIPMNEDVETNVHKSENVEVLKVQDEKSFGPIKVYFGRLKVTHEYLGYAVKGKDVERHVERLERLRDAGILRGEIEFNVTMFEEWWKFARVSFYSPYKREFETEGVWLVFPRSIDEVPAEEFRHFFSIASEYNYELAMFLFNKLSRGVLFPSLLGATTHYIRAVIRKVAKEEGLDENFVFAVKKMVDSKDGVKSGLHAIEHNLIKIAPVVTHVDSRELGGYSYDDFNGLPTIFIYDGNEGGSGIARLIYENIEKLIVRSREHIAKCPCKDGCPACVYSPKCGTFNEFLDKWMAIKIWDKVLNQKV

SEQ ID NO: 12077 - protein, 529 aa, Pyrococcus abyssi GE5
MSVYDVVVKRLSEIKGFKPEKRPVLEEALDKVLSSTRSPFLVIQAPTGYGKTTLSLSLALHSLKDSSLFDRVIHVLPMRSIIEDIDRTAKEAFGFSRTKMMGSSEEFLHLFPLNITTVDTFTWDILKLNTKKITQVERGREFGYDYLTQASILTSLVIFDEAHFILEEPRMKTAFLAVLRFLMENNVPIIIMTATLSRGYFELFKKYAQNNGYYFEPEPLVPDENDPFIKRESKKNFEIQFKTGNPLDFIDSAKRNAIIVNSVKRAVEIFDQAKEDAPKLGFEEEEIMLIHGRMKPSHKARLIEKLREWKNKESFLIIGTQAVEAGVDFSVDVMITDAAPINSLIQRFGRVARYDEKNAEIIIIEDAPVHPYDGKKVERTIALMKESSTLNPRIPQTYQGIVDEIHGKTKTKVMSGVDRSRERKLRVLLKDPTKRSVDVLSEIKSMIKEEGPLLRDFLIPLEVDDEYVLVSPEKMLELAKRGLLQVRVGENEISVDSEAIAYKIAERIALGEKIVVKFTGKYDEERGIV

SEQ ID NO: 12078 - protein, 3374 aa, Montana myotis leukoencephalitis virus
MTKGKMKNANKKKAKNSKTNPGRSGRSNGMDLVMGIMHFATHIAMGMKVNKRLKTFWKVTPPGRLAKGITRLINILKTLLNAVLGRKKQRSAKTVWVLFSMLALMVAMEIEQQGTSLVIKPQRSDVGRPVRVSTGYCMFSAMDIGITCEKTIQYECVTLTTSEEPFDVDCYCRNVTNVLVEYSTCNPTVERAKRSLVIQDHPHSETVAKPTLWLKWNTVNDRVGMTEEWVMRNTWKATILTLAIIAVTGLNWKGVLLLVVALMFAPNLATNCVSIQKRDILRGSGSTTWFDVLLEKGSCVTIVADDRPTVDIWLDRITHESPIAGREYCMRVDISGLKIATRCPTLGEAYLSEEHTEDYVCKRGFSDRGWGNGCGLFGKGSIVGCVKTTCKSSGIAKSYSYDIPKVKYVISTEVHKGELISGNVSASVVSATFSSEAEKHSMELEDYGRLEFTCRVVSGSNLGSVRILEIDNHYFNVHEDWLLDLPLPWRIPDGHWHDLGKLIAFKEPHAVKMVVQAYGDQRASLLKSLVKAEEIAKSGNSYYLPGGHVDCRVSLVNLKLKGTTYPYCGDSFVWKRRPTATHHGTVAMEVTYQGTDVPCKVSVIVEKDGQNGGNAGSLITSNPIITAQGSSVFLELEVPLGFSTIKVGAAKQQWRQDGSSIGKAMARASRAFEQTLMTAGSYWQSTDTVTSFSLMRMIRAPLAMLFGDVGFMGKMIISIVCIWFAMNSRNMTLSLVLGVLGFGLLAFTTGVMGDQGCVLDISRKEMKCGDGLMIWNEINDFKHGYKYYPEDPETFLASLVQDGEKHCGYQPSNLIELRMWQSLEKELNLYLEDQKIGWNIKVAEEMKHFPKTINVGWERRQGRTGLTWTNWMKSMPGIHHFMNKNTDLTGTYFVGSIGLDECPASNRSWNAFKVAEFGVGLVHTRAFIDIRNQPSLTCDLGLIGSAAKDRMIVHGSPWMWMESYEVNGTVQLQKLTLTHTVECLWPITHTLGNRMVLDSKLILPKEMGGPASILNMVEGYSEQNKCPWNQGPVTVERGYCEGTEVEISEDCEERGPCTRSKTQGGTTIPHWCCRECKLPPLKFTNPDGCWYAMEIRPVKAHVGLVSAQNEMSPLDARCWGVFSILVLYYLGILTKIEKGNWGPSLIVTISIMMWLHIIDVTELLHYLLAVGYTFVWQTSEPMLWIVAMQAIFQLRPGFAVGFALCKTWRFERIVGMVACMWTIQELTTPYEAFWRFMDALGLLVYAYSASHSTRQSYLYVVLMLSLTKIQNATIRLAVGMFGTMLLMLVGRKFAESDWLQKTKVTIAGATRLMELPYFPLVVSYFMRGQPSKRATDYMSILGVVMALGAAVCRNGINTDPWIIGVMALVLLFFLFQVSSGEMVAEWAGYHEWKKDCPKSVGSISLEVKRMADGRLINMSKEKDSLWEMGIVGCGMVVTAMHWIGIPLTIVALAIKSGLDGKRRSLYLLGLGEGEPESNQRITDGVYRIKVSSLFGKKQVGVGVWSEGSFHTMWHVTRGATLRIGDRKLSPEWANITEDLISYNGGWKLEKKWKGEEVQLHAFTPSNETVVTQLLPGSMKTEKGEELGLIPLDFPPGTSGSPIITSSGHVVGLYGNGIIHGDVYCSSIAQAKEVVKEETVKAVEGDEWLAKGKITVIDAHPGSGKTHKILPSLVRRASERRMRTLVLAPTRVVIKEMENALRGMDVSFHSSAVSSKTPGSLIDVMCHATFVNRKLIHMPQKNYELIIMDEAHWTDPSSIAARGFITTMSENKKCAVVLMTATPPGVQDPWANSNEKIEDVVKVIPEGPWKQGHEWITEFEGRTAWFVPSQNAAQGIAKTLREHGKKVAILTSKTFHDVYPKLKTEKPDFILTTDISEMGANFDVERVIDPRTTLKPIEKGNTVEISGEIQITPASAAQRRGRVGRTPGKMAQYIYQGEVEPDDSELVCWKEGQMLLDNMSVKQSMICTFYGPEQEKMPETPGFFRLSEEKRKVFRHLITQCDFTPWLAWNVASGTKGIEDRDWVNLGPKENLVTDENDDPIVYKSPGGKEHKLAPVWLDTRLTRERKDLAGFIEYAEKRRSSVLTAIPGLLYSRFLSAFDTIYIYSTSDPSSRAFKMAERELPEAILCVLQGFLMCVGMLALIVWLVTRTKVDRMCIGFCVIVMSGIMAWIGGAPLSLVAALVLISFILLVCLIPEQGMQRTQIDTTLATLVLAIVTFGLLVFANEMRWLENTKKDLFGQPQTSPSVNTGGIIQDLLQLDIRPMNVWGTYVALVTVARPQALHNLKMFTKKIVSGVVAGKESAMERLPTGGAWMNLRMGDLTLLATTLKGMTCFNLLGGLTFAFIHWFWFFPLHEAAESAKAHKIVTQSLSKNNMVDGEVIYQLDEVRAETETNERNFSLGVAGCLALLNIVMCRKPWTVLEALMIISVVAKNYLDPKAETFWTLPVASGLSALLRNEFLGLVPIGYRVWKHLSPGRRGLSLSHLTLGEDWKLKLNKMTKSDFLEYRTRLITEVDRGEAVYQLGRGKTNTGHAVSRGTSKLAWMHERSLVRLEGCVVDLGCGRGGWSYYSAAQNPVRKVDAYTLGYGGHEKPRLVETLGWNLITFKAKTDVFSLNPYSCDTILCDIGESNPSYAVEAQRTIRVIDLMERWLKVNPQANFCFKVLTPYTGNVLERLHSFQTRFGGGLVRVPLSRNSTHEMYFVSGITNNVVGTVNAVSRKLLQRMSAKGGSRVIEDIRFPLGTRSNLTNLVKADRKIIQRRIDKIKSENKNFWMEDTNHPYRTWEYHGSYHIRDVGTKCSAPNLVVKLLSWPWQALESVVSMSMTDTTAFGQQRVFKEKVDTKAPEPRVEVKKVMRVVFNWLVHVILKNGGKVRKCTREEFIKKVESHAAIGAWSKDIPEWGSAVEAVHDERFWNMVDKERQLHLTGDCEMCVYNLMGKREKKPGDFGVAKGSRTIWYMWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICSAVPANWVPTGRTTWSLHATKDWMTVDDMLSVWNRIWIEENPWMKNKQPVREWNAIPYLPRREDINCGSLIGTSKRSTWATLVPGAVMKVRNLFGPEKFSNYMDCIGRYHVGHQDFCLY

SEQ ID NO: 12079 - protein, 876 aa, Corynebacterium diphtheriae
MNPHEELWAKQKGLAKPYPLLAHLLDSAAVAGALWDHWLRQDLRQMFIEELGSNAREIIQFVVGSHDIGKATPLFQYQKAQKGEVWDSIRYAIDRTGRYQKPLPSSYLVKKTSGGPNRHEQWSSFASKNEYLKPSAAAKENWIGLAIGGHHGRFEPVGYGRHQRKAAEDLAKSGWSAAQQDLLRALEKASGITRASLPSELSPELTLVLSGLTILADRISSTESFVITGARMIDDGTLHLATPIDWLKTRKLDSEKHVAKTVGIYHGWNNHESAIHSILKGYDPRPLQTIALQNQVGLLNLMAPTGNGKTEAAILRHSLKENDRLIFLLPTQATSNAIMRRVQGIYSDTPNVAALAHSLASVEDFYQTPLSVFDDHYDPSKEQFESSMSGGLYPSSFVCSGAARLLAPICIGTVDQALATALPGKWIHLRILALANAHIVIDEVHTLDHYQTALLENILPILAKLKTKITFLTATMPSWQRTKLLTAYGGEDLQIPPTVFPAAETVLPGQFNRTLIDSDSTTIDFTMEETSYDHLVESHVKWHQTTRLNAPHARIGLICNTVKRAQEIAAALEKTNDRIVLLHSRMTTEHRRRSAELLESLLGPNGNRKTITVVGTQAIEASLDIDLDILRTELCPAPSLVQRAGRVWRRNDPYRSSRITADHKPISVVFIAEAEDWQVLPYLRAETSRTQRWLEKHNQMFLPQMAQEFIDAATVDLDTATSEMDLDALALMGIHLMKADGAKARIQDVLNSDSKVSDFALLTSKNEIDEAQTRLIEEGTHLRIILGDENESIPGGWKHGLSSLLKLKASDRESLRTALLASIPLLVSEKQKQLLYQHNLVPLSSSKTVLAGFYFLPKAQNFYSKNLGFIWPEEKD

SEQ ID NO: 12080 - protein, 732 aa, Photobacterium profundum SS9
MMDEYQRLDTRIQKWVFKQGWSDLREIQKRAINPILSGDRDVLISASTAAGKTEAFFLPACSATADMEQGFGILYISPLKALINDQYRRLESLCEELDMPVTSWHGDSSQSKKKKAKKTPSGILLITPESLESLLVRDAGWVQQAFGFLKYIVIDEFHVFIGSDRGLHLLSLLNRLEHLLKRYSSPIPRVALSATLGELDQVPLSLRPNKSMPCEIITSSKSHTTLKVQVRGYIEPLDLQSDDLRDSAEDQICKELYRLCRGSSHLVFANSRKRTESIAAQLSDLCEANIVPNEFFPHHGSLSKELREELEARLQKEMLPTTAVCTMTLELGIDIGKVNSVVQVTAPHSVSSLRQRMGRSGRRNSPAILRMLISEDELTKSSSIIDKLRMELVQSLAMIRLLIASKWFEPADTSQMHFSTLLHQVLAVTAQWGGIRADQLYTLLCTNGPFQKTTIQHFKLLLSHMGFCELLTQLSSGELVLGIQGERLVSQYTFYAVFKTPEEFRVVVGNKTLGTLPIDSVVIQGQHIIFGGCRWKVLDVDSDKKVIHVEATKGGKPPSFGGEGMSIHDVVRQEMFQIYCEGDYLIQVGHGKVDYIDTVAKGLFKEGACYFKDSKLESKSIIQQGQYVYIFTWMGDKVVNTISAILLQRGFKAGTYAGVIEVEMASIDDVAQCLQSTVKTGLPTEAELAKMVDEKLIEKYDEYLPDELLCEGYGYRAFDCVKAEAYLTKLVM

SEQ ID NO: 12081 - protein, 927 aa, Photobacterium profundum SS9
MLRQTASKSTAVSCHWIRSRSRSQLLWLVGNKLKFNQQGIVPVNSTGKEVFMDVATDKPKQGVLYANTQLQPLAEHLFAVGYLAEQLHRKLLPENPQFSIVNFIAGCLHDLGKIDPKFQQWVTNPKKKNYVADDGQHIDDAKFSFEKHPRHNEVSLLLYQLLDGTELTAIPKKNKRSIKHAVYWHHAKPFRKDKNSFTTYKDISKKLIAKQKDVSLGDMVGQAQLLLKQVVGIDKKYRELSNSTLEKAFLAEVSTELESSLPDAPALPTYKEYELEESVIANSGSIKSNARNNIARACLITADRKISSLSAADLHEVIFERSLDEKVAELLEVETTLSSQIETCLSSFFPNSERSIKQSEIAQQLTTAEDVAVLAGAAGCGKTKIALEWAKLQGAKRIIWVCPRVQVCQGLFYELTSEQYLPNATIEINTGEFKFHNQWDNPIPEDKNFSGDIVITTIDQIIGSVISHTKANTLIDFLNVSVVFDEFHEYVNMPAFNLLFAELIAAKKMQQQHANTLLVSATPHYVFVEDLLGIHQDDINVMPSFNQSQYQLDFKVFDDSVLGKDNPLFVPQNDCAFVISNMALTAQNSFIANQHDENAVLLHSKFIKSDKRKWFGEVYEAYKRGGTRKYEVLRSGPIVQASLNISCDYMVAEITNAEDCLQRLGRLDRFGENNVFNTYALAVPKSIAEPKGNSPASRFLSKMYVLSSVRAWYQCLLNALEDKIFTLPEIYQLYYEFHHRESTKRFIESDLVAALKESVKKINEKVIDPITVPPKKNKDKKRSKISKGSLRGDNRFVQLAVVDLSNAEPKYLEEYAYSIPLDDDSNIDNMTYATNAILGYGKSDKDLLAHMFKKHHNISGVKTAHTDKILLNEARDPESPIYLSYTTNDLLQVGGESSRHPHAIYYAVCDKQAIGAVSINQTTEDEE

SEQ ID NO: 12082 - protein, 593 aa, Debaryomyces hansenii CBS767
MTLKIGGIVPIVRVMRDTIIQRPVSTFVRYHSKRSRSFKKKANHKPGQVIRSKLGKTLEAPKTQPKLFSFGNFSGLDQPENKLKEMSSNAIKNITSFESLRIFPTVRSAMLEEIKYGYNLKSTYIKSKEELEIKPSPVQIAAIRKINQPRLRNVNAEKKLADKKASGQEILEDLQKSNEMNRLKIFTIAAETGSGKTWAYLAPLLSKLKEEDMRVFNMSEQSYADAKKTSIIRSVILLPTHELVEQVYDSLKRASKASIDLEASVNKKILQDPQYARYLSLPENQTSLNLNVVKWGSGDSHQKLFDAGRKRIDVLVTTPAKIQGLAKLNNVSRPFRLFNFVEYCVVDEADTLMDKSWIVDTTSVIRRLSKCKDLIFCSATIPKEFKKTLGKMFPDEFSIINIVTPSLHKIPKQINLKVIDAQLSPYNGSKTRCLAQALYAIHNDGTEQGYVKRILVFVNEKRDVQPLADTLIEKFGHREEDIIGITGADNADDRLAKIEPFLKPAELLEEDLDGSKVKVLITTDLLARGLNFNGIKNVILMDLPNTSVDLVHRVGRTGRMRQSGRVFVIIDKKTGKSWIKGLPKVIKKGIPLG

SEQ ID NO: 12083 - protein, 828 aa, Aromatoleum aromaticum EbN1
MTKRAIDMPIAHWRASDSTPQALSGHLSNVGGLARAYAAKLGLESAGEVIGLLHDLGKYSEEFQAYIGSALGLIDTDDDEYVDAGVLKGKVDHSSAGAQYVWQALCQKGRLERFCAQILAICIASHHSGLIDCISADAGTFGEDTFDKRMRKLQERTHLDEARHSADAEILARCKELLDNAELSACVRAVVEQILRASPQKRVAQQQIGLATRFLFSCLIDADRVDTADFEHKRVREYRSNGEYVAWSVLIDRLERHLQVIRSDRPIDALRREISQHCLDAASRERGTYTLTVPTGGGKTLASLRFALHHAKQRRLDRIIYVIPFTSIIDQNAQVVRSILEPVDEPADHGKVVLEHHASITPEQQTWREKILCENWDAPVVYTTMVQFLEALFGAGTRGARRMHQLANAVLIFDEIQTLPIKCIHLFNNAINFLAEQCNSTVVLCTATQPLLHQVSADKGAIRLHRQHEIMPDVRKLFDDLKRVELRDRRKPGGWTYSEIAQLALEEMRRAASCLVIVNTKDAAKQVYQSCREQLDDEETLHLSTDMCPAHRKQELGRVRQRLGAGLPVLCVSTQLIEAGVDVDFGVVIRFTAGLDSIAQAAGRCNRNGRPEPGVVHIVNPQDEHLEKLPDISTGRDKAERVLDDYATHPDRYHDNLIGPEALTDYYQYYFFDRQKEMDYPVAAKDLGYDDTLLNLLSSNSQALSEHHRKTGGVPDLLLQQSFMTAARAFKAIDAPTQGVIVPYGAGGRTLIADLHAAFDVQLEIDLLRTAQQYTVNVFPHVLRQLSEASAVREVKPGTRILCLDERYYSNEFGLATEPVSRMEVLYD

SEQ ID NO: 12084 - protein, 950 aa, Corynebacterium jeikeium K411
MTDPHSAPLFDLDSWNDLVDSFSPTASAFLAKSGDEHGPMSLVQHMVDSGAVATYLWDTWFSPQTKDFLSRSTRLPPEHIRSLAVFLVAAHDVGKISGPFLRKLRSPETNAPLLYPLENAGIPIPDLTPDEDVANLAHPLYSRELLKRWLKTHGLKAPVALSLTQTVEAHHGWLTTAGRKAVTTFVNSYPPEWQSAVDEILDTLASTAHVQPALDGLEGKPPTTAIQIITGFTVMCDWLASNTDFFPLRFSGSQADRIKLGMAKAKFDLHTEFKHFSEDPTQIAENYRVSFAWPESATPRPVQFAVAELLNSNSPGPTLLIIEAPTGEGKTEGALQAALLFAQHNHASGAILAAPTMATANGLFKRFSCWVENITENSAVSSLYLAHSKNRLNKDYRKLRYSDIGEDCADHGTVIATDWLSGRKNGLLSNFVVGTIDQVLMMALQIRHSMLRHLALAGKVVIFDEVHAYSTYTNEYLAETLRWLAAYGVPVILLSATLPTSRKKELVTAYGGQMHKNDLALAGEGYPLLTLVTEEGVSEQAVTPRPDDMHAKVEIIDDSVEELTRLVTELCSDGGVVLVICNTIKRAQEAFTALDSVFPDEVRLHHSAFTGLDRARHEEDLLNELGPASQRKQGRPPLRIVCGTQTLEQSLDIDADALITDIAPMDLIIQRAGRLHRHQRPDSDRPEKLRDARIYIRGVEETTPVPIWDTGTEYIYDDALLLTTYQLLSTEVVETGFRRPSDVPQLVQRAYDLDADHNFPEAWAARWEESKTSSRGKDDSDKSRSKVFRIPSPDETGKRLDSLFEMLVHDRSEEEIKATASVRDADNSIEIIPIVDDEYGYRPLPGLNNDQPECVVEDTTIPNFDTAFQLAASTVRLPTMFTRSDKVWDRTVDALEDQTPEGWKDHYLLRGQVALRLDQNLGATLADVKINYSELLGLRTEGFPGSRNGA

SEQ ID NO: 12085 - protein, 445 aa, Lactobacillus sakei subsp. sakei 23K
MGQQVIACGRQFTAAQLADTQNNNYSLPQIKRRPAFLRVKHRLVCQRCQQVVPPQTCLPDGRHYCAQCLLFGRLVEGDWLYTVPECHLFENNIPKLTWEGQLTPHQEKAAQAVVEVVQTQKRHVLTAVTGAGKTEMLFQGILVALQKGQRVCLAAPRVAVCLELYPRLQAAFATTSIMLMHGEQTEPYRYTQLVICTTHQLLKFYHAFDTVIVDEVDAFPFVDNPVLATAVEQACKPQCALLYLTATPTPAIKRAIAAKQMTVSELPLRFHGHLLPEPQRHVAFNWRAQLKKGRLPKRLERDCQTYLKTQQILLFVPQVRLLQPVANRLSTLLPAVRIETLHANDPDQIKKITAFRAQQIQLMVTTTILERGVTFKNVAVLVLGAEHMVFNEAVLVQIAGRAGRHKDYAQNPVHFYYQDYTRAIKGACRQIKTQNQRGRRLQSTV

SEQ ID NO: 12086 - protein, 897 aa, Dehalococcoides mccartyi CBDB1
MKEMIMTNDPNLKLWAKTGRGGDLYYHPLLYHMLDVAAVATHMWELLSEDQRKRIGYTLGNEARAITLFLAGGHDIGKASPGFQQQVPQLSELTDLQVSVNDQNRPHGFVSACVLNRFFTTVLGQIAGGHHGIFPRSLDLRMGRDILGNREWEIARNGLLQELAKVLKIDISDDTKCKPKIIDPFIIPLLAGLISVADWIGSNQDFFPCLTKPGQLPELVGDKYFEVAKDRADKALHELGWMPGVIFAKEAPFTHVFSGFIPNSLQNSIEDIAIKQTSPYLMIIEAPTGQGKTEAALYAADLALCRGFARGIYIAMPTQATSNAMFKRVQVDYLKNRRHKGKLNLQLVHGNALLAGMGEVREGEISDFKIADTDTGDTNTDMEAQSWFTAKKRPLLSPFGVGTIDQSLLSVLQTRHWFVRLFGLAGKVVIFDEIHAYDAYMITILERLLQWLAEIDCTVILLSATLPEARRKALIYAYSGQNSSENKCYPRITLAQSRHYINQETNELIVCKEVSVEDSHCIYLNFSRNDLEILAGELTRKLEHGGCAAVICDTVDRSIEVFRYLQANMHETECLLFHARTLQVWRREREDEVLRKFGKGTKQHDGSYTNPDRPFRAVLVATQVIEQSLDLDFDLMFSEIAPVDLLLQRIGRLHRHSRTRPEGLEMPQFTILCDGNRGGAPPDTFGKNIEHIYDRYILLRTWLVVRGKAMIEVPAETEKLIEKVYGTDEEICGPDWIEALEKAKRNLVHEQEESQKAASRLLICPPCDSEDIVRQFNCELFDDDDPEVHTAIRAATREGDPSIMLVMVNAGAVLAAEPALDEVRDLLGHSTMLSYKGLYHELASNCETPKGWEKNTHLNHARLMRLDENNRAKIGGYILTVNEKLGIVIEKESKDNG

SEQ ID NO: 12087 - protein, 802 aa, Clostridioides difficile 630
MKNIMQKEILAKSYNLRTNQQEQTLVEHIKDLFEVLESILELNLYSDKDVEILKICCALHDLGKINSIMQQKMEINNKISYSCSEEERKKLESDKKSLKKIARHNIFSGAFLKDILEKMNLSEEDKLYIYKSIMLHHGNYEDYMRLSISKVQEEIYEYIEKGILEKEEFNLKDIESYINSILNVDFKFGEDVLDYDYIDKLSESMFIDSDYNNGQIDDSVLNYRKFKYILYKGMLNLIDHSASSRQKGIKFYNDFTDEEIDNMILNEIYKSQGNLEKNNIEFNTIQKRLRELSGRNVLTVAFTGSGKTAADYRKTFKRKFFLVPNKISAESFYRKNIFQNKNDLDTRSSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDVDFHLMTATLPKSYKEQMINKGIIFQEESNENVTDKGEIVFIESNKEEEICEGKDVKVSFIKEKEIKSIVEDALENKQKILIIKNTIDSVNRTYEFLKENLSDKYGGVDIDVLHSRFKFKDKKEKYSKILNGEGDIWISTQSVEISLDLDFNIIISDLATMDSLIQRMGRCNRNNKYEYGNFYILPSEDKIYDNKLKNTTKNILKDILKTNSIFTMGIRKTILDDYYDNSVVKKYFEENFISCDKEIKNIYGINKEIFDGLDLIFNFEPYKNIVDSKKEAAKIFRDVDVSYKIILEEDFYKEDRELQQDSIQVSGFIFNRLYYYGLISKVEGYMVLKSSSKFEYNSTVGLILK

SEQ ID NO: 12088 - protein, 773 aa, Clostridioides difficile 630
MLYAKSNPVETLREHTDELLKQMNVLRESYGKNINSLDFLEEEIFWQLLDFVIEFHDIGKAFSPFQELIKSRMDTKINEPKIVTHLENNVGHNYLSPAFIDYSYIDRKKNKELRAVLNQVIVYHHERDIFIDKDFKNLIQKILDEDLINKVYELQHEFKVRYPIKTEKLSKVYLQSVEKRIDKNHKYYNLYIMLKGILHRLDHSASAHEVVECNNVINIGEQTENYLMKEFGSLREAQSFAKSNRNKNIILIAPTGMGKTETALIWIDKDKAFFTLPLRVSINALFDRAKNIVGVGESNDTFLGLLHSTAIDYLEESNQENSSEIVDLAKLLSCKLTFSTIDQIFKFPFLYRGYEKVYSTLAYSKVVIDEIQAYSPEIAAVLVKGIEMIHKIGGRFMIMTATMPTIYIDELKKRGVMNSNLAELTCNTEKIRHCVSIVENSIDENLGKIIQSGMNKKVLVIVNTVKSAVEKYELIEEIVKPKGIDVNLNLLHSMYIQEDRAKLEKYIKEFADSDSNGIWITTQLVEASLDIDFDELHTENSTLDSLFQRFGRCYRSREYEENSPNIFIYTEKATGIGSIYDKDIVEKGLELLKTFINGKECVKMKEKYKVEMVKILYSKESLEGTAFEKRFTSALNILDTITPYSLGSKDAQNILRNIEGYTVIPEDIYNKIEETLIKDYEELGQELINAYSNDDRQLINKIKSKRKKARREIIKKTVNLPIYKAKQNVIDIQVKGLEDLKILLYKYDIYENKHTKQIFGKGVLISNEIDQFI

SEQ ID NO: 12089 - protein, 841 aa, Candidatus Kuenenia stuttgartiensis
MKAFAHSKTDSVKEPFHTHCDKTLFYFDNIIQTYEIEDIFHRLITDIDVDNSVDNEKLLKIMREFVFFHDIGKLTPEFQAKLDGEKNKTTHSDKSFFVLVYAVLKLKKTDTVNNKEFMILFLLLYSVYKHHGRLNDILNDIQNFSCRADVKVLIDILQQLNEIPDNNILEAVSAGGFWKKWNDRGMRELVRKLSKESMSFFILVKMFHSCLISSDYFATMEFKTGQKFNHDILRNEIKEEVFNNFHKVDEFEINQKKEINFNVNISKDRNSLRNVNIEDIKWSDNQKRKEALNKIRSILNVVTENNLENILDEQSDIRTFFLNIPTGGGKTNISLRLALKIMEKREIKKLFYVFPFINLIEQSYEVLGKFIGLRNMARLDSRFIDSSDNEDNYEDDTSVFANYVDNLFFNKPVLFLSHVKFFDLFFRNDKNSNYNFYQIANSVVIIDEIQAYKDTVWTEVAYMFDVIGRFLNTHFIVMSATLPRLDILTNSTFHQIIPEDTSSKVFKHEVFNRTRITPDKKLKINESNDKNRFDKLVNRIKKLNKENKILIVLNTVKDSFDIYIKIQKEKTISEEFEVYLLNSTIIEARKKDILIACKDANRKIVLVSTQSVEAGVDIDFDVGFRAYAPFDSIVQVAGRINRNSGKECCEMFVFEDDASEKVYGKDLKSRETNKEAFFSKKTIDENSELQEFYKRVINGIDQKNKMSFVDSSQTNISDIRNLFLKQVDRNVHLIDGDTISIYIPYNEKGETLWIEYMSLFDGEKSLENAIRIKEFKKKLIPYSINVFNCYTKHGKLRKIIDEEIRHGFYYCENWHQFYSIEKGLDQEGFKKTVGEREAIFV

SEQ ID NO: 12090 - protein, 808 aa, Candidatus Kuenenia stuttgartiensis
MRILFDQLMSNKGLAPYPYQEEVAQRLLDGRNIFLRAPTGSGKTWAAILPYLWAKKQGTTFVDRLIYVLPLRTLATTLYAETVACCKSGFRVVCDPNARRGEKGELVITIQTGEQKDDPFFEGDVIFTTVDQCLSSYLNCPVSLPQRVGNINAGALLGSLIVFDEFHLLESDKAMRTAVEMLDRLKPFSQFVIMTATLTTKSLDLLKEILGGQFVSLTPDEVMSLPSHKEKKRAYRWINRPLTINDILDHHNGNRSIIILNSVTRAQNIYEEMAKRLEGSNTTVFLLHSRFYSEDRKKVEDKLKGWFGKEATKTNVILVTTQVVEAGIDISADNLHTEIAPLNSIIQRAGRCARYEGVRGIGTVWIYELLTNEKGLPDFGPYRENDHKALISGTREVLERLPSDGAILDFNSELERLDKVHSNIEERHLESYRQNQYSLKTKIHEAMDGRNEVAVRELVRDVASINVVICNDPSVLRFDKNKWPRMLSVPRSSLYKLSPFFEECRDFGETVAWYPIENANIIDETETSFGWERITSKDQIRNASWLVVINPEFASYSPDVGLKIGVKGCHEEIRYFDRPLIPRYKISYETYREHVQRVVAACRAMKPFYSYAATRLAERYKMSANQLETLADVCCALHDVGKLSMKWQEAVRKWQQHKNPQMLTGEPLAHSDYAPDMDFENKKKFPKQPPHASEGAYSVAGWLRDNFGVNAVVTWTAIARHHGAFTASLEDFRLINDTKKWVSETLPSSIEGIALTDNPDKLTQRSFQDDLLIFSGPNSEDTGLWPLYVFLVRRLRLADQRSQKGGEG

SEQ ID NO: 12091 - protein, 803 aa, Candidatus Cloacimonas acidaminovorans str. Evry
MIISHPAKNGYQEKLLVDHLAEVASDAKEMIQKLSLNLTTTTKDKLAFVAEKIGIMHDLGKASSYFQNYVRGGNRNNLTHHSYISAVITFFNFHSWKEYSSFAPNAFKCVQKHHSNLSSFWGEDLNNAALIDETLTIYKSVWENINNDVDLKKLLEKHNIILPELSYNSFQFMSDNLEEFSLNYSPTNIDEAVESFLIQNLLFSVLIDADKHNAAVKEYVFLEKLNPKLSFSPAKKIAEKNKIQSALNTLRNQFIDNIRSNQNITPSQKLYTLTAPTGSGKTFACLEFTDLIQSYEDNLRRVIYCLPYTSIIDQNYQEFENVLLSNLNEKTNLDYRFLVKHHHLVDYSAITKDEPTYNWEELQKDILSIESWESACVISTFVQLFHSLIGNRNAMVRKLHNIINSIILLDEVQNLPADYYPLLRVVFKVLAEKFDTYILSCSATQPYLYPDGKYIELCKKELFSVPDFNRVKLYINLKEQSVDEFCQNFLEFNDAKSILIVMNTKRSALAVYNYLSSNYQSSYQVFCLTTLHIPIHRQEIIDKINTILKEIQKKVILVSTQLVEAGVDLSFQRVYRDFGPLDSIIQVAGRCNRNNELGELGGEMFLVNLQKDGRLLSHYVYDKYLLSKTKECLEQFTSLESRQFSHIIDVYYQILDIGAKGEAILRAISDLNYDQNIQNQVPIADFKLISDDYATETVYILCDDTSTNAISSIIGYLDCLKNTKLPKEEIQKIKTALEKEYRALNSYQITLSPNELSVIYDSYKVKKLNDHIYYIDSEFIEDFYECSTGFKLYSTAKSSCLAL

SEQ ID NO: 12092 - protein, 782 aa, Gluconacetobacter diazotrophicus PA1 5; identical to SEQ ID NO: 11652

SEQ ID NO: 12093 - protein, 899 aa, Gluconacetobacter diazotrophicus PA1 5
MAMRSNGLEFFWGKARAVPAEGAMIGPVMHPLIAHMLDVAAVAVLLPENAKCGLDRRQLGLLVALHDIGKLMPAFQAKVEICWPEAILGGFPVELVPCFHDAAGLALLDLMVDDVLAALFANGQDGKCWRLTHKLKLLRAVAGHHGQPVSAQNRNTLAPDTIERARTLVALLFDVFRPPPILRPGDDTLRRLEWMLARVTIQADWIGSQQEWFPYVTPESVADPSGYFWNHALPRAQSAIHRAGLGPMVGAPFAGTAGLFDHIREPSPMQALLETLPVPSGPVLVVIEDATGSGKTEAALVMAQRLIAAGRSSGLFVALPTMATANAMYDRLAAAYRRLFQPSARPSLALAHGRARLDERFAAALAPDDGSDAFPDARIMDETAEAYCAAWLGSESRRALMAQVGVGTIDQALMAVLPVRFATVRHAGLAGKILIVDECHAFDPYMRREMVALLRFHAAMGGSALLLSATLTQRIRQELTNAFRSGLDTVDPAPLSGTAYPLVTLVGKAGAEEYPCALRPGLARSIAVRRLADTDAASREVIAAAAAGAAVAWIRNTVDEVIATARFLRAQGVELLVFHARFAMVDRLAIERDVLARFGKNKETTGRSAVLVASQVIEQSLDLDFDVLVTDLAPMDQVIQRAGRLRRHDRIARPVDREELLVISPEPVAEPDPSWVRRVLPGTAAVYRDPALLWRTARTLFRYGRIESPGRIRALIEEAGDADAPGAVPDGLAAGSTDAMGKALAAGFAADRNVLSFDAGYVADGALWEREARTPTRLEDLPYVTVRLAVMQDGRVLPWAAKIDPGLACAGEHRRAWALSEVSVAQYRLARCPPPPGLERVVAAARAEWPRWEREDESSVLLLILQKMEEGWRGAGQIETGHEVVIGYDRTYGLEVVPA

SEQ ID NO: 12094 - protein, 900 aa, Thermococcus kodakarensis KOD1; identical to SEQ ID NO: 12040

SEQ ID NO: 12095 - protein, 733 aa, Thiomonas arsenitoxydans
MTQQESSAFYLLDERIQRFIWAEGWESLRYAQEKAIPLIVRADRDVIVAAATASGKTEAAFLPALTHLLQSSPPGLIAYISPLKALINDQFGRLSQLCEQLEIPVWPWHGDVSAATKTRFLAKRHGVLLITPESLEALLCNRGTSIAAVFGSLTFFVVDELHAFIGSERGKQLQSLMHRVERAIGRSVPRIGLSATLGDMSLAAEFLRPGAGSGVALVESKEFSAELKVLVKGYEEPLVVRQRDDDEAPEPVTPAQIAAHLFKSLRGSNNLIFPNSRREVERYTHLLNGLCQEQQVPNEFWPHHGSLSKEIRSETEAALKQRERPATAICTNTLELGIDIGAVKSVAQIGPPPSVASLRQRLGRSGRRKGEPAVLRGYCVENAQGGRLSLADELRLDTVQMTAMISLLREGWFEPPVANGAHLSTLVQQILSFIAQNGGATIGELYHLLCGPASPFIGVSKGELVELVRHLGKKELLMQDPSGLLLHGRIGEKMVNHYSFYAAFATDEEFRIIAGSKTLGTLPVSQALTIGQRILFAGRTWRVEEIDEEQKSIFVTRAGGGTPPLFSGGVGRTHTRVRQRMRQLLESTEVPAYLDAAAARFLDESRATYARRGLAESYLVDQGSELVLLTWLGDAANEALACLLQSRGVASTAGGPGIEVPKHHESAHEIAAVLLEIGASATPSLEYLLADAKNLQREKWDWSLPDSLLRNTYASLRLDIDEALTWARGLSPG

SEQ ID NO: 12096 - protein, 763 aa, Xanthomonas albilineans GPE PC73
MAFYAHSTERSDRSNWQGLADHLNGVGERAARHAGPFGGQLLARVAGQLHDLGKYTEKFQARLDGDPAKVDHATWGARIACARYGDGGKLLAYTIAGHHAGLADGRQDKDSSRTSLHERLSEEYRAQALPPLLPDWERELTLPAKLEFPQGFARHPRPERRAFQMTLLARMIFSCLVDADFVDTDDFYRRIEGRKTREEEVGAQPTLAELRERLDTHLAGLPSKGGINPVRAQILHDVRAKAHLRTGLFSLTVPTGGGKTLASLAFALDHAIVHGLRRVIYVIPFTSIVDQTASVFRHALGAQDNSAVVLEHHSAFFDDPSKAPQAIEKRKLAMDNWDAPIVVTTAVQFFESLFTDRPSRCRKLHNIPGSVVILDEAQTLPYKLLRPCVALLDELALNYRVSPVLCTATQPALRQDQGFADGLEQVEELANEPQALYTQLRRVRVRHVGPLDDDALADQLRQREQVLCIVNNRRHAHALFNAIADQPGARHLTTLMHARHRRVVLAQIRKDLQEGRPCRIVSTSLIEAGIDLSVPLVLRAEAGLDSIAQAAGRCNRNMEWDIDSSEVRVFAPTNTNWKPPRELELFAEVFRDVEREHHGDLLAMDAIHSYFRKLYHRLGDDRLDNEAILSLLRKSTIDNLPLNTLARKFNVIQTTMRPLIVPYAPYAMESDKEVPEVAEVLHELEHAERVSVAGAARRLQSWLVQVPEQAYKALWQAHAIAPVAPERCGEEQFVRLCNPRLYDARFGLHWDNPQFLEGEQLFW

SEQ ID NO: 12097 - protein, 802 aa, Clostridioides difficile CD196
MKNIMQKEILAKSYNLRTNQQEQTLVEHIKDLFEVLESILELNLYSDKDVEILKICCALHDLGKINSIMQQKMEINNKISYSCSEEERKKLESDKKSLKKIARHNIFSGAFLKDILEKMNLLEEDKLYIYKSIMLHHGNYEDYMRLSTSKVQEEIYDYIEKGILEKEEFNLKDIESYINDILNVDFKFGEDVLDYDYIDKLSESMFIDSDYNNGQIDDSVLNYRKFKYILYKGMLNLIDHSASSRQKGIKFYNDFTDEEIDDMILNEIYKSQGNLEKNNIEFNTIQKRLRELSGRNVLTVAFTGSGKTAADYRKTFKRKFFLVPNKISAESFYRKNIFQNKNDLDTRSSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDVDFHLMTATLPKSYKEQMINKGIIFQEESNENVTDKGEIVFIESNKEEEICEGKDVKVSFIKEKEIKSIVEGALENKQKILIIKNTIDSVNRTYEFLKENLSDKYGGVDIDVLHSRFKFKDKKEKYSKILNGEGDIWISTQSVEISLDLDFNIIISDLATMDSLIQRMGRCNRNNKYEYGNFYILPSEDKIYDNKLKNTTKNILKDILKTNSIFTMGIRKTILDDYYDNSVVKNYFEENFISCDKEIKNIYGINKEIFDGLDLIFNFEPYKNIVDSKKEAAKIFRDVDVSYKIILEEDFYKEDRELQQDSIQVSGFIFNRLYYYGLISKVEGYMVLKSSSKFEYNSTVGLILK

SEQ ID NO: 12098 - protein, 773 aa, Clostridioides difficile CD196
MLYAKSNPVETLREHTDELLKQMNVLRESYGKNINSLDFLEEEIFWQLLDFVIEFHDIGKAFSPFQELIKSRMDTKINEPKIVTHLENNVGHNYLSPAFIDYSYIDRKKNKELRAVLNQVIVYHHERDIFIDKDFKNLIQKILDEDLINKVYELQREFKVRYPIKTEKLSKVYLQSVEKRIDKNHKYYNLYIMLKGILHRLDHSASAHEVVECNNVINIGEQTENYLMKEFGSLREAQSFAKSNRNKNIILIASTGMGKTETALIWIDKDKAFFTLPLRVSINALFDRAKNIIGVGEANDTFLGLLHSTAIDYLEESNQENSSEIVDLAKLLSCKLTFSTIDQIFKFPFLYRGYEKVYSTLAYSKVVIDEIQAYSPEIAAVLVKGIEMIHKIGGRFMIMTATMPTIYIDELKKRGVMNSNLADLTCNTEKIRHCVSIVENSIDENLGKIIQSGMNKKVLVIVNTVKSAVEKYELIEEIVKPKGIDVNLNLLHSMYIQEDRAKLEKYIKEFADSDSNGIWITTQLVEASLDIDFDELHTENSTLDSLFQRFGRCYRSREYEENSPNIFIYTEKATGIGSIYDKDIVEKGLELLKTFINGKECVKMKEKYKVEMVKILYSKESLEGTAFEKRFTSALNILDTITPYSLGSKDAQNILRNIEGYTVIPEDIYNKIEETLIKDYEELGQELINAYSNDDRQLINKIKSKRKKARREIIKKTVNLPIYKAKQNVIDIQVKGLEDLKILLYKYDIHENKHTKQIFGKGVLISNEIDQFI

SEQ ID NO: 12099 - protein, 661 aa, Clostridioides difficile CD196
MNNLYEYKAKSDGTSIDKHNEDMNYIMNQLVSIYNISNDMKNDLYEAIVCHDVGKVVKSFQDNIESSTRRVRHELLSASIKYLNRGQKLAILTHHKDIKFLEGQITNSIYEIELKELKELLDIEVEDIRPFIKEISRARNDDTRKLENILLKGYLQYCDHIASAGIKSIDKGFNSIKDFSIPKGVSYNSIQEKVLNMDKNEDIMIMAMTGLGKTATSLYWSNLVQNEYKSKRVYYILPYTASINSLYENLYNRNISVSMLHSKAPYFLNKISDEEDIKQLYQIYKKSVKQINVCTIFQLVKSVFSCKRFEMLLSQLKDSIFIVDEIHCFDTRVLCYTLEFLKYLKENLNVKICIMSASIPTCLKKLIQERLQISTIIEPDSKDLIFRHRLNRLSEGILDSIHKIENDLMQGKRVLICVNSVDLSQELYGRLQKYNPKLIHGRFNTRDREQAEKGIEESFLLIGTQSIEVSLDISYDVLYTELAPLDSLLQRFGRVNRRGDNAELSNIYIYDYDRKLNIYDEDIINRTDIVISDIIHNDNSIVDESKVPSYLDNVYLDIDMDKYNKHKVALEIIMKNMRLGVWNKSANNDMLNNDTISVVPECLLEEYKLYIDKKMYLEASSLFVNVSVKRYNYNKKMFYECGDIVVTSYSYNDKLGLIFDC

SEQ ID NO: 12100 - protein, 802 aa, Clostridioides difficile R20291; identical to SEQ ID NO: 12097

SEQ ID NO: 12101 - protein, 773 aa, Clostridioides difficile R20291; identical to SEQ ID NO: 12098

SEQ ID NO: 12102 - protein, 661 aa, Clostridioides difficile R20291; identical to SEQ ID NO: 12099

SEQ ID NO: 12103 - protein, 530 aa, Glycine max; identical to SEQ ID NO: 12006

SEQ ID NO: 12104 - protein, 911 aa, Ralstonia solanacearum CFBP2957
MEKGAAQYFAYWGKARMQEGTSQLYHLLVFHALDVAACGAELLRLPRFSLAPLAAELGWPLRVVEQIFIWFLALHDLGKFARAFQNLAPGLSPDLVSPDPKKQYLRRHDTLGWLLWQERAACLGASLPDPVHGFWAAWVQTAVGHHGMPPQETAGGGLLPLQLHTFYLPEDMDAAVAFANAVAPFLLPSDIPVPGRAQRQTLLRHAWRLAGLAVLADWLGSNQEHFRYCVHPQDLSVYWREVAQPAAARAVCMAGLSDQAVSPWQGSQALFPYLVSPTPLQQYAETVPLAQGPQLFLLEDVTGAGKTEAAMMLAHRLMAAGHAHGIYFALPSMATANQIYRRTAAMYRRLYQAGTAPSLVLSHGARQLVDDFRSSVLERQAHDDDFGYGREESSASAQCSAWLADNRKKALLADVGVGTLDQALLAVLPARHQSLRLLGLSGKVLLVDEVHAYDSYMHTLLCRLLTAHARQGGSVLLLSATLPTGMRAELVAAFQAGCGREGAEPAADTRYPLATHVHAEVSTHACATRPQLVRKVAVAPFHAEQAAVERVIDEARAGRCICWIRNTVDDARHAFMALQAHLPAPSLALFHSRFAMGDRLAIEAAALDRFGKASTAVQRRGQVLIATQVVEQSLDLDFDIMISDLAPIDLLIQRAGRLQRHARHGDGEPAADGCERRPAPTLYLLCPENTDTPASDWYAALFPKARHVYPDVGKLWLTQRALLAAGQIVSPGGPGEDGAVRSLVEAIYGAEADSIPDALQPAAQEREGKDMAAVSQAHFNALNLERGYCIDSSRHWDEDTKTPTRLSDETCEIYLAREEGGELVPFVAALDFPWEHAAVRVRAGTVGTLSECWQARFGPAIDVLRKCHRLLADPALVLPLVQEDGQWVGYCERNGKPQRIEYDDVLGLRGF

SEQ ID NO: 12105 - protein, 704 aa, Eubacterium  rectale DSM 17629; identical to SEQ ID NO: 11686

SEQ ID NO: 12106 - protein, 704 aa, Eubacterium  rectale M104/1; identical to SEQ ID NO: 11686

SEQ ID NO: 12107 - protein, 719 aa, Faecalibacterium prausnitzii L2-6
MERSTRLAHISEDGTRTQTVYDHLAGTARLAGSFAAPFGAQSEAEFAAWLHDVGKYSDAFQLRLKGGPKVDHSTAGAQEAWVRQHLHAAFAVAGHHSGLPDGGSPADDPGDATLFGRSKKPAAPYDGWREVTLPASTPPAWACADPLSLAFFTRMLYSCLVDADFIDTETFMDGRAAPRGSGTDIAALRDIVSVQAQRYLRAESPSPVSVQRNAVLRACLEKGAHGPQGLYTLTVPTGGGKTFASLAFALEHAAAQKMKRVIYVIPYMSIIDQTAAVFSGLLGAENVLADFSNAEYKTVEQDDLTPAQYRQMLASENWDAPVVVTTAVQFFESLYANRSSRCRKLHNIADSVIIFDEAQTLPGDYLAPCVSAIAQLIQHYYSTAVLCTATQPALEPLFRRFAPELHPQEITPDAARLYEVLRRTTLQDLGTLPQEELAARLANHPQVLCVVNRRKTAQQLYESLPAEGSYCLTTLLCAADRRRQLDDIRQRLKEGLPCRVVSTSLIEAGVDVDFPVAYREQCGLDSLLQTAGRCNREGRRGAEESIVYRFRLDECSTPQMLRQNVSALDYTARHQDTLDTPRAIQLYFNELSDLRGPDAVDKHGILGAFLRGIRGCQFPFAQVAEEFRLIENAARMVYLPVGEGAALCEQLRSGHVTRTLLRKLGVYSVSCYKDQFDKLDAAGALELRPDGSAILTDTSCYSEKTGLAMDVETGIGLYF

SEQ ID NO: 12108 - protein, 904 aa, Faecalibacterium prausnitzii SL3/3
MRWTLNKTRLLAGKTDPENTSLWLPLWMHLWDTAGIMERLVRQWLPESAKRAMGFEREEALLAHARFLGGIHDIGKATVAFQANILCTLPEARQRLEMLTPLDCPEQNRRESPHARAGEAILLWNDCPGGLASIVGAHHGRPQSCAAVDDQLECWESNYYPKGQEKVWQGFWTELLMTVLQDCGFDDTAELYDLDPQEEVLLTGLLIMADWIASNTEYFPLIPVEELGSMEDYPARVDRAWEKLALPFPWEAQPSIADPQEFAVRFGFAPNAVQRAVLEAADTAAEPGILILEAQMGVGKTEAALAAAEIMASRFGLGGVFFGLPTQATANGIFPRLLGWADTQSEETLPQAIKLAHGMAELNECYLRLQGRGVQLEEDAQEEHQVQVHQWFRGNKQALLANFVIGTVDQLLLAALAQKHVMLRHLGLAGKVVIIDECHAYDTYMNCYLDRALEWLGWYKVPVILLSATLPARRRTELVEAYQQKKAAPDAPWETSCGYPLLTWTDGAEVKQTAISSAAPGQTVQLTTLTEPELPALLRRKLAEGGCAGVIVNTVKKAQKIAQLLRESLPDKEVQLFHAQFLMPDRAARENQLMARIGKESTPKERNDLIVVGTQVMEQSLDIDLDVLVTELCPMDLLLQRIGRLHRHHRSRPAPLQQACCAVLDTGEDAFDAGSEAVYGQWLLWRTRNFLPRSIRLPEEISPLVQRVYGWEREAPGGAQGEEMRSIYEQTQEKKKARAEAYLVPQPETHRLAQLNTLDDWMQNEGACSDPAARAAVRDGDPSVEVLVMQRRADGSIHFLPWQEGGSAVAADSPPPPETALKIARQKLRLPAVFGKAWKVDRVIRELEADNRSRLAAWQLSPLLHGELILLLDENLTARLAGMELCYDRENGLYYQKEETDEGN

SEQ ID NO: 12109 - protein, 764 aa, Fretibacterium fastidiosum
MSRDVPREAWRTLLRGSLNGDLKSHPEKRLIDHLLGTAELARQIVEFHGLEDIAFDVEAAALTHDPGKADPEFQKYLLGKGKGVNHSLPSSFFTFSLQQDNADPFDAFFSVEAVRRHHSKIEDWRTSSSFWANYRASQKKIGEDMRALIPQWPCPLNELCWKKFIYAIDDRYPEDYPFPDYWLRLRSVLSVLVAGDRLDAINVKTMNLQPLPNFKPYPFSSVAGVSERRRATDAWRSDVAECCLRNVAEIRSPGLFTLTLPTGAGKTNIGLRIAHTLAKNLGYSTIVYALPFISIVEQNAKFAKDVFGAESVQEDHSLMLAALDDEDEKGEYDKPGEWKRAQRLFRYWGSPVVVTTMVQLWNTIFNSKAGATIDFHRLRNAVVLMDEPQGIDCHLWPELGKVLTFIHERWGTVFILMTATQPKIFEGTELAPRVCFPFNRHRYHFLKEKHGLKDLPGLLKEHVPAFAERSGMLVFNTRSSARAAYDLLRPILGDAPVFMLSRWMTPKHRRETLEEIKSLEVSGKRHYLIATQVVEAGVDLDFEWAFRDLAPLDSLVQVAGRCNRSGERSDGFVLITSLLSEKGRPFSARVYDDVPMDLTQLLLEEFPGFDEQDVQDIVARYYEKISNAIEPKPLWRDIEEGNWGDYTPLFKEMDFDVPVYVDHDGDLDDLLNELMTLDRTLDNRERLKTLNNRLQQYAIGVRKDLLKEWLDRVGNFVGGSSQNPLEQYGDYCVIRCSGIGEGPDSPYHPEVGFSPCSQGAGLDD

SEQ ID NO: 12110 - protein, 884 aa, Eubacterium  siraeum V10Sc8a
MKTSELLAAKSSFEDNTKWLPFNVHASDTAGIIKRLFNKWIAQNVRRRLCAAIGIESSENAEEIVCNYCKFIALVHDIGKLTPAFQRKLKDNIQGLDDRLLDAGIDLSGLTQISESPHNIAGQYILKKEFEVAPPTAVIVGAHHGDCSADRGQCSYEANYYGHGKVNVNEWTQIRAEWMEYALSVTGFEDVKNLPNPDVAAQMLITGLLVMSDWIASNTDYFPYIDIEERLNDEQCEERVRRAWNKLSLTDSWYADFIADSDSFFEERFGFKPNSVQREFMNVVSLCNKPGIYILEAPMGIGKTEAALAATEILASRFGYGGMFFGLPTQATANGIFDRIHSWASGTDDIHSLRLAHGMTDMNDEYCEIFHGRASDISDDDNDNIMVHTWFEGRKQALLSEFVVATVDQFLMASLKQKHVMLRHLGLAGKTVIIDECHAYDRYMYVYLENSLRWMAAYNVPVIILSATLPPDKRAELIKWYTGSKNSFDNSSTAYPILTWSNGAEVKQKAIPVDIPDKSITVIRREENDSNDIVNLLEDKLSDGGCAAVIVNSVAYSQELADTIAANMPDYRVICFHSGFISTDRAAIERELSDLVGKKSTREKRDKLIVVGTQVLEQSLDIDFDYMITELCPMDLLLQRSGRLHRHNRTRPDKLSEPELCVLIPEDFSKSVYSGWILTQTEKYLPDKLVIPGCIPELVGAVYSEPDNDEQQTAEYREYSDEQKEKKQRARKYCIPSQKINRSDSTLSDMINRRELNNDSDGEAAVRDGQETIEALVLVKTSDTEYSLFSRDEVFDITSVPDNVQAKLIAKQRLRLPAFFSKSYNFGKTIEILANSMPQAWRNAKWLKGEILLLLDGNNKINLLGRTYKYSTERGFEEIKEEES

SEQ ID NO: 12111 - protein, 910 aa, gamma proteobacterium HdN1
MELNKQFYCYWGKASPQCVGGERFHLLPYHSLDVAACGQALLAMPNFSIQQLAKELGWEQSLVESLFVFFLALHDLGKFSRAFQGLVRELSPDLVQADESKRYDRRHDTLGWLLWKQDISENFHGQCLPDLGHEFWSVWIRSVVGHHGKPPEEVGCGGLIALDAGDYFLKQDRIAARDFVAEVADRLLTEKLPAPTKNQLIVLRKHAWRLAGISVLADWLGSNQAFFPYSSSRLALRDYWQQAQQNAVLAISSSGLQWKQSRSWKNPFELFEYLREPTPLQQYAATVELENGPQLFLLEDVTGAGKTEAALILTQRLMQAVRAHGLYFALPSMATANQMYQRVGTVYRCLYDVEAHPSLILAHGARMLVDGFRESVLQEQVDDICYQPTEASASVQCNVWLADNRKKALLAEVGVGTLDQALLAVLPARHQSLRLLGLSGKVLLVDEVHAYDPYMMSLLKVLLTAHARQGGSAILLSATLPLAERDDLLAAFRLGLGVNHDSFLADSRYPLAVRAGKNVCPHACATRKQVQRRVEVRAVHCEEDAVALIVEQARIGRCVCWIRNTVDDARSAHRLLSDSVPEANLTLFHSRYAMGDRLDIEGQLLSRFGKYSQGKDRAGMVLIGTQVLEQSLDFDVDLMISDLAPIDLVIQRAGRLQRHARQRNGDPVKDDGVEQRDAPLLYLLMPEAVDDPQADWYSSLFPKACYVYPDAGKLWRGARALMNAGCIISPGEQGQAGAVRELVEAVYGRDVEAVPDNLQKATQMQLGKDLAKQSQANFNALRLDKGYCIDSSGRWYEDHVAPTRLGDETQTLYLALFRNDELHPLCDQGAYQWEQSSVRVDARRIQSLAPEWLQRFAGHLQNLRSRYRLLEEPAFVLPLVKDGERWVAKVLDGRGRVTEMSYCKKDGLGW

SEQ ID NO: 12112 - protein, 425 aa, Leuconostoc gelidum subsp. gasicomitatum LMG 18811
MKSYFGRQVVHAKVNKVPENIVSSAAFIGNICQRCGQNVHGKLPKNHFYCRACLALGRVSTLDVLLSLPEPNNFDGNDILSWTGQLTQQQKVVSDELLETLSRQREHLVWAVTGAGKTEMLFPVIHQALTQKYRIAIVSPRVDVILELAPRLQQAFSETDKVVLHGEQTEAYRYTPLVLATTHQMLRFKSAFDLLIVDEVDSFPYAGDQMLAHAVKNARKINSAVIYLSATPTKALQQQVKRQLLTTSYLPLRFHQHLLPVLKTTIVGPWRKKLPVIFLRQIKQFSQTKRRFLIFVPQVSDLVGVYQNIKNNFPDMLGDHVFAGDPKRQEKVQNMRDQTIQYLVTTTILERGVTFPGIDVLILGADEKIFSENALVQIAGRVGRNKDRPTGLVKAYVQHTNFKVIAAQRQIRQMNKRGQQLGGRV

SEQ ID NO: 12113 - protein, 794 aa, Kamptonema sp. PCC 6506
MSNLPEHLLAKSKPPITLKKHLEDTAKCALQIFRLDGRWGQNWCRFFKIQGIEAQEKFLLNLRVAALLHDIGKANEEFYKAVSEGCYQTFRHEHISALVLHLKQVRSWLQKENSSLDVEVITAAVLSHHLKAAEKGDREWGKPSKVTRYKPVKLYLLHDEIKVTLQEIARVASLDQPPEIAIATFSQDAIWCKAWEDGMKAARQFKRNLNDERRSLLLAVKAGLIVSDAAASGLVREGKKIDEWIEEVVHSKAITKAEIVTAIIHPIIGKIDARREDKPFDLKKFLEENNTGQLQMLQDETLHTFQKEIGVQGSRVLLLAACAAGKTLTAWKWAEEQVKHHTVGKVIFLYPTRGTATEGFKDYVSWAPEADAALVTGTARYELEAIAENPPDSMKEKDFTTEDRLFSLGFWSRRYFSATVDQFLGFMEHSYGGICLLPALADSVLIIDEIHSFDRKMFDSLIAFLKHFDLPVLCMTATLPTCRKNELVEAGLKVYPTASDRENLKDLEEKENHPRYRLEPVENFTSALTKAKQAYSQGERVLWVVNTVDRCLAISQKLKEELKVEVLTYHSRFRLTDRQKVHTKTVKAFAFQKVRKPAIAVTTQVCEMSLDLDADVLITEFAPIPSLVQRFGRANRHLVRGNDFRAALHIYEPPKALPYNREELDAARKFINDLGEGDISQKRLADTMEKYTPEERSSDGSSRFLDSGYFATMGSFRDTDEYAVPCILDRDLDEVEKRIKKHQPYDGYKINVPETWAKGDRPSWLPRYLKVAEWEGHYDERSGFQTKPLEDVKL

SEQ ID NO: 12114 - protein, 761 aa, Neisseria lactamica 020-06
MKVYYAHSAQGQLCNLLPYERWQTLQSHAQNVGNSAANFAQVFGAQDIAYYTGQLHDLGKYSLEFQARLNGGSRPVDHSTAGAKIAVERWGNVIGKLMAFCIAGHHAGLANGNGEGDNRRTLKQRLALQFGADIPVLDNLWQQEIKLPETLSAPPLKADAHHPFFSYAFFTRMLYSCLVDADYLDTEAFYSNLENKAVERGGYPDLNTLQHNFNQFINDFRRRITQAPEQTEAEKRNAALNRLRSEILDHAVEQATQAQGLFTLTVPTGGGKTFTSMAFALEHAKQHGMRRVIYVIPFTSIIEQNAAEFRKAFGELGEQAVLEHHSTFDDGKLQNEVTKDKLRLASENWDAPIVVTTAVQFFESLFADRSSRCRKLHNIAGSVIILDEAQMLPLNLLLPIMQAIKELAQNYHCSVVMCTATQPAVQAENGFYRGFENVREIAPKPTALFDKLRRTTVHHIGTQTDTDLLAKLAEHPQMLVIVNNRRHARSLYDQAKHLDGTFHLTTLMCAKHRSQKLDEIRGRLKNGESCRVIATSLIEAGVDVDFPLVMRAEAGLDSVAQAAGRCNREGKRPSENSFVWIFAPEEQWKAPPELAAQAAVMRLTADSFSDDLLSTQAVAAYFAELYQLKGSELDNKKILKMHNDTGQSLDFPFQTIADQFRMIESHMQPLIIPFDVDAENLISGLHHADHIGSLLRKLQPYTVQIPEKALAALYKAGRIEPINEQNFGKQFYTLIGLDLYDEVAGLSWEDTAFVKGESLVF

SEQ ID NO: 12115 - protein, 530 aa, Glycine max; identical to SEQ ID NO: 12006

SEQ ID NO: 12116 - protein, 834 aa, Neisseria lactamica Y92-1009
MNFDYIAHARQDSSKNWHSHPLQKHLQKVAQLAKRFAGRYGSLFAEYAGLLHDLGKFQESFQKYIRNASGFEKENAHLEDVESTKLRKIPHSTAGAKYAVERLNPFFGHLLAYLIAGHHAGLADWYDKGSLKRRLQQADDELAASLSGFVESSLPEDFFPLSDDDLMRDFFAFWEDGAKLEELHIWMRFLFSCLVDADFLDTEAFMNGYADADTAQAAGLRPKFPGLDELHRRYEQYMAQLSEKADKNSSLNQERHAILQQCFSAAETDRTLFSLTVPTGGGKTLASLGFALKHALKFGKKRIIYAIPFTSIIEQNANVFRNALGDDVVLEHHSNLEVKEDKETAKTRLATENWDAPLIVTTNVQLFESLFAAKTSRCRKIHNIADSVVILDEAQQLPRDFQKPITDMMRVLARDYGVTFVLCTATQPELGKNIDAFGRTILEGLPDVREIVADKIALSEKLRRVRIKMPPPNGETQSWQKIADEIAARPCVLAVVNTRKHAQKLFAALPSNGIKLHLSANMCATHRSEVIALVRRYLALYRAGSLHKPLWLVSTQLIEAGVDLDFPCVYRAMAGLDSIAQAAGRCNREGKLPQLGEVVVFRAEEGAPSGSLKQGQDITEEMLKAGLLDDPLSPSAFAEYFRRFNGKGDVDKHDITRLLTAEASNENPLAIKFRTAAERFHLIDNQGVALIVPFIPLAHWEKDGSPQIVEANELDDFFRRHLDGVEVSEWQDILDKQRFPQPPDNPFGQTDQPLLPEPFESWFGLLESDPLKHKWVYRKLQRYTITVYEHELKKLPEHAVFSRAGLLVLDKGYYKAVLGADFDDAAWLPENSVL

SEQ ID NO: 12117 - protein, 729 aa, Listeria monocytogenes serotype 7 str. SLCC2482; identical to SEQ ID NO: 12000

SEQ ID NO: 12118 - protein, 844 aa, Oikopleura dioica
MSDSANDLANLEEGRTQSTGGVFSGSASHTSGSDTMAGISEMPSAMSFKSRKPSEDKAPSTPGSSSRDTTEFGKNGNSDSTSKFKNNESTPSPSQKKQDSDEDTDSDTTLKESDEGDTGKVRTFAFKQAKADKTEEAGETERPKRRGFRRDEFFQRTLEQFREADKPIILDRGKKESEEENEESDAESENEEQEGTTDKAAKGFGAKKASKETDKPKGSKEQNDAVNLVKNFGKKPEDPPKETGSDDEPSSSDDDENKPKNTGRGFGKVKKSQPDGDDDEKEDSEEEDDNKSEILRITEELEQNRIYSGHICYELEDDEDLHGVNVPGEGLVKIESLEFKVSQGVEDGVKEIPKEHYVTNAFSDMTLHDQLAKNIRDYNWDKPLLVQRVAMRPISEGRDILVNAQTGSGKTGAFLIPIVNNILLNKRSDEIPGVGGIEGINPRALILVPTRELAIQIAREAVKLCRGLKKEIIKVCNLYGGTKRTTQRFEAFGADIIVGTPGRVGDILFPQVDGATKVIKLIAKFYIFSKQNFVNCDYIVLDEADRMLDDGFGTTVLEIINRIEAKREGNPITKVLASATFSADIQTYASAVLRPNYLYAQCGVLNAPCASVTQKAVQIENRKEKLSKLDEVLKEHNIGVENSVAKALIFGKTKKGVDFLGNKLSEKLGKSCITMHGDRGQVQREIALWTFSTSNCPVLVATNVAARGLDIPAVDLIVNFDCSDECYFKDDYIHRIGRAGRVGRPGTAVTFIEKERDGGNAPILKTLMEAGNAKVPEWLEEMATAAPDTDEEDRESEAASVSKSLASSRSSSVSNLSKSNPSTPRKKRSFGQSSPSVKGVRRDG

SEQ ID NO: 12119 - protein, 914 aa, Oikopleura dioica
MKRNLESKVEDFLSSGKDSYRFPAGMFNFERQYVHALCKKRGLISASHGSGEARRLTISRKQGREEKEILPQLIPDNAKHVIEALRNYQEKAWQNNKQPKLEPKFRLNFHSKPSLPNRQYNKPVNKLQAFRSALPIAEKKTEIVRSIVNSKVTIIIGETGSGKTTQVPQFILEDAEERLRPTRIYFSQPRRLATITCASRIAEERGSVLGKEIGYQIRLDNRISNDTNLILCTHGVLLRTLVGSKKENREKLSAMVSHVILDEIHERDKNADFLLIELREMLKSGELNRLVLMSATIDFNFFRNYFEKEGIKTEAVSVEGRTGYEKLFSRTIDNNLVKLLVADLWQKKEFSNTGSILVFLPGYGEIKSLGLDLIEHFHKCNLTPLYDDESSVTPQCSSRNLFYLHSQINPRKQAEAFRVGKKKIILSTNIAETSVTIPDVDFIVDCGKQRMKSFEPGSAVSMWLTTLISKSSARQRAGRCGRLPGTIGTCYHLFSRKTFDEIMLNEQAPELVRIPIPEICLSAKMLGGDMKIEEFLSKAPDPPAQKTICNAVEELKALGAIEQNEDLTPLGRLLVDMPLDPRLGKAVLASVLLRCVDPVITIVTSLGYRDPFVIASNGDDNHLTKKFKSAMSGGLQSDHHLILQAFEAWNSGCKGNWPIHRILSIPTLQYIKDVRRTIFEHLKACNLHPSNDNSHDWNLVTACLSIGSFPNVGRMTNPKSTGRGRKQFTVISANQRKLFQVAKASMYVENFQISESNHWVIFDEMFQIARGAVPNLKTVTAVPVLPIALFGGIDRPMIKSDEGEVYLQWNQVNLKLSCASHQVAAKFAHLHKDWNAFFNYALETRNTRDDGLVRVIQMLLSSDGNIRQAPNSNYSGARNESRSNGRYFRGAFNRGRGRGRGRGAPRGGFRQNPF

SEQ ID NO: 12120 - protein, 1075 aa, Oikopleura dioica
MKRNLESKVEDFLSSGKDSYRFPAGMFNFERQYVHALCKKRGLISASHGSGEARRLTISRKQGREEKEILPQLIPDNAKHVIEALRNYQEKAWQNNKQPKLEPKFRLNFHSKPSLPNRQYNKPVYKLQAFRSALPIAEKKTEIVRSIVNSKVTIIIGETGSGKTTQVPQFILEDAEERLRPTRIYFSQPRRLATITCASRIAEERGSVLGKEIGYQIRLDNRISNDTNLILCTHGVLLRTLVGSKKENREKLSAMVSHVILDEIHERDKNADFLLIELREMLKSGELNRLVLMSATIDVNFFRNYFEKDGIQTEAVSVEGRTGYEKLFSRTIDNNLVKLLVADLWQKKEFSNTGSILVFLPGYGEIKSLGLDLIEHFHKCNLTPLYDDESSVTPQCSSRNLFYLHSQINPRKQAEAFRVGKKKIILSTNIAETSVTIPDVDFIVDCGKQRMKSFEPGSAVSMWLTTLISKSSARQRAGRCGRLPGTIGTCYHLFSRKTFDEIMLNEQAPELVRIPIPEICLSAKMLGGDMKIEEFLSKAPDPPTQKTICNAVEELKALGAIEQNEDLTPLGRLLVDMPLDPRLGKAVLASVLLRCVDPVITIVTSLGYRDPFVIASNGDDNHLTKKFKSAMSGGLQSDHHLILQAFEAWNSGCKGNWPIHRILSMPTLQYIKDVRRTIFDHLKACNLQPSNDNSHDWNLVTACLSIGSFPNVGRMTNPKSTGRGRKQFTVISANQRKLFQVAKASMYVENFQISESNHWVIFDEMFQIARGAVPNLKTVTAVPVLPIALFGGIDRPMIKSDEGEVYLQWNQVNLKLSCASHQVAAKFAHLHKDWNAFFNYALETRNTRDDGLVRVIQMLLSSDGNIRQAPNSNYSGARNESRSNGRYFRGAFNRGRGRGRGRGAPRGAAANALSDSAANYLMVNELNLCHMRGRGHQECLEHIRGQFESLHGVTVTCGFTTDGKNVAGMAFWFSSIENYGAISCGELTYSNINTAALKRASDDAAAYGSPCYYEHGLKFNTCASMMISQRANEWCPTSDSHNIIVSDPAYIYVSGYAFDFTYPGGQYGIAYCISR

SEQ ID NO: 12121 - protein, 729 aa, Listeria monocytogenes SLCC2755; identical to SEQ ID NO: 12000

SEQ ID NO: 12122 - protein, 886 aa, Salmonella enterica subsp. enterica serovar Weltevreden str. 2007-60-3289-1
MSIYHYWGKSRRGETDGGDDYHLLCWHSLDVAAVGYWMVINNIYFIDHYLKKLGIQDKEQAAQFFAWILCWHDIGKFAHSFQQLYRHEALNIFNEPTRHYEKIAHTTLGYVLWNSWLSECPELFPPSSLSVRKSKRVMALWMPVTTGHHGRPPEAIQELDHFRQQDKDAARDFLLRIKALFPLITLPEAWDEDEGIDQFQQLSWFISAAVVLADWTGSASRYFPRTAEKMPVDTYWQQALAKAQTAITLFPSAANVSAFTGIETLFPFIQHPTPLQQKALELDINVDGAQLFILEDVTGAGKTEAALILAHRLMAAGKAQGLYFGLPTMATANAMFERMANTWLALYQPDSRPSLILAHSARRLMDRFNQSIWSVTLSGTEEPDEAQPYSQGCAAWFADSNKKALLAEVGVGTLDQAMMAVMPFKHNNLRLLGLSNKILLADEIHACDAWMSRILEGLIERQASNGNATILLSATLSQQQRDKLVAAFSRGVRRSVQAPLLGHDDYPWLTQVTQTELISQRVDTRKEVERSVDIGWLHSEESCLERIGEAVEKGNCIAWIRNSVDDAIRIYRQLQLSKVVATENLLLFHSRFAFHDRQRIESQTLNLFGKQSGAQRAGKVIIATQVIEQSLDIDCDEMISDLAPVDLLIQRAGRLQRHIRDRNGLVKKSGQDERETPVLRILAPEWDDAPRENWLSSAMRNSAYVYPDHGRMWLTQRILREQGTIRMPQSARLLIESVYGEDVNMPVGFAKTEQLQEGKFYCDRAFASQMLLNFAPGYCAEISDSLPEKMSTRLAEESVTLWLAKIVDSVVTPYASGEHAWEMSVLRVRQSWWEKHNGEFERLKGESFQQWCVEQHQNKDFAIVIVVTDSAACGYSATEGLTGKMG

SEQ ID NO: 12123 - protein, 702 aa, blood disease bacterium R229
MAGLAVLADWLGSNQAHFRYCEHPQDLSAYWCEAAQPEAAQAVRMAGLSDQAVSPWQGSRVLFPYLASPTPLQQYAATVPLAQGPQLFLLEDVTGAGKTEAAMILAHRLMAADHAHGIYLALPSMATANQIYRRTAAMYRRLYMAGTAPSLVLSHGARQLVDDFRRSVLEPQAQDDDFGYSREESSASAQCSAWLADNRKKALLADVGVGTLDQALLAVLPARHQALRLLGLSGKVLLVDEVHAYDPYMHALLCKLLTAHARQGGSVLLLSATLPAAMRAELIAAFQAGGGHEGVEPAADTRYPLVTHVHAEVSTHACATRPQLVRKVAVAPLHTEQAVVERVMNEARAGRCICWIRNTVDDARHAFTALRSHLPEKSLALFHSRFAMGDRLAIEAAALDRFGKASTAAQRQGQVLIATQVVEQSLDLDFDIMISDLAPIDLLIQRAGRLQRHARHGDGEPATDGCERRPAPTLYLLCPENTDTPGSNWYAASFPKARHVYPNVGQLWLTQRALLAAGQIVSPGGPGEDGAVRSLVEAVYGPEADPIPDALQRATQEQMGKDMAAASQAHFNALNLERGYCADSSHHWYEDTQTPTRLGDETCEIYLAREEGGGLVPFVAASAFPWEHAAVRVRAGVAGVLSARWQARFGPAIDALRRHHRLLADPALVLPLVREDGQWVGYCERNGKPQRIEYDDVLGLRI

SEQ ID NO: 12124 - protein, 724 aa, Novosphingobium sp. PP1Y
MSTAFDKLARPIQKWIRQQGWKELRDIQARATHVLMDGNRDLIVAASTAGGKTEAAFLPLLSQVLDEPSEASGFDVLYVAPLKALITDQARRLEEICRDTDLPITPWHGDVSSSVKAKATKRPRGVLLITPESLEALFIRRGLEIPRLFGATRAVILDELHSVLDSERGIQMRSLLTRLEIAVKRPIRRVGLSATLGDMELAKAYLRPDSPSEVEQVIAEGGSAELQLQLRGYVAGDKDDEGPSATDAIAQHLFEHLRGSDNLVFGGARQAVEIYSDRLRALCEKEHLPQEFYPHHASLSREHRDFVERRLKDGTAPTTAICTSTLELGIDIGDVTCVGQIGAPFSVASLRQRLGRSGRRPGKPAILRQYAVEAKLTPTSNFSDRLRLGMVRAIAMIELLLEGWCEPPQREALHLSTLVHQILSVIAERGGIRAQQLYGILCQSGPFRQADTQLFLDVLRALGQPEVALIEQASDGLLLLGANGEKLVEHYSFYAVFQTPEEYRLISSGKELGTLPIDNMIAPGMLLIFSGRRWLVQEVLDRDRVIMVVPAKAGVPPIFGGDPGNIHDRVIERMFNVLEGKKRPIYLDATALELLDEARSSYSQMQFDPGRIAQLSDNAAVIATKTGSVRTTTLALALRANGFTVQAHDGFLEVFGKDESPQLIDALSTLADGKDVDLFAHSPNLLFEKFHPYLTEDLLQKDALSARLDANGLTDLCRSIKGNG

SEQ ID NO: 12125 - protein, 926 aa, Streptococcus salivarius CCHSS3; identical to SEQ ID NO: 11860

SEQ ID NO: 12126 - protein, 906 aa, Haloquadratum walsbyi C23
MTWTLGSGQEILSHPSEANRDPKSLWDHLTGVSNRAATAVSENTQSQTEDSLSEIVQLLGLAHDFAKATPAFQRYIRDDSYDSPKHHARLGSLVAYFFLEQNGYEPEPRLAGLLAVAKHHGDVPDAAKYIRKTFDDPRIDPMGSNQTIQAIEQAKIIDKYAETFARDLFRKAVGEGAWDDFLEKVGDASDSPILTGIVEDAGKRGGFAGELEVENSQFNESIYTTHLLLFGALTFADKTDAAGIGSDDDRLSGEYPSLDKLETHLTELGGETQNDIEMQLNEVRTKVQDKIPAQTQEFLESNQSVATLTLPTGYGKTFAGLLAGLTLCDDHDGRLVYALPFTSIIDQTSGTLQEVFETAPSGNLLTVHHHLAETRTDIENGEEDETDEHASHEVLLAESWRTGLTLTTFVQLFESLAGPRNGQSLKLSALQGSTVVIDEPQAIPQHWWPIVRKLIDMLTEQFDSQVLLMTATQPSLVEDSFDLIPSEQLLEIEQSAFTGEPPSRVQYQLHPTALVTENEDRLSHPDAANLLAETVGSENTTLAICNTIESTRTLTKEFVDGIAESKPDPVAVSKLYESQLDEDEIAGPSATKEYGGKRRPSIERGRLVRAVVEELQTKETVAYLHLTARVRPCDRQFLLAVANDLAGIDIRFALISTQLVEAGVDISFDTVYRDFAPLDSIVQAAGRCNRSYERAPETGVTTIWQLEPPSECNTPPSTAVYAPNRSRGETDLLMHTRSVLETTREEHGAAFADEVLAKDAIERYHDTVGERVHSVSESNDLVTAFEQADGKTLREASLIERRQSVEVYVCRTTEEHDSAMAIESLMRERKFDEVDSKRDELASIRVSIPVPKANTDAASGILSLEPLLNEEEKRHDPERILHASNSIFDPEFGVQPSEYGLEDRFF

SEQ ID NO: 12127 - protein, 730 aa, Megasphaera elsdenii DSM 20460
MKMGNYIGHTSEDGRQQLLIDHLKGTSLLAERFASVFDAPEWGRMAGLYHDIGKYSAAFQRRILEDGPLVDHSTAGALLMKKVKNVPLAFCIASHHSGLLNTGTKLSKVDDGTLMGRLKKELKGKLDYSAYRQELPEPVPIRKAPAFLYGKDQFYYSFFIRMLFSCLVDADFLDTERFVNDGKVQRGGFATMEELHDLFFAYYATFGKPTTPINQKRQEIYQQCLDAAEKEPGMFSLTVPTGGGKTLSSLAFALKHAIKYKKQRIIYIIPYTSIIEQTADIFRNILGDGNVIEHHMNVDYDKDYDKNYDDDKKEDDGLNRKKLATENWDAPVIVTTNVQFFESLFAAKTSRCRKVHNIANSVLIFDEAQMLPEPYLRPCIRSMGELVANYRCTAVLCTATQPSLETYFSRIGEDLKVREICPDTQDLYGFFRRVTYRFMDVDSLESLAAQLKEHEQVLCVTNSKKDARDLYQMMAGDGCYHLSTFMYPAHRRRVLAIIRQRLQEGLPCRVISTSLIQAGVDVDFPVVYREIAGLDSIIQTGGRCNREGKQRTEDSIVSIYDLPKPMNRIPAFVRRPIEITQMVAKDHADIASAESIKAYFDQLHYTLGEDQLDSKDVLKRLEVNKPAFTEIAKDFKLIEEDSRTVFIPIDDDLDNQKILAQLRSGVCNRSILRKANQYMVGVYENQFRKLEETNKLEALEFGLYVLTDPAAYDPDTGLVVNMEDGIGIFL

SEQ ID NO: 12128 - protein, 596 aa, Thermoproteus tenax Kra 1
MGFRGGFSSAERATTRPPHCLWRRSLGCAASHGFSSSSWSRGRTTSSLPHRPSGAPHLSPRCMEKATGGGESPRTGGGSTRWRGACWPARGCPRARGGRSARSSAMRRAVERGLELARAGVSRIVLELPTGYGKTYAAPLFYKALREEGLCSKAIHVMPLRALIRKQIERYASAHPDIKFAYQDGDVLLRDRYEKDPYFREEYVLTTLDSFVHNLAKVPVAEMWKFYKSERPSVRYHIPLAYIYPSCVFLDEAHMAAGSRKELAAVKAAVRFLKELGVPTVVMSATLGEWKRDVFKGFRFVSLGDRDEERGDDVKVADPEFERRMSNVTYKVGRVDNIEEVARRKAEEGKRVLVIVNDVCRVQRLSETLGAPAVHSLMTRRDRERAERELDKAQIVVGTDAIGAGVDVDFDVLITEADEVERVVQRVGRVCRNRESCVGEIYFIGEVDEKLLKVKNWRLPHKPDSYMHLLRGETEVDERHFWFLETVMKEERVDTGRLRKKLLKEGGSFVRHALLEAEVGEGPEESFTVPLDRLEQLEFEAYVGERRIEPPRSYEGGELMRWLLDAVAEHGDVPRIRVVKYREGLGAVLKKCGEGV

SEQ ID NO: 12129 - protein, 566 aa, Thermoproteus tenax Kra 1; identical to SEQ ID NO: 14

SEQ ID NO: 12130 - protein, 767 aa, Methylomicrobium alcaliphilum 20Z
MKKYFAHSGNDFGSWHLLNEHLESVSKLAHSYSEGWRGGEEAALAGLLHDLGKYGDRFQNRLHGQDQGLDHWSQGAFLALTKYGSIVSAIAIQGHHIGLQSLQKEDLKKLMPGNLAKHHPQHLQLSDLDIERLESRLHQDELTAQKPASRLFSGWLGQSQARIDTMLDVRRVFSALVDADFIDTESHFNGDANGKIYRKPGLKLNDDGIASAALKKLCDYIDAKSALADQASVLQQVRRQLLNCCLTNAQKSTSIFTLTAPTGSGKTLSMLSFALQHAIHNNLERIILVIPYLSIIEQTAQIYREIFAEFGPDFVLEHHSMSGLGEETAQSDAEGCEDRERQLRRQRLLSENWDAPVVVTTSVQFLESLFSNRPSACRKIHRIANSVILFDEVQTLPTDLAIPTLAALSHIGHSWQSSVVFATATQPAFDHLHAAVQKQCAFGWQPTILVNEHGSMSNALRRVDYDWLDENPTWTELAAMLNEQTQVLCIVNLKRHTQALWEAFETTDELFHLSTNLCPLHRQQVLNEVRQRLKDDLPCRLIATQCIEAGVDVDFPLVYRAFGPLDAIIQAAGRCNREGKLNKGKIVVFTPDCDGRLYPDKTYEQASSVTASLKHDYGEAFDPYDSKIIEQYYRRLYTVAAPEQLGKRLNEAVQDLNFVDVAKHYRLINNDTINLVVPYDRELYEKLREQAATEGLTSKWVKQARCLSISLFRPKPDDVIWDSLVPVQVFRNGRHSRQEDWFIVNNLEDYDANLGYIKPEHLNLYIA

SEQ ID NO: 12131 - protein, 872 aa, Pyrococcus abyssi GE5; identical to SEQ ID NO: 12076

SEQ ID NO: 12132 - protein, 529 aa, Pyrococcus abyssi GE5; identical to SEQ ID NO: 12077

SEQ ID NO: 12133 - protein, 737 aa, Brevibacillus laterosporus GI-9
MMYFAHRTTSEDKGEWQYLHVHLKDGAEQTSEFAKVFGAGKWGYATGLFHDIGKYSVEFQKRLEGSLILVDHSTAGAQAIVELWGLEGKIPAYAIAGHHTGLPNGGTITGPDTCLTRRLKREVKEYRHAFKEIAKPDKPVSLPIEVGFNPGMSYSMFIRMLYSCLVDADFLNTEEFCNKELSRLRGITLDISTTLNRYEQYKREKFGSPKTEIQRYRNELMHECLMAAEGPQGLYTINMPTGSGKTLSSLGFALYHAKKHGLSRIIYVVPFTSIIEQNATILREILGNEVVLEHHSNIQREMDLDEKEEKIKILHQKMELAEENWDVPVIVTTNVQFFESLFSNKRSKCRKLHRIANSIVIFDEAQIMNGNFLKPSLFAMEELARNYKVTSLFCTGTQPGIDRFFPPSIPIKEVVHDVSLRHKQFQRTCLHQLGLQSLKEIASRIQTHHQVMCIVNTRKEARELYQHLGVNNDEKDPFLFHLSARMCGKHRIKVLDMIKERLKNKSLRCYVISTPLIEAGVDIDFPVVYRQLAGLDSIAQAAGRCNRNGRFNLGDVFVFETEQGLPAGWFQLTGSIAKKILQKYKEDGLSLSAMEDYFSELYFYQKAALYDRTDSKNIIGRLNEDIPGLSFPFKDVDRLFKLIDTQMETVIVPIDEKSEELIKTLVAASSMKSVLRNLQLYTVQIYQKEFQDYLQAGELIEVRQEVFVLHNHSKWYKKDIGLMPFSKEHHTKEIFIN

SEQ ID NO: 12134 - protein, 764 aa, Xanthomonas citri pv. punicae str. LMG 859; identical to SEQ ID NO: 11542

SEQ ID NO: 12135 - protein, 910 aa, Ralstonia solanacearum K60
MEKGAAQYFAYWGKARMQEGSSQLYHLLVFHALDVAACGAELLRLPRFSLAPLAAELGWPLRVVEKIFIWFLALHDLGKFARAFQNLAPGLSPDLVSPDPKKQYSRRHDTLGWLLWQERAACLGASLPDPVHGFWAAWVQTAVGHHGMPPQETAEGGLLPLQSCTFYLPEDMDAAVAFANAVAPFLLPSDIPVPGRAQRQTLLRHAWRLAGLAVLADWLGSNQEHFRYCVHPQDLSVYWCEVAQPAAARAVRLAGLSDQAISPWQGSQALFPYLVSPTPLQQYAETVLLAQGPQLFLLEDVTGAGKTEAAMMLAHRLMAAGHAHGIYFALPSMATANQIYRRTAAMYRRLYQAGTAPSLVLSHGARQLVDDFRRSVLEPQAHDDDFGYGREESSASAQCSAWLADNRKKALLADVGVGTLDQALLAVLPARHQALRLLGLSGKVLLVDEVHAYDPYMHTLLCRLLTAHARQGGSVLLLSATLPTGMRAELIAAFQAGCGREGMEPAADTRYPLATHVHAEVSTHACATRPQLVRKVAVAPFHAEQAAVERVINEARAGRCICWIRNTVDDARHAFMALQAHLPAPSLALFHSRFAMGDRLAIEAAALDRFGKASTAAQRRGQVLIATQVVEQSLDLDFDIMISDHAPIDLLIQRAGRLQRHARHGDGEPAADGCERRPAPTLYLLCPENTDTPASDWYAALFPKARYVYPDVGKLWLTQRALLAAGQIVSPGGPGEDGAVRSLVEAVYGPEADSIPDALLPATQERMGKDMAAVSQAHFNALTLERGYCTDSSRHWYEDTQTPTRLSDETCEIYLAREEGGGLVPFVAASDFPWEHAAVRVRAGTVGTLSECWQARFGPAIDALRKRHRLLADPALVLPLVQEDGQWVGYCEHNGKPQRIEYDDVLGLRI

SEQ ID NO: 12136 - protein, 744 aa, Phaeospirillum molischianum DSM 120
MYFAHSLREESDKTGWQKLSDHANGTAELAASFARVFKAERAASVAAILHDLGKYCPEFQERLNGADIKVDHSIAGAAEIRALGATGASAWDKIMAELVSYAIAGHHAGLPDWQDFSDRLKHIRPALDSVWREEISVDSSNLALSLTPHPAKTRTAFQLGFLGRMLFSCLVDADYKDTERFYAQAAGSQLDRDWPRLGDITSDLIARFDAHIATKAGDGPVNRLRREVLTHVREKADTSPGLFTLTVPTGGGKTLASLGFALDHARRHGLERIIYAIPFTSVIDQTAQVFRDVLGDDVVLEHHSAIETEKSAQWEQRDKLRLAMEDWAAPIVLTTNVQLFESLFANRSSRCRKLHHLAKSVIVLDEAQTLPLSLLIPCIAAIDELTRNYGASVVLCTATQPALDKRHFAGGDGTGLELEGRELAPDPDGLAARLTRVTIRSGGPMSDDELVAELERHPQGLVIVNSRKHALALYRKAGEAGLEGLVHLTTRQYAADRRRILADVRQRLKDGDPCRLIATSLVEAGVDLDFPRVWRAEAGLDQIAQAAGRCNREGRRPVEDSIVTVFTAPDNPPPREVAQLAAAYGRMAGNHDDPLAPAALRDYFGEVYWSKGPDLDRHKILGKFTVDRSGLAFDYKTVARDFQMIDSGLVPVIVAHEKKARHALEQLGIDGISPGQIARALQSFVVQIPPKARARLLANDHVRFEREKIFGDQFAVLQTGSLYRKETGLLWEDADYLGLEQSIF

SEQ ID NO: 12137 - protein, 388 aa, Halobacillus halophilus DSM 2266
MIERKDMKNMSNNQTEWFNELSPFLKEAWSNSGYETLTTVQERAIPLVLNGEDVLGEAPTGSGKTLAYLIPLLHKIDPDQKHTQVLILASSHELVMQINEEVQNWTKGSGINSTTLIGGANIKRQMEKLKKKPQVVIGTPGRVYELMKKKKVKAHEIKTVVMDEADQLLVPEHIRTVNDILESMLKDRQILLFSATMPEEVIDVAQEFMDEETEVVRVETEIQKPDVEHTYMVCEDRDKIEVLRKLARMDGFKGLAFLQDIAKLNVFAEKLTYKNLDLGLLHSDANKEQRAKAIREFRKGDYSLLLATDVAARGLDIIDINHIVNLDVPKDATAYIHRAGRTARLGASDGTVISLVNPVEQKRLMKHARDLDLSLHEKVIYKGSLKDA

SEQ ID NO: 12138 - protein, 744 aa, Saccharothrix espanaensis DSM 44229
MSIDENDLYAHSENKSGTPHDLTEHLVNVARLAGEFAGVFGAAALGWWLGVLHDLGKAADVWQQGLRVAARTQARVNIDHKAAGTRFAVRLGLWRWAMAVHGHHGGLTTPVELQRFLTSPKSNHAAEKQALDRMAALVPQLGVPSRPELPEWARKNESAGELLLRMVFSALVDADFLDTAQHFRPQDAEVDTALCSPGVEVLLGRFEAGRRKALDQRPAAALVDGPRERVYQDSVRTASLPQGFFRLGVPTGFGKTYAMAGFGLHHAKKHGLRRVIVAVPYLSVTDQVAEEYRTLLDPDRTGQVVLEHHSGVDLDAVRQRAAHGHRGRSARWQRLAAENWDAEFIVTTTVQLLESLHDRHPGRMRKLHRLAGSVIVIDEVQALPVHLLEPVLLMLRQLVEHFDVTVLLVSATQPEFWDLPVLEGREPVDLVDNVEELYTGLRRVRYRWWTEARPSLTEVAREVAENRRALVVVNTTDHARTVFRQWEAMSETGSLASEVQLRHLSTRMCSRHRLDVIKDIRKFLAEDVDVLVASTQLIEAGVDLDFPLLYRAMAPAEALLQAAGRCNRDGRLGHEGGLVVVFDPREPGRPPTYELPLHETRIHFGPGRAQPDDLAALRRYFPALYESLGPEALGHAVVTAREEWDFVRTAELFRMIADDTVPVLVDYTPAKDPVQRTRADRVVTALKAGNPVSATEMRRLQPFLATVPRTALSDNRLVPLAGNLHRWTGPYHPHFGIDLTSEKS

SEQ ID NO: 12139 - protein, 892 aa, Pseudomonas pseudoalcaligenes CECT 5344
MRCKECQMKGFADLSEQARRLWAKSDDGFGHGVLAHLLDVAAVAERMLAHEPPSTLDWAAQALGLEREHVARWVACLVGLHDFGKAIPGFQDKWLAGRQADEALGLAFPDRALGVTDHACASAALLWEHLPKQGIGHLLWIRHVLQAISAHHGYNFNQSEFNRAKPSFEPPAWGEARRQIFAAYWAVLAPQGVPQIEALSQPAVQWLAGLTSVADWIGSNPEWFPLGERHALLAEHHADACARADQALREIGWRAFQPLLTAPATADHLIARIVQRSELTARLLQAQADLLLDGVQGPALLLVEAPMGEGKTELAFLAHLRLQAANQHRGLYVALPTQATGNALFSRALTFLHSFAVGTPLDVQLVHGGAELNEQVLALRGIHGAAGEDVTSSAWFSQRRRPLLSPYGVGTVDQALFATLNVKHHFVRLWGLSNRVVVLDEVHAYDTYTSGLIEALLRWLRAMGSSVVLMSATLPAPRRDALLRAWGVAPESAPELSYPRLLLADDRGLKGDTCDSRPLPPINLQAVPEDIDSLVARACELVGQGGCGALIVNTVDRAQSLYLKLKVELADEVPLLLFHARFPANQRSEQEQAVLARFGDGGARPAKALLIATQVAEQSLDIDFDFMLTDLAPVDLILQRAGRLHRHQRERPEAHRRATLYVAGLAPEGLPDLKSTAWEYVYEPYILGRTWALLSREQALHLPQDIDRLVQAVYDSEDLPADLAEADRAFIEDEAYGSHLGKRQTERMMALNVAIDPEAEPQNAYTQKNRGYEEGEEGLGLPNYTRLGDDSVTLIPVHQVPGGWSLTPSGEAFDPDQPLSNALAKQLHARQLKTSRTALVKHAQVLEARRSFSEHPLLRHLKPLLLTDGCLQLGRLTVRLDDELGLVYQRTS

SEQ ID NO: 12140 - protein, 746 aa, Fibrisoma limi BUZ 3
MELLAKSPEQGGLTLLQHTQHVVDCILKMAREYGFNTRLARLGAVLHDLGKAHPYFQRVLQGKIGTVENNESDPHRHEISSLLFLPLFDRRDWPILIDTVVAHHKSLKSLQNNNASRRGLNDLKREFGPNDVFLRHADYTYSACQEVWEIWSARVEPVVKAFKVNYRSISREEAREAFDYAIEYCKNRPTGRSRWRGLLMSADHFASEHMHEAKSLLGSYYKRPNLTYYNRQSDLHPLSLLPTNRRNRHTLVIAPTGAGKTDFLLRRCLGRVVYTLPFQASINAMYLRVNENINKKDGKWLPRNEQTDVRRAHASSQIRLRDEKGKQIEEEQFRQRNPGASIKVTTPHQLASIVFKTSGHEAAALDVADCDVILDEVHVYDNLARAMTLELVKELVRLGCRVHIGTATIPDDLKQHLINALGGSRRVYQVHLKKRALTKFNRHEVSKLLDEAAARALVKKVVTGENKERVLFVANRVKLAQERYQWAKKELPNVPVLLVHSRFRRCDRADLECLIDVFDKSEGPCVVIATQVVEVSLDISFDRLVTDAAPLDSLIQRFGRIHRRRTSDTIGTYKPVQVIAPAITDKDILPYDAEVVRRSFDLLPDGLLRETELQQLINQVYDKITVPPIDIHTAPIWELCHRPKSYLIDALEIDGAVCILAKDRETYLKPKGINRQELEIPVPWKSIAAFVAAKTFPPLEAGNYPYVIPDNLYQYDPEGITLGLVLPDKPESVRTGASSTTAKRMI

SEQ ID NO: 12141 - protein, 822 aa, Microcystis aeruginosa PCC 9432
MKRLLAKSYNQKEHPKPPEFALLTRHSRDVADACRALAAISGDIALNNAEIWDMHLDFERTLRATGWLEDLGKCSSHFSEMLSGGDGFQLLRHETISGILAYFNEQFQTWLKPLGKFKIVAIWGAMGHHRKFDEKTTPYQGLPLILHISQSDNQDFNTILEEMAVDLELGNPPQFDHNLVIGYNSDDECDIPAFESLYDLINEFKQYEEEEFADERLRRFVALVKSYGIAADVAASAVAKKKGEDNQPYSLPNFVKNDLSIKLSYEDLTKLIHSWAWRNSDGFKDKKNEWDLSRYPHNFKLRNFQEQVASSDSYLTLAIAGCGSGKSLAAYLWAREWCKKLTDRNFRLFFCLPTTGTTTEHFKDYALESNIPSSLAHLAHSRSSIDLQTMAQTTPQEDSENSDIAEAAREALRAEQDKIESLALWSTPLTITTADTVLGLMVNARRSIYSLPVIMQSAIIFDEIHAFDDQMFGHLLVFLKNFPKLPVLLMTASLPEERLKTIQSIRPDLNCVPGLKEFEDLSRYNLPYMVEQVDEAIVWQEVQKCLENNGKVLWVRNRVDWANQIYQKAKVDFPDIAVNVYHSRLRYKDRSDRHRRVIDTFKEKGKAALLVSTQVAEMSLDLSADLLVTDIAPVPSLIQRMGRLNRRATPDNPGNSKPAIICPLPKIKGDTYKPYQKSEIDTSLIWVQKLLDLNKSLSQRDLAQKFLEVSNLKEYDYKKAEERACFFSGVWRTRPGITRNEGYTISVILAKDYKKCDDFKYNQPSPDWIRQHEVAIPIKPEALKWDKISGVRIAPKEFITYDYDQKDQYGNIISDGMGASWK

SEQ ID NO: 12142 - protein, 918 aa, Microcystis aeruginosa PCC 9443
MSKSNPQPFFKFGRVFFSGEPTIAPDKILFQPLGNHVGNVRQLARKWQDDNFSLERVIEGINLHDKAKPQTFKIRVETNKQGEFTKYTYSFKGHRFKVDEPQNLWVQSLARGHHDYSTKEIIKDTYQLKKDPEYQKIFSKDPLQYAKELYILEMCDQIEAELACRVIGDDEQAKSRTFMDFTITKGTSEDSNHRVFYLDPYPFKEPTITLNFRSWTYNLSDEDKNQLQQLHENGKDKELGSKLNTLVKEWWKKNEHTISEDRAITAIIKPDNSNTYSPSEKSENAILWWYRELANFQPNPMQEEVFQTMVENQHPAFILKAPTGVGKFEAIIIPFLAMLSTKEDRPRLIIPLPARSLLEDQKQRCEKYLKQFSLLHKGREVSLVIDTGTEMNRYVYLDGEVKSRNNSRRHLYKGDIILTTIDKFIYRYFGYGDKQKSFIFPYRIHHGNTLICFDEAHTYDDISFTNFCTLVKALYEAGRSLVLMTATLSQNHLERFDYLTDNMIDYIDVQDNLEKLNNFYQQILKQDYSNLKQFEWVDDIVYDVKEPTNFQQKLTSIALAEWNSNPSHRIIVSVETVKDAIAIYEKIKQTLNIKSSGENEFLFLYHGRLSDIPKTSHYSRTNLYQRLKERDENDQAYILVTTSAIEVGCDLNSTRLITQLCNPESLIQRAGRCNRKGNVEDAKIIVIGNNIPEFVNTLSEAELEDYKTILKGLHDQNFDPKAIMNCVSTKQTIDDYRVVELFSLLQDYVYNADLTCQSAHEKGLVITRSWTPSVTLVYDDGKQGDSLEKIVKESPQIQVPIDRLILKKNNEGNYTNQYANVSVYEWIYDKEETRYKLEPLKYWGCAYSKDMVIKVCAVQEGAISDSFAPYSYDHELGFKDLPGVFIKWRPNGYQERLQYNPTKDRSVVINYTSALTQD

SEQ ID NO: 12143 - protein, 798 aa, Microcystis aeruginosa PCC 9808
MSKMPEKLLAKSKKGNIEVTLEAHLLDTEKAAQLIFSLDGRWGKNWCRFFNIKSEELHQKFLLNLRVAALFHDIGKANEDFYQAVMASGFKPQTLRHEHLSALILCLPEVCQWLAKNSRLDINVITASVLSHHLKASKEGTTTDNGKSYKWCQPQKKSSLELYLNHPEVMRILQRITEIANLDSKSLPFLLPKTSWSNNTLWNKAFVAGTNAGDDFEDDIQEDQERRSLLVAVKAALIVSDAAASGLVREGKDIKDWIKEVVHSKSISDEDIANAIINPRIEQIKAKTGVFKLATFQEQIAKQGSKALLLAACGTGKTLGAWKWAEEQSKEYEIGKVIFLYPTRGTATEGFRDYVGWSPATDAALVTGTARYELEAMQENPNEAIDGKDFQTDERLYALGFWSRRYFSATVDQFLSFLEHSYQSLCLLPVLADSAVIIDEVHSFDRRMFDSLISFLENFNIPVLCMTATLPPSRQQRLKKAGLTIYPTEIDRHLLPDLEEKERHPRYYLELVDNFAAAFDKAVIAYQQDERVLWVVNTVDRCLAIAQKLKNDPQLKERNAEVLTYHSRFRLRDRQKVHSRTVEAFAIQKDMEARKPVIAVTTQVCEMSLDLDADVLITEVAPIPSLVQRFGRANRHLARGLDFRAKLYIYPAAKNLPYQKDELELAKNFLQHLSHGEVSQHQLAETLENYSTPEREADRSARFLESGYYAIPGSFRNIDEFSVPCILDKDLDTVKAILNSPEKYRKEPFIIDVPKKWVNPKETYPSWLPKYLSVATWEGHYNEASGFMTKLLEEVELG

SEQ ID NO: 12144 - protein, 819 aa, Microcystis aeruginosa PCC 9701
MKRLLAKSYNQKEHPKPPEFALLTRHSRDVANACRALAAISGDIALNNAEIWDMHLDFERTLRATGWLEDLGKCSSHFSEMLSGGDGFQLLRHETISGILAYFDEQFQTWLEPLGKFKIVAIWGAMGHHRKFDEKTTPYQGLPLILHISQSDNQDFNAILEEMAVDLELGNPPQFDRNLVIGYDSGDIPALESLYDLINEFKQYEEEEFADERLRRFVALVKSYGIAADVAASAVAKKKGEDNQPYSLPDFVKNDLSIKLSYEDLTKLIHSWAWRNSDGFKDKKNEWDLSRYPHNFKLRNFQEQVASSDSYLTLAIAGCGSGKSLAAYLWAREWCKKLTDRNFRLFFCLPTTGTTTEHFKDYALESNIPSSLAHLAHSRSSIDLQTMAQTTPQEDSENSDIAEAAREALRAEQDKIESLALWSTPLTITTADTVLGLMVNARRSIYSLPVIMQSAIIFDEIHAFDDQMFGHLLVFLKNFPKLPVLLMTASLPEERLKTIQSIRPDLNCVPGLKEFEDLSRYNLPYMVEQVDEAIVWQEVQKCLENNGKVLWVRNRVDWANQIYQKAKVDFPDIAVNVYHSRLRYKDRSDRHRRVIDTFKEKGKAALLVSTQVAEMSLDLSADLLVTDIAPVPSLIQRMGRLNRRATPDNPGNSKPAIICPLPKIKGDTYKPYQKSEIDTSLIWVQKLLDLNKSLSQRDLAQKFLEVSNLKEYDYKKAEERACFFSGVWRTRPGITRNEGYTISVILAKDYKKCDDFKYNQPSPDWIRRHEVAIPIKPEALKWDKVSGVRIAPKEFITYDYDQKDQYGNIISDGMGASWK

SEQ ID NO: 12145 - protein, 427 aa, Lactobacillus gigeriorum DSM 23908 = CRBIP 24.85
MKISEKLIGRQWPQASTSISENSELTIIPGIQADHCNRCGNIVQTKLPSGQRYCRTCIGLGRITEGEVLVRYDQNIEFPQVSDGGLTWHGELTPEQAKISNCLVKNYLTGIDSLVHAVTGAGKTEMLFPLLAQCLAQGKRACIATPRIDVVNELYPRLSEAFVKMTIGKYHGREYSDPGLEQLTICTTHQLLKFYHAFDLLVIDEVDSFPYVNDPQLHFGALNSVKVTGRKVFLTATPTADLLEQVKQNKLCKLTLKRRFHGGLLPVPEQKLFLKPFINQKGQLNQNLQKEIRKIIATGHPLLLFVPRISEIDTYVKEVKKLCSDNQTVAGVHATDKRRLDKVQNFREGKTKVLVTTTILERGVTFRHVWVIIIAADDPIYTTASLVQIAGRVGRDKNDRNGRVLYCYHRYTKQLKAAMKQIKEMNQ

SEQ ID NO: 12146 - protein, 744 aa, Mycobacterium canettii CIPT 140070010
MAETTARQDGPAEHGSHGAPPVLAAHSRNDSGQWHSLADHLMGTGRRAGTFGEAFGSADACRLVGELHDIGKADPAWQRYLAAADAGLKLPTVDHKHAGAFVCTTWGLGAFAPVIAGHHGGLPDQTDLRSKVTAEPTAGQQVAIDHVETLGLTRPEAQVVMPPQFRPGPRADAAGMRRMEFWLRMVFSALVDADSLDTEEHFRRGRREFPQPPGLNVLNDRCDARRKATLAERQHDPVTPARTAIFDEVISKAAADPGWFELTAPTGSGKTIAALAFALRHATVNGLRRVVTAVPFISVTEQVANVYRSLLDGGSDSPVVLEHHSGMFARGEAQSGAGLWSRLAAENWDATVIVTTTVQLLESLFGNNPSRTRKLHRLARSVIVLDEVQSLPWQLLDPTLDTLRELVRSYGCSVVLTTATQPPFHKIGSVDGVDRRALLGAGNHNKVFDRADADVVPDRLSWDDFGARVAIESNRHRGQCLVVLNTIADAREVCNRLVGRAGLAHLSSRLCPAHRVDVLDAVLALLREGKPCTLVSTQIVEAGIDIDFPVAIRSYGPLPAIVQVAGRVNRHGLAERGKLVLIDPAEGHVPGDEYKTGTQITRDLLRMRAHPFAPETLETYYDRLIHATRDKLDKRQIQRERELLNFAAVADRYRVIADETTPVLVRYKDFDPRGIVIPEDPASRRHFLRQHQPFTVSLRARELERCKETGLVEERDGGVMVWHGPYDDDVFGLSIDRESEALIW

SEQ ID NO: 12147 - protein, 804 aa, Mycobacterium canettii CIPT 140070017
MTFEEFVAEATKGSVRPYLAAVMVPEGQSAVAEATKGSVRPYRYQTALAESGLPEVLRAPTGSGKTLAAVLPWLYRRIAHPDPAVRADTPHWLVVVLPQRTLVEQTHAEIVSWVENLNLSMPVHVLMGGEDSGDDEWKTYPDADRVFVGTQDMVLSRLLMRGYAELRPAWPRSFGLLHAGVQFVFDEVQLMGPGLPTSLQLQGLREVLGTALPCRSMWMSATIDVAELSTVDLRRPLSVVDVTDEGGELARRMAATRTIRQLDLGADAKKYPATLAASVVNEHRPGTRTLVVLNTVERAMDVHAEVKRLDPSADTVLLHSRFRPTDRASQTAAALAEPGPEGTIVIATQVLEAGVDVTSETMITEAAPWPSIVQRAGRCNRDGLAVGARLLWTMPVGPNWHLPYDERDLKASAAVLAGLEGRAMTARGLAETAVAVTRPIHPVLRKRDLVDLFDTAPDLAGNDIDVSPFIRDAENRTVSVAWREFGDDNMAAADRRELCQAPIADIRSFIKKDPKRALIWDQVDGKWRVAAQADVRPGAVVVLEARLGGYLPERGFDPQSRKRPVDPVVVPPRTPDAHDRDPGSCGCRRWVALDVHLAETRDKAEKLIQRFGPNLALTEQQRDAIVRAGLLHDLGKSYSTFAEALVTANPETPPPDFGGPWGKSPSKRQLRYSPPHFRHELVSALWLRDPSTGLLDNEPEPDLVVYLVLAHHGKVRVTIRGKPNEPRDTILGVKDQSPTTGFTLDGASVPGVTLSHRHITHGTGSLTSSALALRDRADLGPFRLAFCEAVVRSADCQASAKEAS

SEQ ID NO: 12148 - protein, 769 aa, Caloramator australicus RC3
MFCSHEGKRLIEHLKEVYQINQDKIDEEFKPCFKIISYCHDFGKFTSYFQRYLNTKKRGKFTDHGFLSALFAAFCSLKSFREDSFLPLISYSVVLHHHGDLENISEDLPSTMRGILDSDFRLTEKIEIAKEQIKDIAKNKDLIKEEYSILNFEDYFLEFLNCDIVDVLKSLKKLQIKMEMAKKENLYFIHQLLYSALISADKLSAAKIEIPYEMFAGFEVLNREREKDLENKDMDINKIRSEIFEKIQKNIEKNYKNSKIFTITSPTGTGKTFAGFFAAVKLRELLGDNRRIIYSLPFTSIIEQNYDVLYRLHKNIEGFEKESGRYLLKHHSLANIKYESDEYDFDNLQSELLIENWSSGIVVTTFVQLFETLIGTRNRMLKKLINLKGSIIILDEIQAIDISLLPLVEFVLERACEIYDLRIVMMTATKPYILKNSIELLEDNQKYFFMFNRTTLLPDLNNKKLSTFLDEFKERIEDKSYLIVCNTISSSLDVYNNLKELNRPVFYLSTNLIPIHRRERIKNIKKLLDKGEKIILVSTQVVEAGVDVDFDVVIRDIGPLDSIIQCAGRCNRNGLKDNGLVYVYSLVPEDNDVLNFGFGKYVYGIPTLEITKKILKEPQYSEGEYFDIVSDYFKLIQQDRSKEKSKKFINSIKTLNFSQETKDALPLYKFSLIEDNPGFMDAFVIYDDLAQSTFKRYCDMLKLTDYYDRRREYLEIKNIIRDYTVSLPIKYHSLFDEQFGLYILPRERVVDCYNEEIGFIRQEKSYDIF

SEQ ID NO: 12149 - protein, 717 aa, Caloramator australicus RC3
MIFAKSNPVESLKEHTDLVMGNYKKLKELYENDISNIVEEEKFWDMLEIACFYHDFGKVYSPFQNEIRKVLKMELLNTKFKNDIPHGYLSPAFLNSKYIKTKFGEDNYVILVQAIAFHHERDSDVEDLNIQEVLDKDLSFAIEKLNEEMGISLEKVSKKYINHIKQQVRIKEWDRGYKKYIMIKGLLHRIDHSASAHVDVEIKPEKNISETVVNYINKKLNSNLREPQKFCLENKDNNIIMIASTGIGKTESALLWINNDKAFFTLPLRVSINAIYKRILEDMQYKDIGLLHSTSYDFLFKEEYKDSFEKYEISKQLSYPISLSTIDQLFTFPFKFKGYEKILATLAYSKVVIDEIQAYSPKIAAAILKGIEMIHKMGGKFMIMTATLPNIFKEYLENKGITFQFNEFYSDINRHKICIKQEKINDNLNYIIDKARDKKVLIIVNTVKKAMELYEEVVKKELIKENDIEVNLLNSLFIQKDRFDKEDKIKNFNKNGIWITTQIVEASLDIDFDILFTELSTVDSLFQRMGRCFRKREYNGEEPNIYIYCNEVSGIGTIYDEEIFKKSREELLKYDGKFITEKEKGEIVDKIYSRESLKGTHYLEEFDKALEVLDSVYDYDLDKRDVHKELRDFTNVKVIPKEIYEKNITLIEEYLNERDYKRKRDKLIDIKQLTMDVPYYRVKNNLLDSKINGIFIVNYKYDSKIGLHVGEEVTNFI

SEQ ID NO: 12150 - protein, 821 aa, Methanoculleus bourgensis MS2
MESQVKDGFDSFFQHATGHTPYPFQRNLATSEIFPEVIKIPTGMGKTDAIILGWLWRRRFDPRDEVRLRTPRRLVYCLPMRVLVEQTRDKTKQWLDRLGILAASPGDDNAVTGFAESSMREGKRIAVTVLMGGEEREWWDIYPERDAIIIGTQDMLISRALNRGYGMNKYRWPTHFGLLNNDCLWVMDEVQLMGRGLATTTQLQAFRHRLGTMEPSPARSVWMSATLEERWLGTVDFDPGTNITRTLTLSQGDRNEPAIQSRIQARKILERVETGAGDLKGLAGEILDKHPGGARTLVIMNTVRSAADLHKEISKRKPDAKLVLIHSRFRPPDRQEVVSDLLEEPGPEGTIIVSTQVIEAGVDVSAKALFTELAPWPALVQRLGRCNRAGEYDEAQVYWIDVPTDKKGSALPYTPEELDRAREVLLSLEGQSVGPDWLPDVREEVVHEQVIREKDIIELFDTTPDLAGNDLDVSRFIRDADDTDVQVFWRDFPEEGPGGEEPEQLPHRDEICTVPIGEIRDLVGKKREEAWVWDTLDGQWSRVRADSIYPGITLMLRANSGHYTRAKGWDISSKETVPVIQRKEESTDIDYTSNESAVGGWMSIAEHTNQVCGEMAAILDSLGLDGQWRTSLLEGARWHDAGKAHRSFQALLKKDALEEFDDPPAAKAPRDAWKGRLPARPDADDERRRYFRHELASGIAALQNGRDDLVAYLAAAHHGKVRVSIRSMPGEQRPRDQDTRFARGVWDGDVIPETDLGGGVILPQTTIDLSFMDLGHGVNGASWLARALELRDQPDIGPFRLAFMEALMKAADERASGGGGA

SEQ ID NO: 12151 - protein, 597 aa, Cronobacter malonaticus 681
MDIHARGPHLIILEDVTGAGKTEAALVLAHRLMAAGQARGLYIGLPTMATANAMYARMSQAWLRLYREGSHPSLVLAHSARKLSAGFNASVWARELLPNDSGDEAAAYEGCAAWFAQSPKKALLAETGVGTLDQAMMAVMAFKHQNLRLLGLNDKVLIADEIHSYDAYMSHVVEKLVETRARYGNATILLSATLSQAQRDRLIAAFYRGLNTTRESPRLGPDDYPWITHLHAQGIDGQRVATRAQVQRRVAIGWMEDDDACFDKIETVAREGGCIGWIRNSVDDAVNSYRELIRRGNIPEENIILFHSRFAFIDRNDKEQTTLEWFGKQNAVNRSGKVIISTQVIEQSIDIDLDYLISDLAPVDLLIQRAGRLQRHSRDKQGQLKLTGADERPAPRLDILAPRWQAQPDEKWLTSAMRNTSYVYPAHSRLWLTQRVLREQGEIKMPEAARLLIEAVYGEEIDVPEGMKRSEDAALADYYCQRAIASKYEISLDVGYSVESAELWGPDVSTRIGELTIDLWLARDTPQGIMPYAQGDNAWEMSALRVRKSWWEKHRGEFTLLCGEALSQWCREQRKPEAVVILLPGGYSAKEGLIGEV

SEQ ID NO: 12152 - protein, 597 aa, Cronobacter malonaticus 507
MDIHAKGPHLIILEDVTGAGKTEAALVLAHRLMAAGQARGLYIGLPTMATANAMYARMSQAWLRLYREGSHPSLVLAHSARKLSAGFNASVWARELLPNDSGDEAAAYEGCAAWFAQSPKKALLAETGVGTLDQAMMAVMAFKHQNLRLLGLNDKVLIADEIHSYDAYMSHVVEKLVETRARYGNATILLSATLSQAQRDRLIAAFYRGLNTTRESPRLGPDDYPWITHLHAQGIDGQSVATRAQVQRRVAIGWMEDDDACFDKIETVAREGGCIGWIRNSVDDAVNSYRELIRRGNIPEENIILFHSRFAFIDRNDKEQTTLEWFGKQNAVNRSGKVIISTQVIEQSIDIDLDYLISDLAPVDLLIQRAGRLQRHSRDKHGKLKLTGADERPAPRLDILAPRWEAQPDEKWLTSAMRNTSYVYPAHSRLWLTQRILREQGEIRMPEAARLLIEAVYGEEIAVPEGMKRSEDAALADYYSQRAIASKYEISLDVGYSVESAELWEPDVSTRIGDMTISVSLARETSQGITPYAHGDNAWEMSSLRVRKSWWEKHRGEFTLLCGEALSQWCREQRKPEAVVILLPGGYSAKEGLIGEA

SEQ ID NO: 12153 - protein, 744 aa, Mycobacterium canettii CIPT 140070010; identical to SEQ ID NO: 12146

SEQ ID NO: 12154 - protein, 804 aa, Mycobacterium canettii CIPT 140070017; identical to SEQ ID NO: 12147

SEQ ID NO: 12155 - protein, 719 aa, Desulfobacula toluolica Tol2
MDVCDHIKAKGAPEFTTLYAHLCQVKSAIKVFAGYLNFDVETAKLGAVFHDIGKASPIFQERLVSKYKTGQSTFRHEIASCFFLSLVEKTYHPQLIEMIIAHHKSIENDKGLKGILDLEENEDDIFEFHIEHWDVWKLDALKILAGFGINSRDIGYDEAKENYFKVLEYCENTIMNNGYSEWRGLLMSADHFASALSSAAPDYLPHTFKKPILEFYNRTSQLYPLSLKKASSNRPHTMVVACTGAGKTDYLFRRCRGRVFYTLPFQASINAMFKRVKTDLIKLNPNLDIRVLHSSSKISSGAESHEDMLLQRLVGSSVKVLTPYQLASIIFATRGFESMIEDLKGCDVILDEIHTYDNVSKSIVLKIVEVLNHIGCRIHIGTATMSSSLYNEIIDLLGRDFVSEISLDSIELEKFDRHILHKIGSWDDAHAVIKEAIKKNNKILLVCNRVDSAQEMFEIVKEAFSDIPLLLIHSRFKRGDRRDKEASLLGLDSQGNTTFEFNTSSNACIVVSTQVVEVSLDISFDLMITETAPIDSLIQRFGRINRKRTPATIGTYKPVYVIAPPEDEKAARPYELEILRKSYAVLDHDQVLHESDYQEKINCVYPDLSYTSIENHTAYKGNGRWNVPMLTHRDRSILLELLEVDSVNCIVDSDCQAYEQAGFEDQMMLEIPVRYYAVKNYFQLNFGSNPFVIPDSGYSRETGLDLAKANDRKADLNFL

SEQ ID NO: 12156 - protein, 800 aa, Desulfobacula toluolica Tol2
MFSSKLYSHPDISLIDHLQNVADMCEEKFLSHQTGLDDFFEKKSWQKLIWIMGFCHDFGKATCFFQAYLAEKDEKIKAGMRGKKETNHALISAVLSHFILCSIVKKSKNRNDLWEIMPFLIFMAIKRHHGNVNNAVRMNNAKEDENELDIKYEYIDRQFDNIDTDEFEHLLALLEKKSGINLNRSDFPESLSKYFKQNILRGEKKRIKAVDKKIEYYFIFQYLFSLLIQSDKEEAIFNRRFEFKRKDIQGDIVKNYIKDNFESPKTEMNIIRDNIFNDADKTVSCIDLTSDKIFSLNVPTGTGKTFTSLSVALQLRTRLENEKKQFPRIIYSLPFTSIIDQNYKVFEKIFTKPDSDILIKHHHLADVFFKSENHEFDTNESKFLIESWESEIVVTTMFQLFHSVLTNRNRMLVKFEKFVNSIVLCDEIQSLPYKYWKLAKAIMTCLSKTFNIYFILITATQPKIFNENEIVELVPNKSTYFSKLDRVDITFEKQPVTLEDYKLLCKTAINSNEESFLFVMNTVNSALELFESLSASGCDAEFFFLATNIVPADRLIAIQEIQDSKKRKIIISTQMIEAGVDIDIDNVWRDMGPLESINQVCGRCNRNFKQEKGKVRIFQVLNEAHNNTPFEKYIYGKNPLSIHQTREIIAGKETVSETDFLNNMDQYYEQIQARLRDDDSVDIINFMKNLQFLSVFKNFKLIDEENYERKDIFIELNEVAEEAWRRYIEIREIQDKIERKLKFLKIKKVFYDYIISVPANFVSEKEYGDTNFVYINKEMLPVCYDKKTGWMRKTEDVYTF

SEQ ID NO: 12157 - protein, 817 aa, Lactobacillus equicursoris 66c
MKYIAHTKENSSEVQLLAEHLVNTQKIAERHGGLLNLSHCAGLAGLVHDLGKFRPEFQEYITSGDEKRGSVDHSSFGAMMIYQEIPKLVSVYPDKQFHISLFGEVIENAIFSHHNSLGLKDYLNTDLKSPFRKRIDSFLSSEDNIKELNQAIEHFYQEVMPKKQFEEYLLEAYREFKNFFSKLLEDKHNLLSNIYYLSEFIYSCLIDADHTDTALFELGKKELQYDSQTIFDNYYQKLLDSLKKFAVKSEIDQARAEMSDECDLFANKDDDIYRLSIPTGGGKTLTSLRYALKHAVLKQKKRIIYVLPYITIIEQNARVMREVLNGNSNDSTNILEFHSSVSNDLKSSSKETTNIISLAEDNWDSPIIVTTMVQFLNSIYARRTSNRRRFHNLCDSVIVFDEVQKVPLNCLSMFNKILNFLKDVGQCGIVLCTATQPALDQMKAGTPVDMAESPEMIGDLDDRIAQFKRVQISNWSNINGRDKILSVDEVADKIADQLEKHGSVLGIFNTISITEQIYERLAELKQEQDDNYSLYCLTTHMCSAHRQTIIKKIKEDLSANRQVICISTPLIEAGVDISFACVVRSLTGLDSVVQAAGRCNRNAERKYGDVYLVLVEGENLRQLPEIKRGREIVQGMLSGGYSADSFLGTEAIEHYFRVLYQDLGSETEFLTSDHGHNVKLASCIDGSELCGQYVNTNSGELPPTKETSSSETIARHFEVISSDTVSLIAPYGKGKEIIVGLNAKDGMKHLASLIHDAQPYIVNVFKTKFDQLLSEGIVKELGNGYVNTNIFAITDRHYDESIGLTEESKSKPTFMSF

SEQ ID NO: 12158 - protein, 949 aa, Lactobacillus equicursoris DSM 19284 = JCM 14600 = CIP 110162
MELSDDALALWGKKSNRDGDPRWLPLVAHLVDTKNVEYWLYTHWLSDGDRNFLTQRIASEMVKAGLSPVKAQEQAEREMGKLIKFLCYIHDIGKATPAFQVKRSYNHDDQLDEILVDRLMHHSFKGLADATLSSPAKSPHARAGEAILQDAGLNETVAAIIGGHHGKPQSKSPIDQLVDYTSNYYQSDNDEQAKAPWKKAQGELIRYGRELAGYKDIKDVPPVTQAEAVILEGLLIMSDWLASSEYLNDNVDYPMFTLIGLDEGFDSLDMDKRWQSAIKTWKLNDQWEPDEVNDAKRYYQDHFGFAPRQIQEVMADKLLEANDPGLMIVEAPMGIGKTEIALAAAEQLASATGRSGVYVGLPTQATSNAMFRRVEDWARKMAQGNELNFSMELLHGKAYLNSDFTDLPRAEDVDLDDEDSSGIQEGAISVNSWFSGKKSILADFEVGTIDNLLLMGLKQKHLFLRHLGFSNKVIILDEVHAYDAYMNSYLYKALEWLGAYHVPVIILSATLPKEKRNEIIGTYFKGKYHSSFEQNLIAADGWEDNYAYPLLSILDGQELKQISNFGQKLPSHELQIEYLDEDPNVVMAKVEAKIANGGVAGIIVNTVKRAQEFAKLVPKGVGCLVLHSAFLATDRMNKEEKLQDLIGKNGQRPKKYIVIGTQVLEQSLDIDFDVLFTDIAPMDLLLQRAGRLHRHEIDRPEGLEESVLYVLKPEGDGYGDANEAIYEKYYLQKTEAFLPRVVKLPDDISILVQKVYDPPTDDQVENLQDAKEDSDKHFAKENSKAESFQVSDPKYPKKETDLQNKRKLRKLTLHGWLDWDAGNLDENQAIAAVRDIRESVEVILLKEVDSKYYLLDEGKETVAVDEIGDRDLAQEIIRLPGVLTLDVDKAIKTLETITIKRFPEWQNSPWLKGSIALVLDENNETTFAGYRLKYLPAIGLTHEKEEGEK

SEQ ID NO: 12159 - protein, 852 aa, Clostridioides difficile T5
MYFKKVELFDISNNINNCKNIYAHINKDRKPETLKEHSDLSYSYLMKLCVKKDLSSCLERIENKFFKKDSFLSKNFYREIILNMVYMHDIGKINSSFQFVKMQNKNFKKISLRYTKHSFISSMLYFDYYFEKLKKYDFEEKKILSLFLMINTYTISKHHGVLKSFKEFLFLFKDEFINIKENFKDLFKNNYNLELKSVPKTIEKMVRGVEGYLDDSHIKDNLAIDLYIYSKLMFSIVTSCDFYATSEYNSGNSIDGFGTIDNYNKYYDVLKKSEIYKGMKKYREYLNNNSECPYKENDINRLRTEMSIEAEDAITHNTRKRIFYLEAPTGSGKTVTSINLALKSIELNQSLKKIFYIFPFNTLVEQTKDVFINEIFNSVKDIQKDVVVINSITPIQTEDKEEDNKNVEYCVTKQEIDYDKSLLNRQFLHYPIVLTTNIGFFNYLFGVSREECFPLIHMINSVIILDEIQNYKNEIWKEIILFLEKYADILNIKFIIMSATLPRLNKLGCNDDNFAYLVKNREKFFKNHLFKDRVNISFEMLNSEINDIEEISEKVIEEAEIYNKILIEFIKKSSALEFYKNIKEKLKYKLEDVFLLTGDDNKLERKKIINKIKDMNSVILVATQVVEAGVDIDMDLGFKDISTIDSDEQFLGRINRSCKKLNSKVYFFNLDDASKIYKKDVRKERHLTLNEESNRKIILDKDFEKYYDKIIARIEENKHKHNDKNIEVFIKDIVGNLNFTEVKKWMALIPDLKEYTIFLNTIVKDESGNMIVGSDVWYEYISLLKNDNVEYSEKRVKMSEIMEKLDYFTYKVQKFDNSFNDLVGDIFYIDDGSKYFTEGKFDRSKFNQNEFL

SEQ ID NO: 12160 - protein, 802 aa, Clostridioides difficile T5
MENIMQKEILAKSYNLRTNQQEQTLVEHIKDLFEVLESILELNLYSDKDVEILKICCALHDLGKINSIMQQKMEINNKISYSCSEEERKKLESDKKSLKKIARHNIFSGAFLKDILEKMNLSEEDKLYIYKSIMLHHGNYEDYMRLSTSKVQEEIYEYIEKGILEKEEFNLKDIESYINDILNVDFKFGEDVLDYDYIDKLSESMFIDSDYNNGQIEDSVLNYRKFKYILYKGMLNLIDHSASSRQKGIKFYNDFTDEEIDNMILDEIYKSQGNLEKNNIEFNTIQKRLRELSGRNVLTVAFTGSGKTAADYRKTFKRKFFLVPNKISAESFYRKNIFQNKNDLNTRNSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDVDFHLMTATLPKSYKEQMINKGIIFQEESNENVTDKGEIAFIESNKEENICEGKDVKVSFIKEKEIKSIVEGALENKQKILIIKNTIDSVNRTYEFLKENLSDKYSGVDIDVLHSRFKFKDKKEKYSKILNGKGDIWISTQSVEISLDLDFNIIISDLATMDSLIQRMGRCNRNNKYEYGNFYILPSEDKIYDNKLKNTTKSILNNVIKTNSIFTMGIRKTILDDYYDNSVVKKYFEDNFISCDKEIKNIYGINKEIFDGLDLIFNFEPYKNIVDSKKEAAKIFRDVDVSYKIILEEDFYKEDRELQQDSIQVSGFIFNRLYYYRLISKVEGYMVLKSSSKFEYNSTVGLILK

SEQ ID NO: 12161 - protein, 773 aa, Clostridioides difficile T5
MLYAKSNPVETLREHTDELLKQMNVLRESYGTNINSLNFLEEEIFWQLLDFVIEFHDIGKAFSPFQELIISRMDTKINEPKIVTHLENNVGHNYLSPAFIDYSYIDKKKNKELRAVLNQVIVYHHERDIFIDKDFKNLIQKILDEDLINKVYELQHEFKVRYPIKTEKLSKVYLQSVEKRIDKNHKYYNLYIMLKGILHRLDHSASAHEVVECNNVMNIGEHTENYLMKEFGSLRETQSFAQSNRNKNIILIASTGMGKTETALIWIDKDKAFFTLPLRVSINALFDRAKNIVGVGESNDTFLGLLHSTAIDYLEESNQENSSEIVDLAKLLSCKLTFSTIDQIFKFPFLYRGYEKVYSTLAYSKVVIDEIQAYSPEIAAVLVKGIEMIHKIGGKFMIMTATMPTIYIDELKKRGVVDSNLANLTCNTEKIRHCVSIVENSIDENLEQIIQSGINKKVLVIVNTVKSAIEKYELIEEIIKSKGIDINVNLLHSMYIQEDRAKLEKYIKEFADSDSNGIWITTQLVEASLDIDFDELHTENSTLDSLFQRFGRCYRSREYEENSPNIFIYTEKATGIGSIYDKDIVEKGLELLKNCMNGKKCFKMKEKHKVQMVKILYSKESLKDTDFEKKFTRALDILDTITPYSLGSNEAQNILRNIEGYTVIPEDIYRKIEKTLIRDYEELGQELTEAYSNDDRQLINEIKSKRKKARREIIKKTVNLPIYKAKQNIVDIQVKGLEDLKILLYKYDIHEDVHTKHIFGKGVIIGKEIDQFI

SEQ ID NO: 12162 - protein, 852 aa, Clostridioides difficile T20; identical to SEQ ID NO: 12159

SEQ ID NO: 12163 - protein, 802 aa, Clostridioides difficile T20; identical to SEQ ID NO: 12160

SEQ ID NO: 12164 - protein, 773 aa, Clostridioides difficile T20; identical to SEQ ID NO: 12161

SEQ ID NO: 12165 - protein, 802 aa, Clostridioides difficile E1; identical to SEQ ID NO: 12160

SEQ ID NO: 12166 - protein, 773 aa, Clostridioides difficile E1; identical to SEQ ID NO: 12161

SEQ ID NO: 12167 - protein, 852 aa, Clostridioides difficile E1; identical to SEQ ID NO: 12159

SEQ ID NO: 12168 - protein, 852 aa, Clostridioides difficile E10; identical to SEQ ID NO: 12159

SEQ ID NO: 12169 - protein, 802 aa, Clostridioides difficile E10; identical to SEQ ID NO: 12160

SEQ ID NO: 12170 - protein, 773 aa, Clostridioides difficile E10; identical to SEQ ID NO: 12161

SEQ ID NO: 12171 - protein, 802 aa, Clostridioides difficile E13
MKNIMQKEILAKSYNLRTNQQEQTLVEHIKDLFEVLESILELNLYSDKDVEILKICCVLHDLGKINSIMQQKMEINNKISYSCSEEERKKLESDKKSLKKIARHNIFSGAFLKDILEKMNLSEEDKLYIYKSIMLHHGNYEDYMRLSTSKVQEEIYEYIEKGILEKEEFNLKDIESYINDILNVDFKFDEDVLDYDYIDKLSESMFIDSDYNNGQIDDSVLNYRKFKYILYKGMLNLIDHSASSRQKGIKFYNDFTDEEIDNMILSEIYKSQGNLEKNNIKFNTIQKRLRELSGRNVLTVAFTGSGKTAADYRKTFKRKFFLVPNKISAESFYRKNIFQNKNDLDTRSSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDVDFHLMTATLPKSYKEQMINKGIIFQEESNENVTDKGEIVFIESNKEEEICEGKDVKVSFIKEKEIKSIVEDALENKQKILIIKNTIDSVNRTYEFLKENLSDKYGGVDIDVLHSRFKFKDKKEKYSKILNGEGDIWISTQSVEISLDLDFNIIISDLATMDSLIQRMGRCNRNNKYEYGNFYILPSEDKIYDNKLKNTTKSILNKIIKTNSIFTMGIRKIILADYYDNSVVKKYFEENFISCDKEIKNIYGINKEIFDGLDLIFNFEPYKNIVDSKKEAAKIFRDVDVSYKIILEEDFYKEDRELQQDSIQVSGFIFNRLYYYGLISKVEGYMVLKSSSKFEYNSTVGLILK

SEQ ID NO: 12172 - protein, 802 aa, Clostridioides difficile CD002
MKNIIQKEILAKSYNLRTNQQEQTLVEHIKDLFEVLESILELNLYSDKDVEILKICCALHDLGKINSIMQQKMEINNKISSGCSEEERKKLESDKKSLKKIARHNIFSGAFLKDILEKMNLSEEDKLYIYKSIMLHHGNYEDYMRLSTSKVQEEIYEYIEKGILEKEEFNLKDIESYINDILNVDFKFGEDVLDYDYIDKLSESMFIDSDYNNGQIDDSVLNYRKFKYILYKGMLNLIDHSASSRQKGIKFYNNFTDEEIDNMILSEIYKSQGNLEKNNIKFNTIQKRLRELSGRNVLTVAFTGSGKTAADYRKTFKRKFFLVPNKISAESFYRKNIFQNKNDLDTRNSNDYIGLLHGDINLYSENEDNGEHDFVLTLRDIDLSVNFCKPCVIATVDQLLLSMFKFPGYEKIFAAVKNASITVDEVHLLEPKMFLILIYFMQFACKYLDVDFHLMTATLPKSYKEQMINKGIIFQEESNENVTDKGEIVFIEINKEEEICEGKDVKVSFIKEKEIKSIVEDALENKQKILIIKNTIDSVNRTYEFLKENLSDKYGGVDIDVLHSRFKFKDKKEKYSKILNGEGDIWISTQSVEISLDLDFNIIISDLATMDSLIQRMGRCNRNNKYEYGNFYILPSEDKIYDNKLKSTTKNILKDILKTNSIFTMGIRKTILDDYYDNSVVKKYFEENFISCDKEIKNIYGINKEIFDGLDLIFNFEPYKNIVDSKKEAAKIFRDVDVSYKIILEEDFYKEDRELQQDSIQVSGFIFNRLYYYGLISKVEGYMVLKSSSKFEYNSTVGLILK

SEQ ID NO: 12173 - protein, 773 aa, Clostridioides difficile CD002
MLYAKSNPVETLREHTDELLKQMNVLRESYGKNINSLDFLEEEIFWQLLDFVIEFHDIGKAFSPFQELIKSRMDTKINEPKIVTHLENNVGHNYLSPAFIDYSYIDKKKNKELRAVLNQVIVYHHERDIFIDKDFKNLIQKILDEDLINKVYELQHEFKVRYPIKTEKLSKVYLQSVEKRIDKNHKYYNLYIMLKGILHRLDHSASAHEVVECNNVMNIGEHTENYLMKEFGSLREAQSFAKSNRDKNIILIASTGMGKTETALIWIDKDKAFFTLPLRVSINALFDRAKNIVGVGESNDIFLGLLHSTAIDYLEESNQENSSEIVDLAKLLSCKLTFSTIDQIFKFPFLYRGYEKVYSTLAYSKVVIDEIQAYSPEIAAVLVKGIEMIHKIGGKFMIMTATMPTIYIDELKKRDVIDSNLADLTCNTEKIRHCVSIVENSIDENLEQIIQSGMNKKVLVIVNTVKSAIEKYELIEEIIKSKGIDINVNLLHSMYIQEDRAKLEKYIKEFADSDSNGIWITTQLVEASLDIDFDELHTENSTLDSLFQRFGRCYRSREYEENSPNIFIYTEKATGIGSIYDKDIVEKGLELLKNCMNGKKYFKMKEKHKVQMVKTLYSKESLKGTDFEKKFISALNILDNITPYSLGSNEAQNILRNIEGYTVIPEDIYNKIEETLIKDYEELGQELTNAYSNDDRQLINKIKSKRKKARREIIKKTVNLPIYKAKQNVMNIQVKGLEDLKILLYKYDIHEDEHTKQIFGKGVIIGKEIDQFI

SEQ ID NO: 12174 - protein, 660 aa, Clostridioides difficile CD002
MNNLYKYKAKSDGTSIDKHNEDMNYIMNQLVSIYNISNDMKNGLYEAIICHDVGKVVKSFQDNIESSTRRVRHELLSASIKYLNRGQKLAILTHHKDIKFLEGQITNSIYEIELKELKELLDIEVEDIRPFIKEISRARNDDTRKLENILLKGYLQYCDHIASAGIKSIDKGFNSIKDFSLPKGVSYNSIQEKVLNMDKNEDIMIMAMTGLGKTATSLYWSNLVQNEYKSKRMYYILPYTASINSLYENLYNRNISVSMLHSKAPYFLNKISDEEDIKQLYQIYKKSVKQINVCTIFQLVKSVFSCKRFEMLLSQLKNSIFIVDEIHCFDTRVLCYTLEFLKYLKENLNVQICIMSASIPTCLKKLIQERLQISTIIEPDSKDLIFRHRLNRLNEGILDSIHKIENDLMQGKRVLICVNSVDLSQELYGRLQKYNPKLIHGRFNTRDREQAEKGIDESFLLIGTQSIEVSLDISYDVLYTELAPLDSLLQRFGRVNRKGDNEELSNIYIYDYDRKLNIYDEDIINRTDIVISDIIHNDNSIVDESKVPFYLDNVYLDIDMDKYNKHKVALEIIMKNMRLGVWNKSANNDMLNNDTISVVPECLLEEYKFYIDKKMYLEASSLFVNVSVKRYNYNKKMFYEYEDIIVTSYNYNDKLGLIFD

SEQ ID NO: 12175 - protein, 773 aa, Clostridioides difficile E16
MLYAKSNPVETLREHTDELLKQMNVLRESYGKNINSLDFLEEEIFWQLLDFVIEFHDIGKAFSPFQELIKSRMDTKINEPKIVTHLENNVGHNYLSPAFIDYSYIDRKKNKELRAVLNQVIVYHHERDIFIDKDFKNLIQKILDEDLINKVYELQHEFKVRYPIKTEKLSKVYLQSVEKRIDKNHKYYNLYIMLKGILHRLDHSASAHEIVECNSNMNIGEYTEKHLVKEFGSLREVQSFAKSNRNKNIILIASTGMGKTETALIWIDKDKAFFTLPLRVSINALFDRAKNIIGVGEANDTFLGLLHSTAIDYLEESNQENSNEIVDLAKLLSCKLTFSTIDQIFKFPFLYRGYEKVYSTLAYSKVVIDEIQAYSPEIAAVLVKGIEMIHKIGGRFMIMTATMPTIYIDELKKRGVMNSNLADLTCNTEKIRHCVSIVENSIDENLGKIIQNGMNKKVLVIVNTVKSAVEKYELIEEIVKPKGIDVNLNLLHSMYIQEDRAKLEKYIKEFADSDSNGIWITTQLVEASLDIDFDELHTENSTLDSLFQRFGRCYRSREYEENSPNIFIYTEKATGIGSIYDKDIVEKGLELLKTFINGKECVKMKEKYKVEMVKILYSKESLEGTAFEKRFTSALNILDTITPYSLGSKDAQNILRNIEGYTVIPEDIYNKIEETLIKDYEELGQELINAYSNDDRQLINKIKSKRKKARREIIKKTVNLPIYKAKQNVIDIQVKGLEDLKILLYKYDIYENKHTKQIFGKGVLISNEIDQFI

SEQ ID NO: 12176 - protein, 802 aa, Clostridioides difficile E16
MKNIMQKEILAKSYNLRTNQQEQTLVEHIKDLFEVLESILELNLYSDKDVEILKICCALHDLGKINSIMQQKMEINNKISYSCSEEERKKLESDKKSLKKIARHNIFSGAFLKDILEKMNLSEEDKLYIYKSIMLHHGNYEDYMRLSTSKVQKEIYDYIEKGILEKEDFNLEDIEDYIKEILDVDFKFNEDVLDYDYIDKLSESMFIDSDYNNGQIDDSVLNYRKFKYILYKGMLNLIDHSASSRQKGIKFYNDFTDEEIDNMILNEIYKSQGNLEKNNIEFNTIQKRLRELSGRNVLTVAFTGSGKTAADYRKTFKRKFFLVPNKISAESFYRKNIFQNKNDLDTRSSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDVDFHLMTATLPKSYKEQMINKGIIFQEESNENVTDKGEIVFIESNKEEEICEGKDVKVSFIKEKEIKSIVEDALENKQKILIIKNTIDSVNRTYEFLKENLSDKYGGVDIDVLHSRFKFKDKKEKYSKILNGEGDIWISTQSVEISLDLDFNIIISDLATMDSLIQRMGRCNRNNKYEYGNFYILPSEDKIYDNKLKNTTKSILKDILKTNSIFTMGIRKTILDDYYDNSVVKKYFEENFISCDKEIKNIYGINKEIFDGLDLIFNFEPYKNIVDSKKEAAKIFRDVDVSYKIILEEDFYKEDRELQQDSIQVSGFIFNRLYYYGLISKVEGYMVLKSSSKFEYNSTVGLILK

SEQ ID NO: 12177 - protein, 784 aa, Clostridioides difficile E16
MKKELLAGSCNLNKKEQTLVGHIKDLFKVLESILDIDLYSGKDIEILKICCVLHDLGKINLITQQKIEINNKISSSSLKEEIKKLEFEKKSLEKIAKHNVFSGAFLKSILEKMNLSEEDEFYIYKSIMLHHGNYIDYMKLTTSKVQEEIYKYIDDGILENKESFNLKDIEDCISEILNIDFKFNEDVLDYDYLDKLSEKMVIESDYDNGQIDDSILNQRRAKYILYKGMLNLIDHVAQGTNKDIKFYNDFTDKEIDEMILNDIYNNHDNLEKNNIEFNTIQKKMRKFSEKNVLTVAFTGSGKKVADCRKNFKRKLFLVPNQFSSESFYIKNIFKNDYLGLLNGDINLYSYSENYNEQDCEVTLRDIDLSLNLCKPYLIATIDQLLLSMFKFPGYEKIFAAVKNASITVDEVHLLNPKMFLILIYFIQFACKYLNVDFHLMATMLPKSYKEQMISKGIIFQEECNENITDKGEIVFIESNKEEDICEGKNVKVSFIKEKEIKSIVENALEKKQRILIIKNTIDSANSTYKLLKENLSNKYNDADINVLHDRFKFKDKEEKYNKIFDEKGDVWISTQEISLDIDFNIVISDLATMDSLIQRMSKCNSNDKCEYGNFYILPSKDEIYDDKLKNTTKSILNKILKTESIFTMSIRKNILNEYYDNSVVKKYFEDSFINCDNEIKNIFGMYKADFDGLDLIFNFEPYKHIVDNESEASKLFKATDTNCKIILEEDFYREDIDLQRDSIQVSGFIFNRLCYLKLINKLEGYMVLKSSNKLKYNSTLGLIL

SEQ ID NO: 12178 - protein, 802 aa, Clostridioides difficile T22; identical to SEQ ID NO: 12087

SEQ ID NO: 12179 - protein, 773 aa, Clostridioides difficile T22; identical to SEQ ID NO: 12175

SEQ ID NO: 12180 - protein, 802 aa, Clostridioides difficile E25; identical to SEQ ID NO: 12087

SEQ ID NO: 12181 - protein, 773 aa, Clostridioides difficile E25
MLYAKSNPVETLREHTDELLKQMNVLRESYGKNINSLDFLEEEIFWQLLDFVIEFHDIGKAFSPFQELIKSRMDTKINEPKIVTHLENNVGHNYLSPAFIDYSYIDRKKNKELRAVLNQVIVYHHERDIFIDKDFKNLIQKILDEDLINKVYELQHEFKVRYPIKTEKLSKVYLQSVEKRIDKNHKYYNLYIMLKGILHRLDHSASAHEIVECNSNMNIGEYTEKHLVKEFGSLREVQSFAKSNRNKNIILIASTGMGKTETALIWIDKDKAFFTLPLRVSINALFDRAKNIIGVGEANDTFLGLLHSTAIDYLEESNQENSNEIVDLAKLLSCKLTFSTIDQIFKFPFLYRGYEKVYSTLAYSKVVIDEIQAYSPEIAAVLVKGIEMIHKIGGRFMIMTATMPTIYIDELKKRGVMNSNLADLTCNTEKIRHCVSIVENSIDENLGKIIQNGMNKKVLVIVNTVKSAVEKYELIEEIVKPKGIDVNLNLLHSMYIQEDGAKLEKYIKEFADSDSNGIWITTQLVEASLDIDFDELHTENSTLDSLFQRFGRCYRSREYEENSPNIFIYTEKATGIGSIYDKDIVEKGLELLKTFINGKECVKMKEKYKVEMVKILYSKESLEGTAFEKRFTSALNILDTITPYSLGSKDAQNILRNIEGYTVIPEDIYNKIEETLIKDYEELGQELINAYSNDDRQLINKIKSKRKKARREIIKKTVNLPIYKAKQNVIDIQVKGLEDLKILLYKYDIYENKHTKQIFGKGVLISNEIDQFI

SEQ ID NO: 12182 - protein, 802 aa, Clostridioides difficile T15; identical to SEQ ID NO: 12087

SEQ ID NO: 12183 - protein, 773 aa, Clostridioides difficile T15; identical to SEQ ID NO: 12175

SEQ ID NO: 12184 - protein, 802 aa, Clostridioides difficile E15
MKNIMQKEILAKSYNLRTNQQEQTLVEHIKDLFEVLESILELNLYSDKDVEILKICCALHDLGKINSIMQQKIEINNKISSSCSEEEKKKLEFEKKSLKKIARHNIFSGAFLKDILEKMNLSEEDKLYIYKSIMLHHGNYEDYMRLSTSKVQEEIYDYIEKGILEKEDFNLEDIEDYIKEILDVDFKFSEDVLDYDYIDKLSESMVIDSDYNNGQIEDSVLNYRKFKYILYKGMLNLIDHSASSRQKGIKFYNDFTDEEIDNMILNEIYKSQGNLEKNNIEFNTIQKRLRELSGRNVLTVAFTGSGKTAADYRKTFKRKFFLVPNKISAESFYRKNIFQNKNDLDTRSSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDVDFHLMTATLPKSYKEQMINKGIIFQEESNENVTDKGEIVFIESNKEEEICEGKDVKVSFIKEKEIKSIVEDALENKQKILIIKNTIDSVNRTYEFLKENLSDKYGGVDIDVLHSRFKFKDKKEKYSKILNGEGDIWISTQSVEISLDLDFNIIISDLATMDSLIQRMGRCNRNNKYEYGNFYILPSEDKIYDNKLKNTTKNILKDILKTNSIFTMGIRKTILDDYYDNSVVKKYFEENFISCDKEIKNIYGINKEIFDGLDLIFNFEPYKNIVDSKKEAAKIFRDVDVSYKIILEEDFYKEDKELQQDSIQVSGFIFNRLYYYGLISKVEGYMVLKSSSKFEYNSTVGLILK

SEQ ID NO: 12185 - protein, 841 aa, Clostridioides difficile E15
MNLEKIIKSNKYIYSHKSEDEEENILLHLDRTKCVFFQIDSKYKILNKLRKTYGNLKFKLNELDFYLSEEAINLIENMFLYSVYLHDIGKINPKYQSEKMKNNFEFLSEEEKSTLCLNKIVSTNHSYLSSIVYIDLMQEKIDESKNISTKEKIVLYYLMLVNANIISRHHSNQSNLEYYFAKLEREINNAKMANYLYFYNKKLNINYEKISKAFINIKKIKFDETSVYIWNKILNSLLISCDFIATHSFYSKKSISEFKINCIEGKENIKDIFYKNPIYKGIESYKLNNRYFEENNLPKINELRSDILIESNNNLDKNNNERIFNIESPTGSGKTINSLSCALKLIKDGSKLFYVFPVNTLAEQTEDVLNGIFKGKLNTQIINSISPLPIKSTDKKIDYNKVLLDRQILNYESILTSNITLFNLFFGCGREQSMGLFSLFDSVIILDEIQNYKNLIWKEIVEFLYKFSEIMDFKLIIMSATLPNLEELMDFEDKKFINLIENPKIYYNNKLFKDRVSIENKLLNETVDFKKLLDLIKEEVNIWNKEKKEYAKFLIEFITKKTAQEFYMYVSKKLNNYTVFELDGDDNKIKKQSIINHLKKDSKELKSNILLITTQVIEAGVDIDMDLGAKDTSFPDLDEQFIGRINRSCLKEGCKAFLFNLDMANIVYKNDYRLVMNIDKNKDNYLKCLSNKDFSCLYDKVFNKINLTKGNWLCSEIDVFYKDLKMIRNKDISKHMKLIDINSFEIFIPTIIDGVDGEEVWSEYVELVSNIDMEYAERKVKMINLKEKLEMFTFSIKSNKSNKLNAFGGFYYIKNGNKFIANDKFDSSRFKKEYMCLLNAQ

SEQ ID NO: 12186 - protein, 802 aa, Clostridioides difficile T23
MKNIMQKEILAKSYNLRTNQQEQTLVEHIKDLFEVLESILELNLYSDKDVEILKICCALHDLGKINSIMQQKMEINNKISYSCSEEERKKLESDKKSLKKIARHNIFSGAFLKDILEKMNLSEEDKLYIYKSIMLHHGNYEDYMRLSTSKVQKEIYDYIEKGILEKEDFNLEDIEDYIKEILDVDFKFNEDVLDYDYIDKLSESMFIDSDYNNGQIDDSVLNYRKFKYILYKGMLNLIDHSASSRQKGIKFYNDFTDEEIDNMILNEIYKSQGNLEKNNIEFNTIQKRLRELSGRNVLTVAFTGSGKTAADYRKTFKRKFFLVPNKISAESFYRKNIFQNKNDLDTRSSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDVDFHLLTATLPKSYKEQMINKGIIFQEESNENVTDKGEIVFIESNKEEEICEGKDVKVSFIKEKEIKSIVEGALENKQKILIIKNTIDSVNRTYEFLKENLSYKYGGVDIDVLHSRFKFKDKKEKYSKILNGEGDIWISTQSVEISLDLDFNIIISDLATMDSLIQRMGRCNRNNKYEYGNFYILPSEDKIYDNKLKNTTKNILKDILKTNSIFTMGIRKTILDDYYDNSVVKNYFEENFISCDKEIKNIYGINKEIFDGLDLIFNFEPYKNIVDSKNEAAKIFRDVDVSYKIILEEDFYKEDRELQQDSIQVSGFIFNRLYYYGLISKVEGYMVLKSSSKFEYNSTVGLILK

SEQ ID NO: 12187 - protein, 773 aa, Clostridioides difficile T23
MLYAKSNPVETLREHTDELLKQMNVLRESYGKNINSLDFLEEEIFWQLLDFVIEFHDIGKAFSPFQELIKSRMDTKINEPKIVTHLENNVGHNYLSPAFIDYSYIDRKKNKELRAVLNQVIVYHHERDIFIDKDFKNLIQKILDEDLINKVYELQREFKVRYPIKTEKLSKVYLQSVEKRIDKNHKYYNLYIMLKGILHRLDHSASAHEVVECNNVINIGEQTENYLMKEFGSLREAQSFAKSNRNKNIILIASTGMGKTETALIWIDKDKAFFTLPLRVSINALFDRAKNIVGVGESNDTFLGLLHSTAIDYLEESNQENSSEIVDLAKLLSCKLTFSTIDQIFKFPFLYRGYEKVYSTLAYSKVVIDEIQAYSPEIAAVLVKGIEMIHKIGGRFMIMTATMPTIYIDELKKRGVMNSNLAELTCNTEKIRHCVSIVENSIDENLGKIIQSGMNKKVLVIVNTVKSAVEKYELIEEIVKPKGIDVNLNLLHSMYIQEDRAKLEKYIKEFANSDRNGIWITTQLVEASLDIDFDELHTENSTLDSLFQRFGRCYRSREYEENSPNIFIYTEKATGIGSIYDKDIVEKGLELLKTFINGKECVKMKEKYKVEMVKILYSKESLEGTAFEKRFTSALNILDTITPYSLGSKDAQNILRNIEGYTVIPEDIYNKIEETLIKDYEELGQELINAYSNDDRQLINKIKSKRKKARREIIKKTVNLPIYKAKQNVIDIQVKGLEDLKILLYKYDIHENKHTKQIFGKGVLISNEIDQFI

SEQ ID NO: 12188 - protein, 802 aa, Clostridioides difficile E19
MKNIMQKEILAKSYNLRTNQQEQTLVEHIKDLFEVLESILELNLYSDKDVEILKICCALHDLGKINSIMQQKMEINNKISYSCSEEERKKLESDKKSLKKIARHNIFSGAFLKDILEKMNLLEEDKLYIYKSIMLHHGNYEDYMRLSTSKVQEEIYDYIEKGILEKEEFNLKDIESYINDILNVDFKFGEDVLDYDYIDKLSESMFIDSDYNNGQIDDSVLNYRKFKYILYKGMLNLIDHSASSRQKGIKFYNDFTDEEIDDMILNEIYKSQGNLEKNNIEFNTIQKRLRELSGRNVLTVAFTGSGKTAADYRKTFKRKFFLVPNKISAESFYRKNIFQNKNDLDTRSSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDVDFHLMTATLPKSYKEQMINKGIIFQEESNENVTDKGEIVFIESNKEEEICEGKDVKVSFIKEKEIKSIVEGALENKQKILIIKNTIDSVNRTYEFLKENLSDKYGGVDIDFLHSRFKFKDKKEKYSKILNGEGDIWISTQSVEISLDLDFNIIISDLATMDSLIQRMGRCNRNNKYEYGNFYILPSEDKIYDNKLKNTTKNILKDILKTNSIFTMGIRKTILDDYYDNSVVKNYFEENFISCDKEIKNIYGINKEIFDGLDLIFNFEPYKNIVDSKKEAAKIFRDVDVSYKIILEEDFYKEDRELQQDSIQVSGFIFNRLYYYGLISKVEGYMVLKSSSKFEYNSTVGLILK

SEQ ID NO: 12189 - protein, 773 aa, Clostridioides difficile E19; identical to SEQ ID NO: 12098

SEQ ID NO: 12190 - protein, 661 aa, Clostridioides difficile E19; identical to SEQ ID NO: 12099

SEQ ID NO: 12191 - protein, 802 aa, Clostridioides difficile E24; identical to SEQ ID NO: 12087

SEQ ID NO: 12192 - protein, 773 aa, Clostridioides difficile E24
MLYAKSNPVETLREHTDELLKQMNVLRESYGKNINSLDFLEEEIFWQLLDFVIEFHDIGKAFSPFQELIKSRMDTKINEPKIVTYLENNVGHNYLSPAFIDYSYIDRKKNKELRAVLNQVIVYHHERDIFIDKDFKNLIQKILDEDLINKVYELQHEFKVRYPIKTEKLSKVYLQSVEKRIDKNHKYYNLYIMLKGILHRLDHSASAHEVVECNNVINIGEQTENYLMKEFGSLREAQSFAKSNRNKNIILIASTGMGKTETALIWIDKDKAFFTLPLRVSINALFDRAKNIVGVGESNDTFLGLLHSTAIDYLEESNQENSSEIVDLAKLLSCKLTFSTIDQIFKFPFLYRGYEKVYSTLAYSKVVIDEIQAYSPEIAAVLVKGIEMIHKIGGRFMIMTATMPTIYIDELKKRGVMNSNLAELTCNTEKIRHCVSIVENSIDENLGKIIQSGMNKKVLVIVNTVKSAVEKYELIEEIVKPKGIDVNLNLLHSMYIQEDRAKLEKYIKEFANSDRNGIWITTQLVEASLDIDFDELHTENSTLDSLFQRFGRCYRSREYEENSPNIFIYTEKATGIGSIYDKDIVEKGLELLKTFINGKECVKMKEKYKVEMVKILYSKESLEGTAFEKRFTSALNILDTITPYSLGSKDAQNILRNIEGYTVIPEDIYNKIEETLIKDYEELGQELINAYSNDDRQLINKIKSKRKKARREIIKKTVNLPIYKAKQNVIDIQVKGLEDLKILLYKYDIYENKHTKQIFGKGVLISNEIDQFI

SEQ ID NO: 12193 - protein, 802 aa, Clostridioides difficile T42; identical to SEQ ID NO: 12087

SEQ ID NO: 12194 - protein, 773 aa, Clostridioides difficile T42; identical to SEQ ID NO: 12192

SEQ ID NO: 12195 - protein, 802 aa, Clostridioides difficile T6; identical to SEQ ID NO: 12087

SEQ ID NO: 12196 - protein, 773 aa, Clostridioides difficile T6; identical to SEQ ID NO: 12192

SEQ ID NO: 12197 - protein, 802 aa, Clostridioides difficile E14; identical to SEQ ID NO: 12087

SEQ ID NO: 12198 - protein, 773 aa, Clostridioides difficile E14; identical to SEQ ID NO: 12192

SEQ ID NO: 12199 - protein, 802 aa, Clostridioides difficile T17; identical to SEQ ID NO: 12087

SEQ ID NO: 12200 - protein, 802 aa, Clostridioides difficile E9
MKNIMQKEILAKSYNLRTNQQEQTLVEHIKDLFEVLESILELNLYSDKDVEILKICCALHDLGKINSIMQQKMEINNKISYSCSEEERKKLESDKKSLKKIARHNIFSGAFLKDILEKMNLSEEDKLYIYKSIMLHHGNYEDYMRLSISKVQEEIYEYIEKGILEKEEFNLKDIESYINNILNVDFKFGEDVLDYDYIDKLSESMFIDSDYNNGQIDDSVLNYRKFKYILYKGMLNLIDHSASSRQKGIKFYNDFTDEEIDNMILNEIYKSQGNLEKNNIEFNTIQKRLRELSGRNVLTVAFTGSGKTAADYRKTFKRKFFLVPNKISAESFYRKNIFQNKNDLDTRSSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDVDFHLMTATLPKSYKEQMINKGIIFQEESNKNVTDKGEIVFIESNKEEEICEGKDVKVSFIKEKEIKSIVEDALENKQKILIIKNTIDSVNRTYEFLKENLSDKYGGVDIDVLHSRFKFKDKKEKYSKILNGEGDIWISTQSVEISLDLDFNIIISDLATMDSLIQRMGRCNRNNKYEYGNFYILPSEDKIYDNKLKNTTKNILKDILKTNSIFTMGIRKTILDDYYDNSVVKKYFEENFISCDKEIKNIYGINKEIFDGLDLIFNFEPYKNIVDSKKEAAKIFRDIDVSYKIILEEDFYKEDRELQQDSIQVSGFIFNRLYYYGLISKVEGYMVLKSSSKFEYNSTVGLILK

SEQ ID NO: 12201 - protein, 802 aa, Clostridioides difficile E7; identical to SEQ ID NO: 12087

SEQ ID NO: 12202 - protein, 773 aa, Clostridioides difficile E7
MLYAKSNPVETLREHTDELLKQMNVLRESYGKNINSLDFLEEEIFWQLLDFVIEFHDIGKAFSPFQELIKSRMDTKINEPKIVTHLENNVGHNYLSPAFIDYSYIDRKKNKELRAVLNQVIVYHHERDIFIDKDFKNLIQKILDEDLINKVYELQHEFKVRYPIKTEKLSKVYLQSVEKRIDKNHKYYNLYIMLKGILHRLDHSASAHEIVECNSNMNIGEYTEKHLVKEFGSLREVQSFAKSNRNKNIILIASTGMGKTETALIWIDKDKVFFTLPLRVSINALFDRAKNIIGVGEANDTFLGLLHSTAIDYLEESNQENSNEIVDLAKLLSCKLTFSTIDQIFKFPFLYRGYEKVYSTLAYSKVVIDEIQAYSPEIAAVLVKGIEMIHKIGGRFMIMTATMPTIYIDELKKRGVMNSNLADLTCNTEKIRHCVSIVENSIDENLGKIIQNGMNKKVLVIVNTVKSAVEKYELIEEIVKPKGIDVNLNLLHSMYIQEDRAKLEKYIKEFADSDSNGIWITTQLVEASLDIDFDELHTENSTLDSLFQRFGRCYRSREYEENSPNIFIYTEKATGIGSIYDKDIVEKGLELLKTFINGKECVKMKEKYKVEMVKILYSKESLEGTAFEKRFTSALNILDTITPYSLGSKDAQNILRNIEGYTVIPEDIYNKIEETLIKDYEELGQELINAYSNDDRQLINKIKSKRKKARREIIKKTVNLPIYKAKQNVIDIQVKGLEDLKILLYKYDIYENKHTKQIFGKGVLISNEIDQFI

SEQ ID NO: 12203 - protein, 802 aa, Clostridioides difficile T3; identical to SEQ ID NO: 12087

SEQ ID NO: 12204 - protein, 773 aa, Clostridioides difficile T3; identical to SEQ ID NO: 12088

SEQ ID NO: 12205 - protein, 802 aa, Clostridioides difficile E28; identical to SEQ ID NO: 12087

SEQ ID NO: 12206 - protein, 773 aa, Clostridioides difficile E28; identical to SEQ ID NO: 12088

SEQ ID NO: 12207 - protein, 802 aa, Clostridioides difficile E23
MKNIMQKEILAKSYNLRTNQQEQTLVEHIKDLFEVLESILELNLYSDKDVEILKICCALHDLGKINSIMQQKMEINNKISYSCSEEERKKLESDKKSLKKIARHNIFSGAFLKNILEKMNLSEEDKLYIYKSIMLHHGNYEDYMRLSTSKVQKEIYDYIEKGILEKEDFNLEDIEDYIKEILYVDFKFNEDVLDYDYIDKLSESMVIYSDYNNGQIEDSVLNYRKFKYILYKGMLNLIDHSASSRQKGIKFYNDFTDEEIDNMILNEIYKSQGNLEKNNIEFNTIQKRLRELSGRNVLTVAFTGSGKTAADYRKTFKRKFFLVPNKISAESFYRKNIFQNKNDLDTRSSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDVDFHLMTATLPKSYKEQMINKGIIFQEESNENVTDKGEIVFIESNKEEEICEGKDVKVSFIKEKEIKSIVEDALENKQKILIIKNTIDSVNRTYEFLKENLSDKYGGVDIDVLHSRFKFKDKKEKYSKILNGEGDIWISTQSVEISLDLDFNIIISDLATMDSLIQRMGRCNRNNKYEYGNFYILPSEDKIYDNKLKSTTKNILKDILKTNSIFTMGIRKTILDDYYDNSVVKKYFEENFISCDKEIKNIYGVNKEIFDGLDLIFNFEPYKNIVDSKKEAAKIFRDVDVSYKIILEEDFYKEDRELQQDSIQVSGFIFNRLYYYGLISKVEGYMVLKSSSKFEYNSTVGLILK

SEQ ID NO: 12208 - protein, 773 aa, Clostridioides difficile E23
MLYAKSNPVETLREHTDELLKQMNVLRESYGKNINSLDFLEEEIFWQLLDFVIEFHDIGKAFSPFQELIKSRMDTKINEPKIVTHLENNVGHNYLSPAFIDYSYIDRKKNKELRAVLNQVIVYHHERDIFIDKDFKNLIQKILDEDLINKVYELQHEFKVRYPIKTERLSKVYLQSVEKRIDKNHKYYNLYIMLKGILHRLDHSASAHEVVECNNVINIGEQTENYLMKEFGSLREAQSFAKSNRNKNIILIASTGMGKTETALIWIDKDKAFFTLPLRVSINALFDRAKNIVGVGESNDTFLGLLHSTAIDYLEESNQENSSEIVDLAKLLSCKLTFSTIDQIFKFPFLYRGYEKVYSTLAYSKVVIDEIQAYSPEIAAVLVKGIEMIHKIGGRFMIMTATMPTIYIDELKKRGVMNSNLADLTCNTEKIRHCVSIVENSIDENLGKIIQSGMNKKVLVIVNTVKSAVEKYELIEEIVKPKGIDVNLNLLHSMYIQEDRAKLEKYIKEFADSDSNGIWITTQLVEASLDIDFDELHTENSTLDSLFQRFGRCYRSREYEENSPNIFIYTEKATGIGSIYDKDIVEKGLELLKTFINGKECVKMKEKYKVEMVKILYSKESLEGTAFEKRFTSALNILDTITPYSLGSKDAQNILRNIEGYTVIPEDIYNKIEETLIKDYEELGQELINAYSNDDRQLINKIKSKRKKARREIIKKTVNLPIYKAKQNVIDIQVKGLEDLKILLYKYDIHENKHTKQIFGKGVLISNEIDQFI

SEQ ID NO: 12209 - protein, 802 aa, Clostridioides difficile E12; identical to SEQ ID NO: 12200

SEQ ID NO: 12210 - protein, 773 aa, Clostridioides difficile E12
MLYAKSNPVETLREHTDELLKQMNVLRESYGKNINSLDFLEEEIFWQLLDLVIEFHDIGKAFSPFQELIKSRMDTKINEPKIVTHLENNVGHNYLSPAFIDYSYIDRKKNKELRAVLNQVIVYHHERDIFIDKDFKNLIQKILDEDLINKVYELQHEFKVRYPIKTERLSKVYLQSVEKRIDKNHKYYNLYIMLKGILHRLDHSASAHEVVECNNVINIGEQTENYLMKEFGSLREAQSFAKSNRNKNIILIASTGMGKTETALIWIDKDKAFFTLPLRVSINALFDRAKNIVGVGESNDTFLGLLHSTAIDYLEESNQENSSEIVDLAKLLSCKLTFSTIDQIFKFPFLYRGYEKVYSTLAYSKVVIDEIQAYSPEIAAVLVKGIEMIHKIGGRFMIMTATMPTIYIDELKKRGVMNSNLAELTCNTEKIRHCVSIVENSIDENLGKIIQSGMNKKVLVIVNTVKSAVEKYELIEEIVKPKGIDVNLNLLHSMYIQEDRAKLEKYIKEFANSDRNGIWITTQLVEASLDIDFDELHTENSTLDSLFQRFGRCYRSREYEENSPNIFIYTEKATGIGSIYDKDIVEKGLELLKTFINGKECVKMKEKYKVEMVKILYSKESLEGTAFEKRFTSALNILDTITPYSLGSKDAQNILRNIEGYTVIPEDIYNKIEETLIKDYEELGQELINAYSNDDRQLINKIKSKRKKARREIIKKTVNLPIYKAKQNVIDIQVKGLEDLKILLYKYDIYENKHTKQIFGKGVLISNEIDQFI

SEQ ID NO: 12211 - protein, 802 aa, Clostridioides difficile T19
MKNIMQKEILAKSYNLRTNQQEQTLVEHIKDLFEVLESILELNLYSDKDVEILKICCALHDLGKINSIMQQKMEINNKISYSCSEEERKKLESDKKSLKKIARHNIFSGAFLKDILEKMNLSEEDKLYIYKSIMLHHGNYEDYMRLSTSKVQKEIYDYIEKGILEKEDFNLEDIEDYIKEILDVDFKFNEDVLDYDYIDKLSESMFIDSDYNNGQIDDSVLNYRKFKYILYKGMLNLIDHSASSRQKGIKFYNDFTDEEIDNMILNEIYKSQGNLEKNNIEFNTIQKRLRELSGRNVLTVAFTGSGKTAADYRKTFKRKFFLVPNKISAESFYRKNIFQNKNDLDTRSSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDVDFHLMTATLPKSYKEQMINKGIVFQEESNENVTDKGEIVFIESNKEEEICEGKDVKVSFIKEKEIKSIVEGALENKQKILIIKNTIDSVNRTYEFLKENLSDKYGGVDIDVLHSRFKFKDKKEKYSKILNGEGDIWISTQSVEISLDLDFNIIISDLATMDSLIQRMGRCNRNNKYEYGNFYILPSEDKIYDNKLKNTTKNILKDILKTKSIFTMGIRKTILDDYYDNSVVKKYFEENFISCDKEIKNIYGINKEIFDGLDLIFNFEPYKNIVDSKKEAAKIFRDVDVSYKIILEEDFYKEDRELQQDSIQVSGFIFNRLYYYGLISKVEGYMVLKSSSKFEYNSTVGLILK

SEQ ID NO: 12212 - protein, 773 aa, Clostridioides difficile T19
MLYAKSNPVETLREHTDELLKQMNVLRESYGKNINSLDFLEEEIFWQLLDFVIEFHDIGKAFSPFQELIKSRMDTKINEPKIVTHLENNVGHNYLSPAFIDYSYIDRKKNKELRAVLNQVIVYHHERDIFIDKDFKNLIQKILDEDLINKVYELQHEFKVRYPIKTEKLSKVYLQSVEKRIDKNHKYYNLYIMLKGILHRLDHSASAHEIVECNSNMNIGEYTEKHLVKEFGSLREVQSFAKSNRNKNIILIASTGMGKTETALIWIDKDKAFFTLPLRVSINALFDRAKNIIGVGEANDTFLGLLHSTAIDYLEESNQENSNEIVDLAKLLSCKLTFSTIDQIFKFPFLYRGYEKVYSTLAYSKVVIDEIQAYSPEIAAVLVKGIEMIHKIGGRFMIMTATMPTIYIDELKKRGVMNSNLADLTCNTEKIRHCVSIVENSIDENLGKIIQSGMNKKVLVIVNTVKSAVEKYELIEEIVKPKGIDVNLNLLHSMYIQEDRAKLEKYIKEFADSDSNGIWITTQLVEASLDIDFDELHTENSTLDSLFQRFGRCYRSREYEENSPNIFIYTEKATGIGSIYDKDIVEKGLELLKTFINGKECVKMKEKYKVEMVKILYSKESLEGTAFEKRFTSALNILDTITPYSLGSKDAQNILRNIEGYTVIPEDIYNKIEETLIKDYEELGQELINAYSNDDRQLINKIKSKRKKARREIIKKTVNLPIYKAKQNVIDIQVKGLEDLKILLYKYDIYENKHTKQIFGKGVLISNEIDQFI

SEQ ID NO: 12213 - protein, 660 aa, Clostridioides difficile T19
MNSLDKYKAKSDGISIDKHNEDMNYIMNQLVSIYNISDDMRNDLHEAIVCHDVGKVVKSFQDNIENTIRRVRHELLSASIKHLKRGQKLAILTHHKDIEYLVSQITNSIYEIELNELKEILDVEVEDIRPFINEISRARNDDTRKLENILLKGYLQYCDHIASAGIKSIDKGFNSIKDFSLPKGVSYNSIQEKVLNMDKNEDIMIMAMTGLGKTATSLYWSDIAQNEGKSKRIYYILPYTASINSLYENLYNRNISVSMLHSKAPYFLNKISDEEDIKQLYQIYKKSVKQINVCTIFQLVKSIFSCKRFEMLLSQLKDSIFIVDEIHCFDTRVLCYTLEFLKYLKENLNIQICIMSASIPTCLKKLIQERLKISTIIEPDKNDLINRHKLNRINKSILDSLDKIENDMIQGKRVLICVNSVDLAQELYRKLQSYNPKLIHGRFNTRDREQAEEGIEKSFLLIGTQSIEVSLDISYDVLYTELAPFDSLLQRFGRVNRKGENKELSNVYIYDYDMNLNIYDYDIVNRTDTIISEIIHKDNSIVNESKVSFYLDNVYLDIDMDKYNKHKTTLEIIIRNMRVGIWNKSASIDMLNNDSISVIPESLIDEYKLFLNQKMYLEASSLFVNVSVKRYNSNRNMFYEDNDVIVTSYSYDNKLGLEFD

SEQ ID NO: 12214 - protein, 802 aa, Clostridioides difficile T10; identical to SEQ ID NO: 12207

SEQ ID NO: 12215 - protein, 773 aa, Clostridioides difficile T10; identical to SEQ ID NO: 12208

SEQ ID NO: 12216 - protein, 802 aa, Clostridioides difficile T14; identical to SEQ ID NO: 12200

SEQ ID NO: 12217 - protein, 773 aa, Clostridioides difficile T14; identical to SEQ ID NO: 12210

SEQ ID NO: 12218 - protein, 802 aa, Clostridioides difficile T61; identical to SEQ ID NO: 12176

SEQ ID NO: 12219 - protein, 773 aa, Desulfotomaculum hydrothermale Lam5 = DSM 18033
MIQEYAKPCAGERGTYTYHVSECYRLWEEIFQSRAVALACFCNSINISLKEFQEKSKKAVLFHDAGKLLPTFQQQMQRLVEKQAPDPALHFRHELASALLLFAMEWKTLKNNETLIPYEILAVLGHHKPLQPDWQSFEREKICQESPGLDEKAIQRIVQVAETYGLCCDLDITATVKRFTFAKWPTLLLENGLGERLQPTTLGNIPASERRKLRLAYALTKGLLMTCDWLASAKSEDQLPINHKMTSAVLRKKLKEKVEQEGRKYEKRPFHRACEEVQGNILAIAPTGAGKTEAALLWATNGEPSKIIFLMPTMVTSNSLYERMCKHYFEEKECGLIHSGADTYFAQQDKFDQDNTVNDFRLALYQFRAFMPPVMVATVDQMLTSGFNIGSWCQKEWALVGSRVIFDEIHAYQSYTLGLITAAIEKIKLLGGTVCLMSATMPAFLREHFQSLLEVSAPIVAEELMQRQKCHWKYRETPINEMAGEIEDYLRQGKKVALIFNTVRAAQEAYREWRKILGKERVLCYHSQFIMRDRQDKETALLMKDEKGRPNNYDLVITTQVIEVSLDISFDVMYSECAPLDSLIQRAGRCNRYNADGDYYFIVFPASEIAVKYVYKGAKAVLEKTAQIVRQNQKRLSEDELGQMLEYVYDGYKLGADNTEYQEGYRLYDEIATSIDSKGFIFDLSISEETVTRKFEDYLKVNIIPQIFYGEVEKLWAERKYYLLRLYEVPISEYRRRKLKSVDNPMQLPIYEAPYTQEEGVLDSEDDFPTRLL

SEQ ID NO: 12220 - protein, 764 aa, Xanthomonas translucens pv. translucens DSM 18974
MKFYAHSAKRQDRGDWQPLAEHLIQVGDFAAEHAAPFGGQILARAAGRLHDLGKYTEKFQARLDGDPARVDHATWGARIARERYSTTGALIAYGIAGHHAGLANGRAGHEAQSRPSLQERLSDDYRKHELPPLLPEWEQELALPDKLALPAGFAGHSHLERRPFQLSLLARMLFSCLVDADFTDTDDFYRRLEGRPSRAEEAGTRPTLAQLRERLNTHMAGFPREGGINPLRTQILHEVRAKADMRPGLFSLTVPTGGGKTLASLAFALDHAIAHAQSHGLRRVIYVIPFTSIVEQTVQVFRHALGVQDRDDVVLEHHSAFFDDPSAAPQAIAKRRLAMENWDAPIVVTTAVQFFESLFADRPARCRKLHNIAGSVVVLDEAQTLPHNLLRPCVALLDELARNYRVSPVLCTATQPALRLEQGFKGGLEHVQELVDDPPALYAQLQRVRVRHVGMLDDDALADHLRRHEQVLCIVNNRRHARHLFDAIAGQPGVRHLTTLMHARHRSAVLAELREDLKAGRPCRLVATSLIEAGVDVDFPAVLRAEAGLDSIAQAAGRCNREGRRPLDASEVLVFAPANRDWAPAKELELFAEVFRGVERAHRDDLLAMEAVADYFGALYRRLGDGRLDREDLLGLLRNADIDGLPLDTLARKFKLIRTTMRPLIVPYAPGSDKEVPEVADTLRQLEHAEQVGVAGAARRLQPWLVQVPEQAYKALWQAHAIAPVAQARYGEQFVRLVNPSLYNARFGLHWENPQFLDAGKNVW

SEQ ID NO: 12221 - protein, 925 aa, Crocosphaera watsonii WH 0401
MDSMDSLNQSAIREAVKQDIYPIPDWLEVGKYAFSTEHQRNVKVNGFLGHIANCLVSGETVHIEIEKLSPSTIEVTEFDISKISHLTYASVATEWQNEIKDIQIFPGDSAKSSTIPAEIHPSLKQALIQTGINEFYSHQLKAWNELNQGHSICITTPTASGKSNSFIPFSFHQALTKQRTSLFIYPLKALASDQYSKLIKLNQALPSQEQLFIAKCTGDVPLETRKNYFKGVKCPDIIVISPDVLHHLLYHTDKSQLVLLKDFLSRLNLIVCDESHTYISSFGIHFANLLRRLRLAAQNSGNSALRLRLGLVEEINWVISTATISNPLELASQLTGLSSNQITLINESGAKSHEKTLLVFNPQNSPNFASTNLISSLLNFDLKGLVFVNSRQTAKHIFSLLSYHHGGYISSVDLFYGSLRSEQRKERIEQLSNCETKILITTNCLEAGIDLPELDFVVLRGFSSLNSFWQRGGRCGRKSPGLIIFIPDSNNHIDYYYATQPQRLLSPVEKVKIQPNYPSILSRHLLCAAAEGGLNSDEVTQYFGDKSDLVTAELLKQKQLSWSLGKRLWKRGYPHKYVSLRGIQDETISLIDVKTSKILEEMSLYIAHKECHTGAIYLTASEGKTNVWRCKELDLKQNKAFLELENSSDKRTKPDVQLAIEPLSKLEDPSIVKTAIPNGNLRLIFYWGKVKRQVMGFKELQLVYAPTCINRNCSHYQIPKASQMTKCPGCGWTLKQRLNTQEIAKFEFKPPLETTIEVPLLRIEVNETLATAITNKAQEIKKAILKTYHNPDDIPHQLSPTFSYEPVHLALHSLCHLLTKTVPLLFLASHQDLSSYTEQRPANIGTSHRTIAYIFDSVHEGCGTTEALVNDWDNCVEKALELATNCDCGDMGCPRCLTEIGCPESNDGLSKLLGIWLLEQIANSP

SEQ ID NO: 12222 - protein, 724 aa, Magnetospira sp. QH-2
MTDFIAHRNPLSRDTHGLWEHSTETGRLAQCFAAAWGAGDIAYLAGLWHDLGKYAAEFQEMIGGDPDAHLEGQPAPRKRVNHSSAGALWAMQRALEAKQRGLGMILGYVIAGHHAGLPDWDPTEGGGGLKDRLTQTSHLERALAAKPPRDLLDFPFPELTLGAGKDLSLWIRLLASALFDADFLDTEAFFNRQKSKDRRGWADLATLSQKLDDHLATFEGVTGDVNKVRGEVQAACRKAADLPPGLFSLTVPTGGGKTLSSLAFALDHAQRHGLRRVIYAVPFTSIIEQTADVFRAALGGDAVLEHHSALDPDGNTSRSRLASENWDAPLIVTTTVQLFDSLFAARTSKVRKLHNIAGSVLILDEAQALPPAVLRPVTIVLDQLVKFYGVTVVLCTATQPALRSVFKELGEAREIAPDPPRLFEALKRVTVTWLSDRTPWDQLAARMATEPRALAIVNTRREARALVDLLPDGAVHLSTWQCPAHRQTLLETVRTPDAPVRVVSTSLIEAGVDIDFPVVFRAWTGLDSLAQAAGRCNREGKLDKGQFVVFRPEGAPPRGHILQAVTALETVRGTYGENCFTPQAFRDYFEALYWAKGDTLDKYGMGRLLNLGGAKLQPHLAFRTAAQAFQMIEDGQQAVIVPFDECAERLIDELRRVGPSRDLLRKLQRYTVPLTRWDFDALSKLGVTETLDGLPVLTDQSLYHPDLGLDVPGLSEPRLNILNI

SEQ ID NO: 12223 - protein, 751 aa, Clostridium  ultunense Esp
MNRLLAKKMKLGTEFGALLPGHLTQVRDVAKIFVNTPDLLNHTGLGADELSYFRKSIQLVSILHDLGKANPYFQGMLSQEGRRITQPIRHEVVSDWILRKHEGIYRAVLKWIDLPNHENSIHDWKFVSLRVAILGHHLKFPGSDHGQGEEITIQTDHNDFKNSLRLLEELTGEEIKNFSVPPLIADYRWLDKNVKKDFRHSLVQSGLGEELSNEKGKYASLLRTFLLSMDSLGSVASETEEDWQHYRSVIQESIQGSDLTKTLKKMIDLRLEGRTPDPEINDFQIRVGKSEASVTIVEAGCGSGKTISSYLWAEKRNAKNFFLAYPTTATATQGYLDYGLLAPEASKLLHSRSTVDMELLANGEEENDEDTAAAMNAMDRIQKPFVLCTVDTILGVVQNYRSSAILFPKLLNGVAVFDEVHSYDDSLFQHLLEFLGTVSIPTLLMSASLQAHRKKEILNLLEKRGRSVQWIKGPEAYERRIRYRIRMREQLDEEVIWSALREGRKVLVIANQVKAARGYYETLKEKAEKMGIEAKWFLYHARFEYQDRVERQQEIVSHFREGGAVCAVTTQIAEMSFDISADLLISEISDFPSIIQRLGRLNRYAKEGDPVKEAYFFKPKEVYPYTSEEITQAEEVLLELKDQDISQMDLAVQLNHLEGRKLQSSIVFAWQSLLSAKADQSLREPGYSIDCLRELHYEPRQRQPWSTLQKYLIPMPGNGISPGLRKVRSAYLIPEEKIDYTKEKGGRWKDE

SEQ ID NO: 12224 - protein, 729 aa, Clostridium  ultunense Esp
MGNFYAHTPSEEGRKWHDLNDHLLNVARLARDFANPYQGGDVAYLCGLLHDLGKFHPEFQEYLEKQAKGENGMSVPHAIWGAALAYQIIWRKMRHPELWKPFALPVAGHHAGLNSSGSLSLILEERIEKQKSHFLEVLQHAEPFLCKYVFPYLLKEWELPTLAKTEREMWIRMVFSALVDADYLDTERHFQPTLALARRQLISVKDLWNRFVSDQQQLIDKAENTLVNRVRKQVYEACVESATKPQGVFRLTVPTGGGKTRSGLAFALKHVAEHQLDRVIVAIPYTSIIEQTAGVYREIFGDEAVLEHHSQVDMEYDEEQNEHVIRQRLATENWDAPLVVTTTAQLFDSLFSNRPGRVRKLHNLSRSVILLDEVQTLPPELLRPTLDALAMLVRHCRSTVVLSTATQPVFEESRFLEAFSDLAVEEILPPALVNDHFRQLRRVDYEVWKGPVLLEELVDFIREQRQVLVVFNTRKEAKKCVDLLKEDGDVLHLSSLLCGAHRRKILAEVRSRLIENRPVRLISTQVVEAGVDLDFPLVMRQIGPLDRMVQAAGRCNREGKLNQGRVIIFETQEGGSPRGPYRVALEVARAMLARMQAEDLHRHHLFRDYFQQLFASVDLDQRKIQTDREVMDYPRVAEKYRLIDQDTVPVVVPYEDSQKYLRNWEKEPSRKNLRLLQPYIIQLYQWEVQKKEREGWLRWVSGNLYQWLGGYDELVGMTEEFYDPYDLMG

SEQ ID NO: 12225 - protein, 785 aa, Clostridium  ultunense Esp
MSFSLNNWRTHPSVLHLESILAKSERRPDGSETLLDHTFNVILALKHLLDRHPHVGEFKEELFWAALLHDFGKMANGFQRQLTTDERWGERHELLSLSFLDWVIPPSEEILRKHVITAVLTHHKEWEKLIERYPPYSSVSEKHIEEQVRELPGHLFPDLWDFIREVVPVWKRELGFGEILWGEIWRDKRNRAPRFQDFVPRAVHVIMTAIHQTDREIHQKFGMRKLDKAEAKIGILLRGALLASDHRASAGRIEIQPLRVSSQREIMERFHLDEDHLYPHQRQVMKVKGSALLIAPTGSGKTEAALLWAFASSFSHFIYLLPYQASMNAMYLRLHSIFPGAVSLKHGRDLQFYYYRLMEMEIGTESAEKEARKIRNVVNLHLFPIRVSSPYQILKVFFRTKGYEAEIVRLSNNRIVVDEIHVYDVVRTAMLIKAFGYLQREWGVEFLFMTATFPQLLQQVLQEELRFQALIKPASEFYQKVRRHHIHFIHRDLLDDESIRIIESRIEKGENVLIVCNTISRAMKMYRRLKAGKIKITLLLLHGKLHGRDRLQVEKEILERMNKPSSQKIPTVLVATQAVEVSLDVSFEVGFSDPAPLEAMLQRLGRVNRKPFPPEKICDFYICTSPTRFQGIYREEEVLRSLEILRKNGESFILDEGRVNEWLDWIYSGDLRDDWLTRYRFEAEKFKRAILDSLAPYSADKELSDEFFEQFDSIPVLAGNLVEEYITLANRSYLEADQLLVPVSRYFYNKYKSEEKPVGLEDVHVVNVYYVNGLGLDVKNEDEGD

SEQ ID NO: 12226 - protein, 825 aa, Clostridium  ultunense Esp
MVIPFHQCIARPKEGDRNYPLPSHLETVARGLKVEDTLSGRISFLAGLLHDIGKARTEWQLYLLEKMRGERKKKVPHSKYGAVLFAFYASRLLEMKKREGEGREAEKLLMLRWVRDIMDHHGELKDIEKDAPWLGGVVRAEEFGSMDLSGIHDWLTSFYPEFGSFSLTVTAILQWMSQSRRSWEQGYRSLKRLEIKRAEAAKYCLRHQTAAFIQADRFDAAQVEERKLTGEMIQKGLKNLDDYLERLNHSGAGISSLRRELQERALSTYEKQVGSSVFLLDLPTGMGKTITSLKIALTEAGRKGRERLVYVAPYLSILSQTAGDIRKATGLGVQEHHSLMWNRFPTSEKNKEEQGRDDPQEEEMDEKAVLLLEAWQSPIIATTFHQLFRGFFPRRAQQTMRLSGLKNTVLIIDEPQVIGDQVWLPFLKMLEEIGETMDCTILIVTATMPPVKILSSPPTSLIAAPVSYPDRYVVRMKENPMSADQLVFEVEQELTSSQQVGIILNTIRDSADVYRKMDERLGDGGMREKVALIHLNGAMTPLHKAVQIGRVKERVGRGRGERPTPTVVISTQMIEAGVDISFRTLYRALSIYPSLVQAAGRVNRHREAEEGKMVIFSYVREDGTDTRRFVYRDSILREITDQLLLSEVELSEREFVQKVEDYYEQLYARQKLEAALDQMIEAAKGRWSEISGILPFEEERMRIPVFVPWGQDFIHADPSKMSEELRRLQDQIRWGLQRYGISDPEELYEHYTDFDRFGRLEGIEQKRFMGLLQQFIVPVHAKTALSIVANWDDPHEIKRISSLKHYSDENGLALHIGHEEGGELW

SEQ ID NO: 12227 - protein, 881 aa, Nitrosospira lacus
MVILPSDAFGKLQRNEFDAVIGWHPLIDHMIDVAATFECLCACRSIRRSMREAAGTLLDERDIERLSVLVFLHDVGKANSGFQAKRWKNLHDIPKEWPCHAGHGIEAFKLFDPSNRLDHLSTLLPVDQMDTWGDACSPLLVASISHHGRPLKDTPADWSKNIWKKVGGAYDPALVLNEMGKRVVELFPQAFEPGGRSLPDAPAFGHLFAGLVQLADWLGSDTKFFPYSEKEEDRAVTARERARKAVSAIGLDADNWRDKLKHHPPSFADTFGIAEPRPIQAAMSNDRLGPLVILESETGSGKTEAALWRFVHLFRAGLVDSLYFALPTRVAASQIYNRTQAVVRNLWIENPPVTVRALPGYVNADGGDATYLPNFDVLWSDNPDDAEAHRRWAAESAKRFLAAPIAVGTVDQALLGALQVRHAHLRHAMLARSLLVVDEVHASDPYMTVLLERLLKAHLNNGGHAMLLSATLGSSARNRYLALAPHVESPQAKSMTFEAACGVPYPAISDYSQTQAVEAAGGTKKVTWAAYDIIGAPDRIANMAIDAARLGAKVLVIRNTVIDAIATLAAIEENIPDKTWLFTVNGVVTLHHSRFSRQDRPVMDKAIEAQLGKQRPPGALIVVGTQTLEQSLDIDADLLITDLCPMDVLLQRIGRLHRHVRPASERPQAFQSAKAWVLTPAVHDLNPLIAKSRHGLGRFHNGGGVYADLRVLEATRELLIERPVVLIPADNRYLVESATHPDRLRVIQVKNGESWQVLGQKIEGETSAQRTVGHLHALDVEQVFGEQEFPRDVQIATRLGAQDRILYFNLELPSAFGVPIKELPVRHHLLPKDLSLDVLSSDINQTKTSLTFRLGEARFSYSRLGLERMNDTLCADTGGLP

SEQ ID NO: 12228 - protein, 756 aa, Thalassolituus oleivorans MIL-1
MKKLTNYVAHVKQKMNSSDWDVPHNLAEHLIKTAELAGQFAPKNSIEWASLTGQWHDLGKYRKRFQDYIRYQSGFERENAHIENSQRAPHSTAGAIHAVSSLPPIVGHIVAYMIAGHHAGLPDWEGGRGSLKYRLKDGEQEYQEALQEAIPDDILQFSAPQFPSFIQNKDVLPLWIRILFSCLVDADFRDTESYMAPEKTKQRGSYPDLNDLLIRFDKEISKLRENAPDTPLIKIRNEILAACNKAAVLKPGLFSLTVPTGGGKTLSSLSFALRHAKKFNKRRIIYAIPFTSIIEQNAEVFRQFLGDESVLEHHSSLDVDPGEENSKARLATENWDAPLIVTTNVQLFESLFASRTSRCRKLHNLVDSIIILDEAQQIPREFQAPITQVMQQMSDHFGVTWVLCTATQPDLSAAQDYLGRTTFNGLNNIREIVSDPTQLAQQLKRVEVVLPKHDAPITPWPEVAEQLSQEDSVLAIVNTRKNAKDLYGQLPNDGNNLHLSANMCAEHRTNVIQQIKHRLATRRAGDTRPLRVVSTSLIEAGVDVDFPVVYRAIAGLDSIAQSAGRCNREGKLESGRVIVFKPEQPSPPGFLRDGESATLEMIGAGLLDDPLSPSSFLRYFKALNNKADRDRHKILSEFLKVKVTQKNELAIQFRSAAEKFRLIDDKGVSVIVPFQPKEGSTCPVETWIEQLERDPLEKWIYKKLQRYTVSLPERIAHELVKIGAIEQRAGLKVLMSKYYDSVWGVYGPDDLLDGVI

SEQ ID NO: 12229 - protein, 718 aa, Halanaerobium saccharolyticum subsp. saccharolyticum DSM 6643
MEKFIAHTENDKGETHELKDHIYSTANKAKKFADKWSMGDLAYTSGLLHDLGKYSDQFQNYLKNNSSGVEHAIAGAIFAKKDKSIKFSNILPFFIAGHHAGLHNLTDLKNSLKEKANKDFVKSSINNFGNNIKLEYKDNENINFDIKNDRLELEFLMRMMFSSLVDADYLDTEKHFDLNKYSLRNLNNYDIEGLWNKFSENQNKLMEEAEKSKLNDIRNNIYDSVLNKAEQKNKFFSLTVPTGGGKTRTGLGFALKHAKFNNMDRVIVVIPYTNIIEQTAKTYKEILGEENILEHHSNFDFSEDEAEYNKEKIKLATENWDMPVVVTTSVQFFESLFSHKTSKLRKLHNLANSTIIFDEVQTLPPEYLNSILQVLKQLVKNYNSAIVFSTATQPAFGDRDKFNGIKNIEELVPDTDNLFRNLARVEYDLSYIEKKLSWNQVAELMLEEKQALAVLNTKDDAKKLYSILSDNSKNVYHLSTYMCSAHRKIILNEVKEKLNNNESCYLISTQLIEAGVDIDFPMVLRAMAPLDSIVQAAGRCNRENKLDKGKVIVFTPKENKLPKGIYKTATDKSKLFLNDPEQLLTAEIFLGYFDTLYKDVNLDKKKINESRKSFKFREVSRQFKIIPDDTVNVIIENNDIIDQLPVNLNVIKNKEFISREEWRKLQPYLISIRKYKVNDLLKDGILYELLEDVYVWTGKYDEKEGIMLDGYNTSDFLP

SEQ ID NO: 12230 - protein, 684 aa, Mesotoga infera
MSLAKPGVSLVEHTERVLDYAHSYLDQNKIALKNTNLDPKQISEAILTACAFHDIGKGCVEFSFDKKGFSHSLASAQIAMASLKESPIKNYILQSILGHHGSRFKDSFSSLEFQRQQATPNPELVNEFKEIKDYVKGHFSIELPDLNLQIPSPRELLKRLCNFFFGAPRDRRLYFLIQGILNLADWSASAKKSLSSASIKLDSRPLRKFQAEASTGKDTIILAPTGRGKSLAALVWTKSTGREKSTLFLPTVTTVEAMYKRYTEEVSDKTGLVHGNIAYYLYSNEGYSEDTRDRIFWMKAFDNPFNVATLDQLLLMSLNWGRWEPKIVNIVNSAVIFDEIHASQPYTFGILLESIKMLKAMGTPVCVMSATLPSYMIQKLKEVLDDPVIVRDYEGESLRRITISHLEEVDPVEETKRQYEKGKRAILCFNTVRKATEAFKTLSDKMPDKDIVLYHGRFNLEDRERILSRITGDSPPRIIVATQTIEISLNISYDVLITEAAPIDSLTQRFGRVNREGTTPIGEVIIFPQNENSYSIYNKNLVDKSLGLLKARQTPSGLELREMMENLLSEIENIEEEISAGKASWQFVREMNFQIYSMSIDQRLADDLIRRIPYKTIEVIPSEFRANNSGKMQKLGKLVKVPVKDVIGRLEKDDDGFIYAPIIYNPSLGYLGPKEDESPIVEDT

SEQ ID NO: 12231 - protein, 706 aa, Pyronema omphalodes CBS 100304
MTDVFRLLTRSATFTKTSQKPAAPALSTLPVAPTAPAQPTLTKSAKKRKRKAAAAASTTESITTTASTSTLIAVPKELDFFGQGQKKATEAAGAPAKRRRHNDDDSEGSDDEGASSDEEGGTKDELTVTLPTLEEIKSTLRLHKLKFTIMSTPTPAEPVEAAEPEPEEKKKKSKKEKKEKKYKNENKTEEAPKKKAKRPELLIPPVTDFSQLRSSGHGYALSKRVFSNILAQGYSSPTEVQMGSLPILMKDNLSIEGIPAGSPIDLLTCAPTGSGKTLAYVVPLLNRLLREQKDRNNDAQKGVKAIILAPTKELVSQITNEIKKLVVGTSIKVSQFKKGARPVSFTDVLPEDFKDPAIKSDILVSTPMVLQNALESAGESCLTNLTAFILDEADVLLDELFREQTVAIWTALKSRSTTLRTSLWSATMPSSVEALVTTHLPDSNIIRLVVGIKDSSLPTITQDLTYCATETGKLHALRQLFTTGLRPPLIIFLQSIDRAQALYREVQYDLATPGRIAVLHAKLDDTTREQTMTRFRLGEVWILITTDLLARGMDFRGVRMVVNYDIPTSVASYIHRIGRTGRAGKDGKAVTYYTKEDIGYVKGIANVIKASGGDVQKWLLDALPNTTKEEKKKLKMHGVEVRRGVSAAARISTKSGAQRDKEWRRKMAVESSKRRKREAEEGSGSDSDDGGVAAGGEDEGDFAGFD

SEQ ID NO: 12232 - protein, 437 aa, Bacteroides sp. CAG:927
MDSKLITKNIELRHGIGQLNAMQQQMLNLRHPAAVLIAPTGSGKTLAFAANLLSAMHSPNGKVQAVVLAPSRELVLQIYDVIRPIASGFKTTVLYGGHRMLDEVSSLTPSPDIIIATPGRILDHLQRKTLNIEQTRILVLDEYDKSLEMGFADEMSRIVRRIHRPERVILTSATELAELPPYMPVNDPVVIKAQQNAHPAKRTQIVEIPSPERDKASTLIRLLHSLPNGKVIVFVNHRESAERIHSILRKEGFPVGLYHGGLEQMDRDNALTLLHNGTTPILVSTDLGSRGIDVEGVSSVIHYHMPPSAESWTHRNGRTARMNAQGTVYVITSEGENIPEYVVTDRSWVPDGNNPDPITASMTTLHINAGKKEKISKGDIVGYLLAHTDLTASHIGTITLRDHNALVAVPKDYAEKIVELCSPQKLKGKRIRISILH

SEQ ID NO: 12233 - protein, 731 aa, Firmicutes bacterium CAG:555
MEEQFIAHISDSGKVQSVAEHSLNTAAAAADFSIAELRQINYLCGLLHDVGKYSSEFQRRIRGENIRVEHSICGALEAAKLEGKGTPLTLLLQLCIAGHHSGIPDCGVKNNTPDMPTLFGRLRRNPGDFGGYSSELDIERVAPEPFTALLIKDCKTTADVVEKFAFFVRYCFSCLTDADSLDTAKFCEEALPDPLRCSFERCEASLDAKLGGFKAMTELQTARSKLQEQAFARIGESSNIYLMNMPTGSGKTLASMRCALKRVLASNGRLRRIIYVIPYNSIIDQTALTFEGLFSEHTDFLRQQSSFVYEEQSELSEDSKAAFSAACENWDAGIVITTAVQFFESLYGDKRGKLRKVHNMANSVIVLDEAHLMPREYLEPCLRGIGYITKYLNSQALFLTATMPDFRSLLERCAEGGLSVTDLIDDTSDFEKFRKCRFSDLGEMSDEVLVQKASGYASSLIVVNSRRKAAELYKLCPGEKYHLSTYMTAYDRTRAIENIKAALKRLYDDYPDLSAVPSERRITVVSTSLIEAGVDLDFVAAFRELAGLDSVLQTGGRCNREGLRAPGEVFVFESPEAGRRRTEQELTKGLLAEYEDISCEAAIRAYYDRLFCIDDEKIHSKSVGRSCKSIDMIPFRTYSENFRLIDDRRTVSLAVCRDDYSRKLYDTLCATGRISSRKISKYCCTVYLDEFERLRQQGVVADHGSGVFFLTNKEYYSSELGVQFEGTDYFI

SEQ ID NO: 12234 - protein, 715 aa, Ruminococcus sp. CAG:60
MEYIAHKDNERVQTVKEHLYGTAELAGFFAERFGKKEWGYCCGMLHDLGKYSKEFQRKIQNDTGERVDHSTAGAKVCNEKGGYYSILSYCIAGHHAGLPDYGNTAIGNSLCGRYNKKICDFKNYEKEIEIPQLHTDPIVFDPTKNLDFSLSVFVRMLYSCLVDADFLDTEAFMKNENTGRVAGETMQILEEKLEQYIEPWLSNTELESINGRRTEILAHCMEMGKREKGIYRLTVPTGGGKTIASLAFALRHAVKHQMDRIIYVIPYTSIIEQNAQVFREILGAENVLENHCNVEYKDSEEFYPMQLASENWDKPVVVTTNVQFFESLFGNKSSKCRKIHNIANSVVIFDEAQMLPMDYLKPCISVIQELVDNYASSIVLCTATQPALEMFFSSKDKMIELCPCVEEQFRFFERVTYEKIGKISQDELIMRMQGDQSILCIVNTKKAAQELYKKLREERKNIYHLSTNMYPKHRKRVLKLIRERLDNNEKCIVVSTSLVEAGVDLDFDIVYRQIAGLDSLIQAAGRCNRNGKKDLAKSKVYIFDFIDEKKVTNQKLQIETAASVLQDYEKVDDLTGISDYFKRLYHYRGTSLDKKNIMGEFKQLRFNFSKVAKEFKLIEENTKMIYINKELKAEELLNELKTKGASKERLREAGQYCVQIYGDERNENSLFDKLYSNGMLRPISEDMQDFYELMSQKQYSDEWGLDFSVDDVLMM

SEQ ID NO: 12235 - protein, 898 aa, Clostridium sp. CAG:7
MKERTKILNHMIAKTDRTDNELWLPLWMHSYDTAGVMEYLYHNWVPPAAIKVICKDMGEEMGLKVCLFLAYCHDTAKMTYVFQSNISEGVKIIREAIIQEGIKLIDPKKLTNRISHSLCGEGILRKYGVPIGISVIVGSHHGKTPDECSDEIEEKIENYGKDVFFGQQRGKWEAIWKEWLDTALEKSGFSSVEELPDISMEAQVILTGLLIMADWIASNTYYFPLIKTDCLGKDTDYPKRVNNAIERLNFPEFWIPGENDWGMDDALFEERFGFLPREVQHTAMEIAQNTIEPGIFILEAQMGVGKTEAALAMAEILGQKAGSGGIFFGLPTQATANGLFPRLMKWAEQQSENVKLGIRLAHGAVALNEDYQQLIKGSALSVGEDEENNLVVHSWFEGRKVALLVDFVIGTIDQLLMAALNQRHVMLRHLGLAGKVVIIDEVHSYDSYMMTFLERILNWLGAYHVPVIVLSATLPQKYRFNLIQAYLNKRNMNASADWCNATGYPLFTWTDGKQVCQKQMRLDGKKEIVQVIRIKDEECMEILKNSLKDGGCAGIILNTVARAQDFAQKIVECFPECEMIQMHSQFIISDRAEIEREILKRAGKNSTSEQRNKLIIVGTQVLEQSLDIDFDVMITDLCPMDLLLQRIGREHRHGGRIRPFCLQLAKCYVLTETRAVYDEWLLQRTLDKLPEQFCLPDDIPVYVQKVYAEPEECEKNELWHRYDTNLKKLKKEAERSLVGEPACEDETNPEFDSIATWMSEGDPELTDASALASVRAGSPSIEVLVLRKKGDDICFLPWQYGGKRISADNIPSEEETKEILKQKLRLSSIFSNEYNYKPVLKKLRDDTDQYFAQWQYAPKLREELVLLLDENLCAELNKHHLHYDSKTGLSSRKEDKKK

SEQ ID NO: 12236 - protein, 735 aa, Firmicutes bacterium CAG:124
MEYYAKSENLQGHQETVKEHLRKVSALAREYGEALGLADAAGLEGLVHDFGKYTKAFQDVWKGKRTGVDHAISGACFLECCYRGRPGSRPVIEAVNGHHAGLVAYDMIKAELHAIADDRKQAHGNAGKTPSIENAAQLKEANAAFQKDFPDFRLPKLPIPPADELESMLYTRLLFSCLVDADYTASAMNDDSTYLDRAEDCYFDPQALLETLYAYCGSIRQASTADKILNQYRDQVFEQCGKMGDKPEGLYTLTAPTGTGKTLALLHFALRHCLKHGKKRIIIVLPFLTLAEQNADTYAKIIPNVLVDHSQSDLPEEARELAARWSAPVIITTSVRFFEALFSDRPTVCRKLHNIAGSVVVFDEAQSLPASLTSATLRAVNALCSRYHTTMVFSTATQPDFAARKDLNWTPCEILPEHRKLFEALKRVNVEWRIGNETPLEAIAEEMAGCARVCAIVNLRRHARQIADVLSRLCPEDTVFFLTTDLCPAHRSRQIEIIRQRLKQKLPCRVVATQCIEAGVDLDFETLYRALAPLDSIIQAAGRCNRNGCGSMGQVIVFRPEDSRIPYPDDWYNNAAVTVQEMNPPFSIHDPENIREYYRRLFDGTVDKPELTKAIDARAFAETAAQYKLITSAGAQVIVPYAAERKLYEQIAEQLRTQGVTGALLKQAAPITLTCFAKNLALYAEQIPFARRGREQSAEQAAGSNVYLLCQQYEDLYSEQLGLHFPQEERFDSIF

SEQ ID NO: 12237 - protein, 778 aa, Clostridium sp. CAG:632
MTEEQEEQFYRLIKTKLAKSKGINGEKETIWEHTECLKKEAARLLRYGYISEEEYRLLDYAVEKHDYGKLNDQMQKRLRTGKTFDAEKEVRHNILSGLFVNPEDFDSWDDYIVVLYAVLYHHENYGDNRTQASVLADRNPIINKFKEEYSEYIYQPNMRTTRRIVRLTQTQGIDEDGESSYEDEYLYQRMAKMKGLLHKCDYSASAHIACEYKNDFLVEALEQLATAWKSGWNELQRFTQEHTNENLIVTAPTGSGKTEAGLLWAGDNKCFFVLPLRTAINAMYDRIRGGILHNESTDTRIALLHSEMQAYYLEKSTSEKGKSDEEEPEEELLTYVTRSKQMALPLTIATLDQIFRFTLKYYGYEYILATLSYSKLIIDEVQMYSPDLLAYLIYGIKMVIEYGGKVAVITATLPPFVKDKLYQVMGNDVAERDFSGIKADRHNVKVMDEPLTSEAIWDVWKKKAGEDSRKFLVICNSVKTAQRLYRELEELTQQENVRIHLLHSKFTGDDRKKKEREILEVGETGRKAHEIWIATSVVEASLDIDFDYLFTELLDLFSLFQRMGRVNRKGIKDIDEVNCYVYLQLQDSPLRCFQSQNPRYRFVDNDIYLLSKEAMETVDGILSETKKTNLINEYLSAEKLEKTGYVKQYEQTYRELEMLNIEEKSTGEMIRDIQTVDIIPAGVYNEHKDVIDTAEQKLRERDAGITEKLQAMEDIRRYVVPVPGYIVYGNKRRSEAVERYIRIRRNVEIPVVACEYSSEIGFEKIYKKETERQGSHII

SEQ ID NO: 12238 - protein, 776 aa, Brachyspira sp. CAG:700
MINKDYFLAKSNKIKNGEFITQTIEEHTNKLIELFNKFKDVYGNYFEEHELELIKIACETHDLGKMNSRFQKKLYNSINREKYFDTNKELNALYEQLNITEIPHGVLSCSFLDIGKLKKEFDTVYIKALASAIYNHHERKVVDNNGIDLEDNKIKKIVESDLFKYYKLYNENLKCNFRGISNNEIKKGVDNDYEFWLKFIVIKGMLNKIDYAASAGLDTLELTPDDASKYVENAFKIKKEKDKNITFPNEVQEFMGKEENKDKNIIVVASTGIGKTEGALLWAGDSKTFYTLPIKVSINAIYKRIWDENYYDKNKFTFLHSDAKSIMRKDEEIDDYQLKYIETRHLIYPLTICTVDQLFYFVFKSLGTEKYAATLKYSKIIIDEIQSYTPDIISFLIFGFKVVNDLGGKFCIMTATLPPIVKYFLEETIGKENIKIAEKPFYKKDNEENIIIRHKIKYEEKDFEYNEILEKAKNNKVLIICNMVRRSQDVYIKLKEKNKQNTEINLLHSRFIFRDRKLKEEKIQEFASTKEEKRNNDAGIWISTQIVEASLDIDFDVLYTDMCSADSLLQRMGRCYRNRIYKENEPNIFIYDTKVGVGNGKNSVYDLELYNRAVDFIKEYDNKIFTEEDKQDYINKVYDIEKLKNIDNKDSYYNTIKKNIKDLEIFPIGGIDKGTAEEQFRNIQNITVIPRIFYKELNEKNIFQKYKEAFGEDKIDIIDEIMDYTLSAPLYFREYCIKEIKNKGLEHIFISNSKYDKELGLIKELDEKLEFENRCI

SEQ ID NO: 12239 - protein, 896 aa, Odoribacter sp. CAG:788
MELLSGCLNDNSYLAHICAGKKSESLKEHLEKVAEYACLLVKKHRLDGVVDRLVEDMAGEYSQKSRNWLKRMFAAVIVFHDTGKVNENFQRLRMMNRIFAVRKTEVLEPSYGHSFLGSWLFLAFILDGVWDDSQMTDEEKKCLFVYAFFFSYVIRQHHSAGLHCAGEEYFLNSFAGCYEEFRDYLTVWGYKADGQRIESVFKCIVGIQQETQKYRSSSFSLFSLLKLNSSLLTAADYLATHEYMNASAIDSLGIFEDRSRVEEMIGHLKNYKHNQEIYKNLNGFTFKYPVEKSGDHLNCLRTEMAVEVIQTIRAHPDDRLFYIEAPTGGGKTNLSMIAVTELMEKHSDIQKIFYVFPFTTLITQTYQTLQKALGLTSSELAELHSKAAFNVKKEENEDGIYGDKTQDYIDRLFALYPVCVLSHVKFFDMLKGNRKEMNYLFHRLANSVVVIDELQTYNPLLWDKMYYLIEQYARFFNVRFILMSATLPKIGKLNVPLTQKTEFVDLLPRAREYIVNPNFAGRVKFRFDLFQEKTDCVCLAEIVLEKSKEYALKNSLDGTVHTIIEFIYKKTASEFYRQIGDMASFFDEVLVLSGTVLEPRRREVINYLKNPANRKRNVLLITTQVVEAGVDIDMDLGFKNSSLLDSDEQLAGRVNRNARKSGCEVYLFRLDEAKVLYGKDERYKLVQKYITPEEYERMLIDKNFARLYELVFEKIDATNRETLVQNFHSEFLKSIERLDFADIDKGFQIIEQKNETIFVPLKIPVEIASKDKGIKERLISEMELDFLNNLGVVLKDGKLDGRDVWEIYEQFVSHSDQKSFNLDRKIHFKVLQRIMSWFTFSLIYQSKDLSELKCGFGEDRYGYFYLSHWDEDRGNGVVYDYNMGLNTNALKDIPFI

SEQ ID NO: 12240 - protein, 712 aa, Firmicutes bacterium CAG:646
MKYLAHKNGEREQTVKEHLTGTAQLAGTFAAKFGKEDWGYCSGMLHDIGKYSVEFQKKIQEECNIQVDHSTAGARVCREKGGLYPNLEYCIAGHHAGLPDYGSVQDQASEPTLCGRRKKKIKDYHAYQNEIEIPPLTSLPFDPMKTKNPHFAMSVFIRMLYSCLVDADFLDTERFMQEGKAERDSGETIEILLEKLEDYISSWLQNTELDTINGRRTEILKACLESGRRERGLFRLTVPTGGGKTVASLAFALRHAVEHHMDRVIYVIPYTSIIEQNAQVFRDILGEQNILENHCNVEYESEEELRSYQLAAENWDKPVVVTTNVQFFESLFGNKSSKCRKLHNIANSVIIFDEAQMLPNDYLKPCIAMIEELLKNYHSSIVLCTATQPALQDLFQNEWQAAELCPRMEEQFTFFKRTVFQNIGTIEQEELIEKLGGEHQALCIVNTKKRAQALYEQLQGEGVYHLSTSMYPKHRKSVLEIIRKRLHEKKKCIVISTSLVEAGVDLDFQSVYRQLSGVDSIIQAAGRCNRHGNRRAEESKVSIFQFQEKEYTPGQRQQMDVTRGLLVDEKELSDLGTIDEYFKRLYRFRGDSLDKKNIMGEFQNRGYNFAKVGKEFRLIEENTKTIFVGREEEAKKLIEKLHQEGFTKNGMRKAGQYCINVYGQDFDKLYGAGMVREVSENLQDFYELVNENQYTEELGLKLDLEYGIGCFM

SEQ ID NO: 12241 - protein, 1247 aa, Clostridium hathewayi CAG:224
MQGYYRFLNRCDITDGFREAKNGPFFVDKSLLIEEINKKISTKEKFVCVSRPRRFGKTMALEMLASYYTKEGAADSLFNNLKIKEIKTYKEHLNCHNVIYINFTDYFELGTVPEGIKNFTFNLLEDMKNKYSEIPSDDENLISVFDKIRQLYGDKFIFLIDEWDCVFRFHKGEKREQALFLSFLKHFFKDRNYVELVYMTGILPIKKYNTGSALNMFKEYTILNPGLTAPYFGFTDQEVTLLCENTAMDKIELGEWYGGYLLSGVGKMYNPCSVKDALEGKVCSDYWNNTGGYTELEEYITMDFDGLIESVANLFTGKSEAVGVLGFLNDWDSFRSKNEILTALIHMGYLTYSNGKVSIPNKEVRIEFSKTIKKMSWATVPKLLKQSKDLLNAVLNQEEAKVAHMLEVVHDGMQEFKEYNNENTLKCVIHLAFYAALEDYDLNFEEKTGKGYADCIMYPKRLGNPGIILELKYNGTLEEAIDQIKDMDYSSALRNKVNRVYLVGINYKKDKKKHECRIEIMDFFKDTYKKGCDNEYLAHISSDKMREQTIVAHCHGTAHLAGDFASSFSCKEWGYGCGLVHDIGKYSEKFQKRLHGGSITDHATAGAQELYKRKNIYAAYCISGHHSGLLNGGTHADCAGEATFMGRMKKGLEDYHAYKKEIEIPDFPVPPLQPLGEFGFTASFFIRMLFSCLVDADYLDTEGFMAENPVPRGAYDTMSSLFQRVQDYIMPWLTNTDRNTVNGRRTEILKACLEKGKEPSGLFQLTVPTGGGKTVSSLAFALHHAIRHDKQHVIYVIPYTSIIEQNAAIFKDILGYENVLEDHCNVVFESEEELGRSQLAAENWDKPVIVTTNVQFFESLFSNKTSKCRKLHNIANSVIIFDEVQMLPVRYLQPCIRAITELIVNYRCSAVLCTATQPSLQPFFPGTMKCEEICPDVKGQYEFFRRTDIQEIGKISEEQLVALLKQETQVLCILNSRRQVQKIYEAVKEEGTYHLSTLMYPEHRKRLLREIRERLKEGKTCRLIATSLVEAGVDFDFQMVYRELAGIDSVIQAAGRCNREGKRRKDDCQTLVFTLEKSADIYLPPELKQPIVAAEQIAAKYNDIASLEAIQEYFKRLYYYKGEKGLDVKGIVEQLEKGGRSLLIPFADVADEFSLIEEGNTKTILIDQEIKAQEIVQRIRRGEHSRQLVREAGHYCIHIFEKDFENLNGAGKLEALDLKFYRLRNLEKYTDEMGLILNTERGEAVFL

SEQ ID NO: 12242 - protein, 808 aa, Clostridium hathewayi CAG:224
METYIAHKIKETNQIQTVEEHCESTARLMKEKCPLEELIPIAWLTGFLHDRGKVSDQFQKYILAAVEGSMEVHRGEVNHSSAGGRIIEAMLPKTLASKIIQEAIYSHHGLRDCLSPRDGRLIFEWSDDKAEIKQAVERFFNRYDKVKLEKQCKEAVDAVAEIKNKIVEFDRAAGGHSIYGSREYFLGMYERLLISLLVEGDRTDTASFMQEKNIENIPDNNEMKLLWDECVLHLEEHLSGLKVINKVDEARRAISEQCLEAAAKPSVLYRLTVPTGGGKTFSSLRFALQYARRYKKRHIIYVAPYNSILEQNAEDIKMALGRNDIVLEHHSNVIYEEKADEERYTLLTENWESPVVCTTAVQFLNTLFSSGLRNIRRMYSICNSVILFDEIQALPVKTIELFNQAINFLTVFGKSAVVLCSATQPLLDCLGVNCLCPPTNMIEEQLSETYAGVFRRTTLIDCTDTSGAGFDAEELSDFAGQIFEKERQILIIVNTKNCARTAYERLKERYGSRCQVVHLSTNMCAENRNIILKKVKNALNEGQEIICVSTQLIEAGVNISFKAVIRSLAGLDSVIQAAGRCNRHGETDNGNVYIVKMSSEVENISRLTDIKEAQAAMQEVLFQYRKNPESIGGSLTSKQAMELYYQRYFYQRKGEMKYNVNVDGIGTGEEGADLVNLLSVNRIGMVEYHKNSGRQLQNRLMNQAFKTAGDLFEVIPEDGKIDVVVEYYEEARRIIDSLNNPYLTVTEQKILFRKLQRFTVGISETMRRKIGNAIYPACNGKIFVLNRDYYSKETGVSDTPCSMIDMIF

SEQ ID NO: 12243 - protein, 725 aa, Roseburia sp. CAG:18
MVCYGKVHQGYEYPILQFAVITDTDIFGEEKKKKKRHRTYEGEKIQQFTDLSVGDYVVHENHGLGIYKGIEKIEVDRKVKDYIKIEYAGGSNLYILATQLDQIQKYAGKDARKPKLNKLGSQEWTKTKGKVRGAVRQIAQDLVKLYAEREEQNGYMYGPDTVWQREFEELFPFEETEDQVLAIDATKRDMESHKIMDRLICGDVGYGKTEIAIRAAFKAVQENKQVAYLAPTTILAQQIYNTFSQRMKDFPVRVDLLCRFRTAAQQKKTISDLKKGQVDIIVGTHRILSKDVQFKDLGLLVVDEEQRFGVAHKEKIKQLKTNVDVLTLTATPIPRTLHMSLIGIRDMSVLEEPPMDRVPIQTYVMEYNEELVREAITRELARGGQVYYVYNKVRDIDEVTSRIQELVPEANVAFAHGQMRENQLEDIMYRFINGDIDVLVSTTIIETGLDISNVNTMIIHDADNMGLSQLYQLRGRVGRSNRTAYAFLMYRRNKMLKEVAEKRLAAIREYSDLGSGFKIAMRDLEIRGAGNLLGAEQSGHMEAVGYDLYCKMLHEAVKEARGEAPAEQFETSVDIRTDAFIPSTYIANESQKLDMYKRIAGIETDEEAEEMLEELIDRFGEPPKSVQNLLTIARLKAVAHSVYIKEIVQREDLLKILMYEKAKIHAEHIPGLVKAFAPSLKFAADPKGPYFTYRLGANSREKNREILEVLRQLLEQMHVFLCAEP

SEQ ID NO: 12244 - protein, 896 aa, Odoribacter laneus CAG:561
MESLFGNLKNDSYLAHICPEKLPETLKEHTEKVVERACWLIGQHGLEKVIDRLIVEIAGKGAEGMQEELKRMFAAVFVFHDTGKVNDNFQCQRMLNPLFKRRKTEMLEPPYGHSFLGAWLFLSFMLDRVWKETGLTEKEKKCLFVYAFLFSYVIRQHHSSGLGYANEEAFLESFTGCYEELQMYLTVWGFEGDWTYIETVFKYITGIRKETEKMRKISFALYALIKLNSSLLTAADYLATHEYMNGYGVKNAGIFQDRRRVEEVISHLRGYKHNRAIYEHLEEFVFSQPQERSSDHLNRLRTEMAVEVIQTIRKHADEWLFYIEAPTGGGKTNLSMLALTELMAVHPEIQKVFYVFPYTTLVTQTYQALRAALGLNSSELAELHSKAAFKEDEEEKEDGLYGGKQQDYIDRLFALFPVCVLSHVKFFDMLKSNRKEANYLFHRLANSVVVIDELQSYNPLLWDKMYYLIEHYARLFQLRFILMSATLPKIGKLHIPLKEKTGFVDLLPRAKSYMQNPNFAQRVEFRFDLFQEETEIGRLADFVLEKSEEYRQRNTTNGTVHTIIEFIYKKSASEFYAWLQERGMIFDEVLILSGTILEPRRREIINYLKNPLSREKNILLITTQVVEAGVDIDMDLGFKNISLIDSDEQLAGRVNRNAWKIGCEVYLFRLDEACVLYGRDKRYQIVREQITAEEYKRILREKDFGRLYELVFEVIDSMNEEVYIQNFHSTFLKYVECLDYQQVDRNFRIIEQQNEIVFVPLCVPIEVDSPEWGMKEKLLSGKELEFLKAYGVIPRIGMLDGKEVWEVYECLVQSRSGGKFDLNGQVDFKMMQRILSCFTFSLICYSKELQELKCGMGEEKLGYFYLSHWEQKGLNGQLYDYKMGLNSRALKDIAFI

SEQ ID NO: 12245 - protein, 318 aa, Firmicutes bacterium CAG:631
MTYDLTKTQQKAAQEILSFIKQGKSVLVDAVCGAGKTEIVYTTIEYFLNQGKKIGFTIPRKDVVIELYHRLKKDYPQVDVIAVYGNHTQKLEGQIIVLTTYQLYRYHQHFDLLILDEADAFPFYNRLFLKRSCKGPIIYLSATFNTWYLKKIPQQVQVHRRFHNVDLPIPKIILTLPFLQNKYLIQSLKKFKAIKKQVLIFVPTIFIGKVLAKKLTIPFVYAGLSSKQQIVDDFKNKQFSFLLTTTILERGITIDDVQVIVYQAEHYLFDLKTLVQICGRVGRKKAHPNGEIIFICSQKTLAIKSCLKTLKSKNNTIV

SEQ ID NO: 12246 - protein, 752 aa, Fusobacterium sp. CAG:649
MLNEEIFKMEDKYNISGVLGSDHSLLSASMFIAYYFGKITDLIEIVETKKIVILFEILFALSYVISKHHGNLDSFEEYIEKLSRNNDENILKELKNISVSNGGILLQAFLEKETITIFFNFIETYISERKKKENISSHEAMSIFVFTKMMFSLLVASDYYSTNEFMQEIKYENFGNMGNIDTIKKEYENSEIIKSIRDKEKNGIPNDEDINNFRTKIFLEAEKNLEKNKENNIFFLEAPTGSGKSNTALNLSLKLLDKDRRKIFYVYPFNTLVEQNMNTLKNIFGNNEEAIKNITVVNSITALTNKNSRDIPIEEYSDILMDRQFLNYPFIVTTHVGIFNTLIGNTKEDCMPFYQLTNSVIVFDEIQAYKNTIWTEIIKILNPYAKLLNIKIIIMSATLPNLSYLLDEEEKNNISKLIKNRDEYFNNTIFKNRVEVNYDLLSEQKIEYEELLQHIIENSLNSQKILIEFISKNDAKKFYEFCENNEDLNVDHEILILTGEDNKARRNSIIKKINSKDKKIILISTQLIEAGVDIDVDVGYKNISGLDNEEQFLGRINRSCKKSGKAYFFYLTDAKKVYKNSIIIENKLNLFSDEMRDVLENKNFDVFYSKVLEILKRKAKEKINNDNFETIIFNKKFRLLKERMQLIEEQDDKKTYFFNRTLTDEEIEEIGENIDGSEVWERYVDILKEENYAKKIVELSKIREKMMYFLYEVKKNTELNYSDIKGSIIYIDDGDKYFTDGIYTGGEGDIFI

SEQ ID NO: 12247 - protein, 757 aa, Clostridium bartlettii CAG:1329
MSYSYKLKSHPTQSLYDHLTGVRDIALKTHKHHTIKPEIDDFIEIVCMCHDFGKGTTYFQRYLENDFRGIEKDHGSISAMFTYWMLPDKWKHLGFLIVKKHHGDINNASDECRIDEVSWDFKNQIKDILDNTIDELNQIYDKYLEGKNIEAFLNWLDDESNLKSIKKEFRKKKYNIEDLLLCEYVYSLLLTGDKSQLIRNDAYIPDKQYPLSFIENYKTDLVKNALIKNPKLKESDVFNLRNEIYDDMINKLDSIDFDKENVFSINVPTGTGKTILAYSAAFYICSKITKNNSNIRPHIIYSLPFTSVIDQNYEVLKEIVEKNINKEISSEDLMKFHSVVPIEYKDFKGYDARFCFENWQSKIISTTFVQLLNTIFKIGKNSIVNRFHRLANSVIILDEVQAIDDKYYKIISEFISIMARQYNCYIILVTATMPMLLDTIDLIEDKEKYFRKLNRIEIINNSESEITLDEFEDIVLEDIRENKDKSFLIVLNTVKSSKNIYKYLKENTDRDIIYLSTEIYPKLRLEKINKIKNSDKKYVVVSTQLIEAGVDIDMDIVYRDFSTLDSINQTAGRANRNGVGGKGIVKLYKIVDNDRRICNYIYPRYLLNATEEVLDGKYIIEEKDIYDCNKEYFLKVKNRLSNDTSDELLDLIPKLQFKKFRDKFELIENDEFRRVDIIVNADNITNSIIQQLENDNEIDNIDLKNKFRILRQYTVSVSRKEMSEINDIDIIKYNIKYINKEDYSEEEGIIRQKQVIW

SEQ ID NO: 12248 - protein, 682 aa, Clostridium bartlettii CAG:1329
MRKFLQKIFKTENINLTEVQEKINKCNLNKNQLILSSCGSGKTEASFYIGSIWNKRLLYVYPMKTLASSIHKRLNHYENILKSNELWTIQHSSAMEDKFLNSKKCITTIDQVLAGYLGIGVQSFIKGKNVVCSNFIFDEIQLFEPDKTLKTTICMLDELVKRGNKFVIMTATMPEVLINFLKDRYDMEVTITDKPSVENRCVKLKYIKSINFDEIESFQNKQIIICNSQQEQEDIQNNIKDKDRIIFLNSKLLREDREIVEKQVFEFFGKDSKENNKILITTQIVEAGMDISASRMYSSLCPIDNLVQRDGRVCRWGGNGEIIVFEGVYSIYDKKVCELTLEYIKSNDEIVFSWDIQKQWINEILNAFYKEHLGNLNSFKTDTLKKGSRNNLIRDIKNVNVIVSKTFEKEDFNRQSISIPREILNKLSKNNKFYILKRSKVKSVTNKEINDNDTVVIQGQDAIYDEIGFRYKEGFISREFPFDIKMKTNQIFSDYIKEEWITHALMTKEIMKEKLIKSEFKNYTEEEIEEYSTLGGLHDLGKLNRNWQKFIRMTDKPLAHNVYEKRNSLLIQDQRHEIISALSLDDIKGKKLKFNLLINHHGRKMIGLQMITVSKYRLVKGAENLIREVGYNGKITKSQEMIDVSCEEFITPADKEWVEFVYLEGILMESDIEAINRNIEKK

SEQ ID NO: 12249 - protein, 713 aa, Prevotella sp. CAG:5226
MNIHQEILAKGERNGRICLFQHLKNVADIAAVVANHAGLDEHIAIEGALLHDIGKVSPLFQKSLAPSYKKKPCSVFRHEIASLFFLSLIKEAHRNAVIDMVVAHHKSMYKDVRELGILDLDDNTNCFEEHSKGFEEWSPIALEILESLGLKTHKISIDEAEDNYEYVVDYCCNRKSDCSKWRGLLMASDHMASAMETESEMPLNKLFIKPDLSFYNRQSQLYPLSMISAESKKKHTLVTAPTGAGKTDFLLRRCQGRVFYTLPFQASINAMYDRIKADLSDTNAQVYLQHAASNLKVKGGKVEESIMQRHVGASVKILTPHQMASIAFGIKGYEAMAMDLRGCDVILDEIHTYSDAIQSIVLRIIEILIALDCRVHVGTATMPTELYKRILELLGGLSEVYEVKLAPNTLASFNRHQIYKLAGREDAFGVISSAVKKHSKLLIVCNQVKRAQEFYEEIDELYPDIRKMLIHSRYKRNDRARLETDLRTDFNILEDTPCIVVSTQVVEVSLDISFDVMVTECAPIDALVQRFGRINRKRSLETIGHYKPIYVISPPENEKEALPYSLDVLKGTFEVLPDNGQVMEEEHIQEMIDKVYPKVMFQNIDYTGVAFLHGKWQLKALCHQARSALLETLDINSAVCITEKDKERYLQGTGMERAEMEIPVSYHSIAHRNLDQLNVGTRPFVIPDKGYDHEKGLLPDYCKTEYYQTFEIL

SEQ ID NO: 12250 - protein, 712 aa, Clostridium sp. CAG:138
MLLAHGATDEHPEGQSIEAHLKGTGELAETFAAEFGAAANGKLCGLAHDIGKYSDEFQLRLRGGKKVDHATAGAIECFKIKAAFEAVCVIGHHSGLPNVGHKDADTTESQTFFGRKLRAEQGGIPDYRKNWNGHIALPQDYFRPSGRGFATAFYIRMLYSCLVDADYIDTETFMNGDAGRGNYEPLSALCDKLTAYISKWNNPTREIDILRQKILNSCIEKASAPRGIFSLTVPTGGGKTVASMAFALNHAVANSMKRIIYVIPYTSIIEQNAKVFRDILGQENVVEHHSQVSHELSEDADELEYRSALATENWDAPVIVTTAVQFFESLYANRSSKCRKLHNIANSVIIFDEAQMIPSNNLRPCVAAIAELVRAYNATAVLCTATQPAIDEMLLEYSKKESVVELCPDVDGMFEKFRRTSFEKEGRLTTDELVSRLESQQQVLCIVNTRKFAQEVYEALPSEGRFHLSTLMCPVHRKQKLDEIRERLKSGKTCRVVSTSLIEAGVDVDFPRVFREMAGLDSILQAAGRCNREGKRSAESSIVTVFESENKVNKLIAVNRDAAEETVRDWTQPNTTSTIERYFKAYRDFLRNDDKSGVMTASEKGISGCGLPFEWIAKEFKLIDQNTFTVYISVGEGKELISRLREGERSRELYRKAGMYSVSIYENHFNALINAGAAEPFGDDAAILTDLSLYSDEKGLATDVSDGSALFN

SEQ ID NO: 12251 - protein, 725 aa, Firmicutes bacterium CAG:56
MGEIYIAHRNEYTNEVQTVREHCENTANLCKEYAIPEMEDLAYAAGKAHDIGKYQEGFQRRIRGENIRVEHSTCGAIAVGEKYPKPMNLMMQYCIAGHHTGIPNGGFGNDEDNSLKGRMNRTFEDYDAYKQELELPELDIRKWQQFLAADCGRNADWLIDKFTFLTRYLFSCLVDADSTDTAEFCRSTEVVRKLQADFEKCLEKINVQLQAFEVKTELQKTRSLLQEQAYRNSTKDAHIYLINMPTGSGKTLASAKIALQRAIAKKKKRIIYVIPYNSIIDQTAEVFEKLFGNNLEILRHQSTFSYDEKVDLNEDYREAAKIAVENWDAPFIITTAVQFFESIYSNKRGKLRKLHNMADSILIFDEAHMMPQDYLQPCLQGIAYITKYLNSEAVFLTATMPDFEKLLKLYAPANNRIENLIKDKTLFEKFQKCQYINMGKVSPEGLLAKSEKYPSRLIIVNKKKNARQLFQMCTGRKYHLSTYMTAYDRQKVLQAIREELKSLDEDFPDGNIPEERRITIISTSLIEAGVDLDVYTVFRELNGLDSILQSGGRCNREGKRDKGEVFVFEFENEAQNDKMNITQRLLAEYKDISQPECIEEYYEEVFFLKQENIQKNTMHIKCRSFENLPFQTYAEQFELIPDRTCSIVVPRDEKSRKLVDTLRYTKIENEKELQKYTCTVTKKELDELIKQHVADDFGTGIYCLTNEDYYDENLGILLEAQDYFL

SEQ ID NO: 12252 - protein, 736 aa, Ruminococcus sp. CAG:579
MENELYAHISEDGRKQTLKEHLENVSIMAEDFCIPMLKPMARRSGELHDIGKAAEDFQQRLYGSKKSFCHAACGAIEYQKLSDFEDIIAWLMEYCIASHHTGLLDGQGSGQELATLKNMLGKKYSGSADYSRYKEIVSEVLLSAEEQKAALEELESCGEDNTEMMERFAFFVREVFSCLTDADFLDTEKFFYPNTERGLTGDMEKALEKLNGRFTEFTQTTELQKARGRIQRQAFKNAAETNENIMLLDMPTGSGKTLTAAKIALTSGKKRVIYVIPQISIIEQTADSMEQIFQETMPVLQHHSNYSYEPKRGADKADEEKAERLLIKTTENWDAPFIVTTSVQFFNSLCHYKSSALRKLHNLRDSILIFDEIHLIPTELLRPCLKAIGYITKYMNSKALFLSATMPDYSAIFKKYMPDVKFAELITDKSDFGYFKKCRYNDLGKSSYSAVAELAQSKPNALIVVNKKDTAVEIYRKLGGEKYHLSAFMTPAHRSSVIAKIHERLNDGAHITVVSTSLIEAGVDLDFKCVFREMAGLDSILQSGGRCNREGKYDKGDVYIFKTDEKANPAFDRLVHFTETAVKNTNTSMENIDSEACVKEYYRLKYGFSEEEMDINSIEKFSIAANECNGHTANYEDSLPFRSYAEHFQYIESDTTAIIIETPESRKLIELLKSGGKSIRRKLQRHSVSVYRYQFETLLKEGVLSEVSGFYLLNTPERYDAETGLIVSAEGEAYFG

SEQ ID NO: 12253 - protein, 787 aa, Ruminococcus sp. CAG:563
MFLAHITDFGQQSLQEHCQNSANIAKNDLTDIGLSNTAYLAALFHDCGKAHDVFQQYLIDSYNGKNVKRGSVIHSFAGVSYFLNKYHDSDNVIEKAASEIIAYSIGAHHGLFDVINPDAKDGFLYRLTRQLEYDDTAIHNFLKEIVDESIVSEVFGSSSNEMERILKIIPNITKKNSGSEYCFYLGLLCRLITSAVMDGDRTDTANFTLNKDYNNAKTSYNPWKEINDNIERRIHSFSSETLINKSRRELSDLCFDFAKSDSGIYRLNIPTGGGKTLSALRFAAAHALQKEKQKVIYIAPLISILEQNANEIRVSVGAEYVLEHHSDVITETDDVEELDLRKYLEDSWNSPVIATTFAQFLNTLFSSKTSSVRRFQSLCNSVIIIDEIQSVPSKMISLFNQAVNFLSRICKCTVLLCSATQPCLESVEHRMIIDGDIISKDDFNKYSEIFKRNSVMDAGNFRLEEIPSFIIDKANNHLSLLVVCNKKAQAEFLFNEIKSQAQNCFHISAGMCVAHRKNVLKKIKELLSKKEPVFCVSTQVIEAGVDISFDCAIRFSAGMDNIIQTAGRCNRNGECRSDSPVYIIHCIDENLKMLPDIQAAKQATEALIVDFKKRSDYYSNDLASDNSINFFYKYLYSNYSSNHFDYPIKNMPSLFELLSANNQYRSLSKSAQYFLCQSFKTAGDKFDVFDSVSTSVIVPYGDGKNIINNLQSYYNDKDYPALQKEMKKASQYSVSVFEYQFKKLLEEKAIIPFCDNSFYMLSPEYYDDNTGLLNKAKEENTCSTLIL

SEQ ID NO: 12254 - protein, 896 aa, Odoribacter splanchnicus CAG:14
MELLFGRLKNDSYLAHICPGKSAESLQEHTAKVVERACWLIGKHGLEKVVDRLIPGIAGKYSENVQEELKRMFMAVFVFHDTGKVNDNFQYSRMLNRLFKHRKTEILVPAYGHSFLSAWLFLAFELDRVWQDPCLTEEEKKMLFVYAFFFAYVIRQHHSGGLGCADEEEFFNSFAGGYEELHTYLTVWGYEGDFTCVEAVFEHIVAIRKETDAQREASFALYALIKLNSSVLAAADYLATHAYMTGRQVKEAGIFEDRHRVEEMIGHLRNYKHNRGIYEQLDKFVFEYPQEKSGDHLNRLRTGMAVEVIRTVREHSDDRLFYIEAPTGGGKTNLSMLAVTELMAVHPEIQKVFYVFPYTTLITQTNQTLKNALGLTSTELAELHSKAGFNEKTEEREDGLYADKKQDYIDRLFALFPVCVMSHVKFFDMLKTNRKEANYLLHRLANAVVVIDELQTYNPLLWDKMYYLIEHYARFFQVRFILMSATLPKIGKLRIPLKERTGFVDLLPQAKSYMQNPNFAGRVEFRFELFQEEIDMNDLADFVLGKSVEYRDKPGKNGTVHTIIEFITKKSAAEFYAFIQEKEPFFDEVFLLSGTILEPRRREIINELKNPLSRKKNILLITTQVVEAGVDIDMDLGFKNISLIDSDEQLAGRVNRNACKVGCEVYLFRLDNASVLYGKDKRYQMVREQISVGEYERILREKDFGCLYELVFEKINWMNEQTYVQNFRSGFLRFVEGLDFQQVDRNFQVIEQQNETVFVPIPLPVEVDSMTEGVKERLFSDRELQFLEDFGVVPCEGLLDGKEVWEVYERLVYRDHPAKFDLEEKVGFKIMQRILSCFTFSLVGYSKELQELKGGTGEEKLGYFYLSHWEDEGVNGKLYDYKMGLNNRALKDITFI

SEQ ID NO: 12255 - protein, 770 aa, Clostridium sp. CAG:221
MCTSFKLKSHIYENKSSQLLVDHLRGVAKIAKETSQLNGIDDKEIMNVIEILCLCHDFGKASSYFQKYLEGKYNGELKKHGEISAYFTYYMLPERWKLIGFICVKRHHGNIDIENNSFFATENKEALKEISKDIKNNIEELKLIYKCDLEEFFSKMNDGSLIKEVKLAFVKRTTTMKRKTIKEQQQEFMWLQYLWSLLLTGDKTQLITGKTFKNIQGLSERFTLNYKNKIRKSLIERIPDIEKSPLFNIREEIYDSAISSINSLDIEKDRKLSINVPTGTGKTISVYGAAFRLSERLIEEKGIVPNIIYNIPFMSVIDQNYDVLEEILTANEVDTSTDLILKHHSMSPIEYTDHEEKEYKNYDARFLVENWQSTVITTTFVQLFNSIFKSGVNSIMHRFNKLAGSIIILDEVQAVPTKYYPIIEDLFNILCDDFNCYIITVTATKPLFLEGKELVINNHIIFKEMNRIIFENNTHKSLYLNDFKKVVLDDIKHNNDKSILVILNTVKSTLDVFDYLKAKLGESRKIIYLSTEIIPKVRLEIIKEIKDSKDKYILISTQLIEAGVDLDFDIVYRDIAPMDCINQSAGRANRNGVKGTGIVKLYKLMDDNNKIFASFVYSNSLLRATLTILKDKRVIEENELLEINNAYFAKVKEVTGNRSLEEYKTYCEYIRNLRLQDIRKFELIEENKNKIDVIIRYNDEVEKYINIIENSKDYSEQDVINGWRGLNKYKISVNRDVVKDMVYEIKGSNFINGSDYNKNRGIIRRSSVII

SEQ ID NO: 12256 - protein, 729 aa, Oscillibacter sp. CAG:241
MEAFLAHSSRDGCPPQTYEAHIRGVYAKASAYVAGVEQYTAKAKDILTEIVQKSALMHDLGKLDDENQNVLHSSDRGKRHLPINHVDAGSAALKSQDSQDSLYAALMVYSHHRGLPDLETESLREEAIFRDEHAEVRKRTDETLDELLRRHEMIFRSQAVKETQPYDGDQNVLFRMALSCLADADHSDTALAYGQAPTGKKMPLLRAEERLTALDKYVSQLGGGDERSLLRSEMYQACRNAKINSGFSMCDSPVGSGKTTAVMAHLLQQASQRNSRRIFVVLPYTSIIQQSVDIYRKALVLPEENPEEVVAELHSRADFQDFDTRYLTSLWRAPIIVTTAVAFFETLSSCQPSALRRLHELPGSVIFVDEAHNALPIKLLPLVWRWLNVLADEWSCYWVLASGSLVRYWELDRLKEIGMAQPKVTELVRYDLRNQLMAYEQNRIAFLNKESPVSRRDLIEWVANSPGPRLLILNTVQSAAVIASDMAQKYGRGCVEHLSTALTPEDRSKTIKRIKQRLKDTSDRDWTLVATSCVEAGVDFSFRTGFREMSSLLSLLQAAGRVNRHGQLKDAEMWSFSLQDDSMLSQNKSLECSADVLKDYFARKIPITPELSTRSMHDEIIRDDSCIKTIKQLMEQENVMQFRTVDREFEVIDADTIPAVVNLSLAEEIAHGRSDWKTLQRQSVSIRRDKIKRWNLKEIAPGVYRWTLGYNDFLGYMSGVINTGKAIFC

SEQ ID NO: 12257 - protein, 725 aa, Oscillibacter sp. CAG:241
MDLQYYAHVRENANGRKEYQTVAQHLTGTAELCREFAAAFGAEADGELAGLSHDIGKCTDAFQDHLLNDGPTVDHATAGAMACAMRGNRYASACVAGHHGGLPDFGNMRTARKADGTFYGRMLKGREERYLERCGESGATLPPPTVLATQGLDPLQASFWTRMLYSCLVDADFLDTERFMNGERGRGGYDDIPTLLARLQAYIKPWQQPRTELNRLRCEILNTCIEAGSKPKGVYTLTVPTGGGKTVASLAFALRHAAEHGMQRVIYVIPYTSIIDQNARVFRDILGSGNVLEHHSGVQFDLSDGAPPEAVRKALATENWDMPVVVTTAVQFFESMYAARSSRCRKLHNLANSVIIFDEAQMLPLAHLRPCVAAMASLAEQFCSTVVLCTATQPSLDDLLRTYAPDCPVTELCPQTAALYGRFRRVTFQHSATMTDEVLAERLSEQRQVLCIVNSLKAAQSIYALLPQEGSYHLSTLMVPAQRQVLLDKIKERLRRGEPCRVVSTSLIEAGVDVDFPAVYRELAGLDSVMQAAGRCNREGKRPADESFVTIFERTELPPQLFQAAVGAAREALKEDRDPAAPETMTRYFRSLRDLSGDALDRQGVIEAFTQGIGGCEFPFRTVAEKFRLIDRNTYTIYIPYGEGTALLRRLQDGECSRDLYRKLGRYAVSVYDKHYRALYNAGALLTAREVPVLDEDSAILTDLTLYSETMGLSLEPETGKAEFI

SEQ ID NO: 12258 - protein, 686 aa, Megamonas funiformis CAG:377
MKEFKDNISFNKDDFFVKLKQTINDSEDYLNKIEFANIDFQDIIHKLSKISINEDEVNKKTIQQGIYLSIYIRWIYSLLVASDYYATSEFMNEADFSENTDLNDIDKWDSVYENTDLLKNIRQYQQETYLISDKELNTVTDINILRSEIFCEVEEKIKTNADENIFYLEAPTGSGKSNTAINASFKLMQHDERLQKIFYIYPFNTLVEQNLETLEKVFADNEDIKQNIAVINSITPIKVLKNDLNAREEKNVYQKALLDRQFLNYPMILSTHVSLFNIIFGNRQSDVFAFYQLSNSVIVLDEIQSYKNKIWSEIICYLKELAKMFNIKIIIMSATLPDLDILSRFQAQAVDLLENSSRFFAVDCFKNRVKLNYDLLKIDKDNILDELKIHLKQYLKSDKKILIEFIKKKTAHDFWVDLQENEDFKDIQIEYLSGDDSIAERKRILDKVKKATDTIILVSTQVIEAGVDIDMDIGYKNISKLDSEEQFLGRINRSCKKEGIAYFFEVDEASNIYKDDVRLSESIVLKDVNMQKVLELKLFDEYYKKVLETTKGKYGYHFDEFIKDISDLNYESISTHMKLIDDTQDMVQIYLIRTLYVDGEFLDGKQIWDSYVDLWENGRKTMSYAEWKIELSRITSKMNNFIYQVSKHNLHIGKFYEQMGNIICLEDGDKYFTKDKFNREILYIKN

SEQ ID NO: 12259 - protein, 714 aa, Firmicutes bacterium CAG:41
MEYIGHTSEDGRKQLLLDHLNGTSKLCRENANEFWADIAEFVGQIHDIGKYTSGFQKRINGAENIRVEHAICGAKEVAKAPPKSYVPMIEYCVAGHHSGLPDGGTKVDSEEDSTLHGRMKRKTGDYSAYENEVKLEYPKDNLRELFDVSNQREIIERYSFFTRYLFSCLTDADFIDTERFVTPNTDRGIDGDFQKAYEKVCEKLNSFKIETKLQESRSIIQEQVYKSVESNANVYTLNMPTGSGKTLCSIRAALKTAIENEKKRIIYVIPYVSIIEQTAKVFEDIFGDVIPVLQHHSNYDFDDDKNEDENEITSEKLKRSCENWDAKLIVTTNIQFFESLYHYKGRRLRKLHNLADSVIIFDEIHMLPIDYIQPCLRAIGYVTKYLNSTAILMSATMPNYDKFMERYMSGVKIENAVKDTSLFNVFDKCRYEYIGKCELASLAEKAQEYDNALIIVNKRKTARELYDICSGNKYHLSTYMTPLHRSEIIAKIKEDIKNGINTTVISTSLIEAGVDLDFKAVFREIAGIDNILQSGGRCNREGKMDMGDVFVFETDGGKGEIQLKSNITRNLFEEFDNISTDKCIEEYYSRLFAFNDGNIDKSTITSLMGENLKFDEIPFRTYAENFKFIKNQVIGIVIPRDENKDLIEQLRYGKLSVKRKLQQYSASVHIWELEEMIKEGIIEQLDCGVCILANMDYYKSDVGLTLENDVDYFV

SEQ ID NO: 12260 - protein, 757 aa, Bacteroides sp. CAG:443
MNIEDIKKVRAKSDGTTLYEHTYMVIETGLKLLQSLSLSDVAQAFLKQNFLPAAILHDLGKVHPTFQKRLNGDKYASIRHELVSVWFAETFLEVNDAVLFAVGTHHKSVVSDFCERSLDMQDLNDISISVDEGAYLPFSEGTMCLETLQSWLSLFSEEFVYRQKELEKIPSTFCYMFRKSKQVKAVPYLEDRQHFSLLRAFLQAADHLASGGRVEIPDYQLISLDDFQPHDKFTKFPFRHFQEKLQRWKGDAILHAPTGSGKTEAALSWVYANQSEGNRLFYLLPYTASINAMVKRLCDVYDRSEVMVQHSKSLNFIYNELCEESSNVNPDYRELEQKARSLNSLSREVYYPVKIMTLHQLLRIPCHGKGWEFSMLECQNALFVVDEFHAYNAFLTGKMLGTVKIFRNIFGAKFLFMSATIPDFLLKEIVEQIYGGDYSRIVRPDSTFSSDACVMGRKRHHLICHAQENVGQYIGQIEADLNSGMSVLVVVNNVRTCQQIYQEIDFDDSKKMMLHGGFNQRSRREIERFVTHTDRSKRPQLLVATQAVEVSLDIDYDTAYIENAPIDSLIQRLGRVNRAGKLVDASDHKKMADVHLFEGIIGKTPFYDEQLLRDTWAVMSELDGKDLSEDDLIRACNEVYKDGYSAQQRKDFEQGLNSVSDFEKKWIAGICEDWADEILDQNNQKVDVLCYNLKEEYCGLVEQKRYIEANELLVSVYPYHLDRKKHLKDIDVWIAEELFYDEKQGCIERKPDCYEII

SEQ ID NO: 12261 - protein, 784 aa, Clostridium sp. CAG:413
MEYLAHIADDGREQTVGEHLRSAAEYASRALAPAGLCEAGYLCALLHDCGKYTELFDRYIHSNGEMRRGSVNHTFSGVRLIMERCHNEPPASTRDIFGELLAYAVGAHHGEFDIADEDGKNGFFHRTKKEDIGYEEAVSNYIELCADTEELDRRFKAACDEVTPIFDRITDIAADNSEVSFYVGMLSRLLLSAVIEGDRRDTAEFMSGVKRKDDEIPDWNELLDSVEKKILDLPANTPVNVARRNISEQCRLAAEAGSGVYRLNVPTGAGKTLSALRYALAHAAKNGMRRVIFTSPLLSILDQNAEVIRKFVGDDSLILEHHSNVICDSADGEALDKYELLAENWSAPIIITTMVQLLNTLFSDKTSCIRRFQALCGSVIVIDEVQTVPCKMLSLFNLAVNFLSQVCRATVLLCSATQPCLEQTKHPLIKQPADIVPYDKKLRDVFKRTDIIFDGSRTLDELAARLDNLLSVSDSLLIVCNLKKQAEFLFRYMKSNHGDCLVFHLSAGMCIAHRRAAIEKLRQALAACGDKKVICVSTQVIEAGVDISFGCVVRLAAGLDSVIQSAGRCNRNGELDSPAPVYLISCADENLAGLGDIKAQKDALNQLLTEYSLNPQAFDSDLASDNSVGRYYRALYAAMPDRAQDYPTKHGFTVYDLLADNDAFSGRCGENDLFAMRQAFKTAGSEFNVFDSNGVDVIVPYGGGAELISELMSPRAEHDITYLHSLCERAKPYTVSVYSHQQRMLEEAGGIYPAAGGAVRVLSAANYDSDVGVILEPDINSFIV

SEQ ID NO: 12262 - protein, 720 aa, Eubacterium sp. CAG:274
MDLDKYLAKGNKTIAQHINDLQHCLEVLVNLGYVETEHLKTLIYIACKYHDYGKVNPEFQKRVSSIKWIKFDKDIEIAHNVLSTFFINSDEFDDFNDYLKVFFAVAYHHNYCDVDEVFRKKRDLIYKLLENFEIYKVKNSVLSKLVKTKIMEERESILLKGFLHKCDYCASAECEVEFKNDFLDNSLEDLKNSWRVDNPNADWKEMQNYCYENSDENIIVVAQTGMGKTEGGLRWIGNHKGFFVLPLKTAINAMYDRIKEDILKNDVKEKLSILHSESLNYVIKKHPEIDDPKEYNDRGKKLSMPLTVTTMDQLFDFVFKYNGYEMKLTTFSYSKIVIDEIQMYGPELLAYLIRGIEMITEMGGKVAIITATLPPFIRDLLGDKFKYKEFIDDSVKRHNVKVINNEISAKDIVAKHCANTNDNKPNKILVICNTIRKAQAMYDEIVKKFKVDNVHIFHTRFTKKDRAEKENHIIKTGKNEGGENEIWITTSVVEASLDIDFDYLFTELQDLNSLFQRMGRCNRKGKKPIDETNCFVYTKIDSNLISNGSRGFIDRTMYNLSKEAISEVDGVISESDKLNLINTFFTTDKVRNSEFFEEYYKYYGRIKNMNAYVLDISEIEVRHIMSVDIIPKDLYYENEERYESIIKQIENEKDRVERIKLLEELSENVVSIPYYDFDRTKRCKDIKINDRHYYWVLDCKYDSKIGFKADRKIQNYATFW

SEQ ID NO: 12263 - protein, 768 aa, Faecalibacterium sp. CAG:82
MEAQLVSWTCNYYPKGEKAFWESGWDELFETALKDCGYDDPAELPDLTPPTEILLTGLLIMADWIASNTEYFPLIPVEELGNEVAYPERAELAWNKWDEKDLTAPWEAQTSIVDEEEFKVRFGFLPNAVQAAAVEAANSVSAPGILILEAQMGVGKTEAALAAAEILAARFGAGGIFFGLPTQATANGILGRLVQWADNQPDRLLKCIRLAHGMAELNEEYIRLQEQTVQVENDWDDSETNEHRVQVHQWFRGSKQALLASFVIGTVDQLLMAALKQKHVMLRHLGLAGKVVIIDECHAYDAYMNCYLDRALEWLGWYRVPVILLSATLPARRRAELVEAYQQKRTSAPDAPWKTSCGYPLLTWTDGEEVRQTTIPLDTPSRTVQTVPLTEDGLPGFLREKMQAGGCAGVIVNTVKKAQAVARMLREALPEKEVQVFHAQFLMPDRAAREQELMERIGKHSTPVRRDGLIVVGTQVLEQSLDIDFDVMVTELCPMDLLLQRIGRLHRHTWRCRPQPMQAAVCAVLDTGEDAFDEGSAAVYGKWLLWRTRELLPQTIRLPEEISPLVQQVYGWAAEDKLPEDAASEKLCHNYELEQGKRKDRAEAYLVHHPKVYKKFPRLNTLDGWMADEGACSDPAARAAVRDGDPSVEVLVMVQGRDGSIHFLPWQEGGRTVASDCPPQPEEALKIARQKLRLPAVFGKEWNVKRVIDELEADNRRLLAQWQLSPMLRGELVLLLDETLTAHLAGMTLHYDRENGLIYEKEETDAGN

SEQ ID NO: 12264 - protein, 855 aa, Anaerostipes sp. CAG:276
MYFDKAVVKIEDLIKQPERYFAHKPKKDDRKKETLKEHTNLAEAYFLRIFEEKKLGHCMEVFEEKYFDHLTWEAKNLFRSMIFGIVTFHDFGKVNPYFQKEKMGHEMPEAKKIFSNSHHSLISAVLYFEYFMEKVWALDKSDQKQLKEFLFLNSYLIAKHHSDLDTFEKYLKSFEDEDIYHLIEMLEDQDHLNFYKKPFQCSLKRERLGKAAGNLKKAARDRKSRTRQILFYAYERLAYSLLVASDHYAASEYMSGVQIRHFGGMEHMDEFCRQYYGTELYHGIRKYEQEKYLKEKDLRKEENMNIMRTELFLDAEQELKKHMDQNVFFVEAPTGSGKSNLAVNLSFQLMKQNSGIGKIFYVYPFNTLIEQNLESMEKIFGGSKVMEDIAVVNSMKPIPMDRAKRKTDELQYYQEALLNRQFLNYPMILTTHVSLFDTIFGRRKESTFGFHQLANSVLVLDEIQSYRNSIWTEIILFLKEFASFLNMKIIIMSATLPNLDVLSPELENAVPLIRNREKFYSHPVFKNRVRADYSLMKKEFTMEDLLDHVLEQQKLKKKILVEFIKKESAYTFFQMLQEDGRLELPAELLTGDQSILERKQVLKKIDTAGQQGMILVSTQMIEAGVDIDMDIGYKNWSKLDSEEQFMGRINRSCKKKDAVVYFFEMDDPRHIYRDGDARIDNLEYTLANEEMRTILSEKEFQKYYKSVLEVLKQTFMETSGDHGIAAFFAKQLGLLNHPEIEKRMQLIQDDMWSMSVYLCRKVEEEDGTVVDGKEIWDKYKKLLMDQEMDYSEKKYKLSEVRSKMNYFTYTIQRTDLMYSDKIGELYMIEDGEKYFQNGRLNKMLLEGRDGTPDFL

SEQ ID NO: 12265 - protein, 792 aa, Clostridium sp. CAG:352
MEYAAHFTEDGRLQTVKEHLISVAEKGKRDSELINMPSLYYLAAILHDMGKNTARSDEYQRTVGSGGEWNKGKVVHSNCGGRYIYEKFIKNNDSDKTNNYTVEIISSVIMSHHGLFDFDYPKSGKENGFVTKINNTNYDYNECKKLTLDEVISEKEIDELYLNAKNEVNEFLNFCSKDEDKRKDGESIERIKLFNCSLLIRVLLSILVDSDHSDTAEFVNRIERPKLYGDAELWEKCCNYFEEKIKLFNKDTELNKIRAEISDKALAYSENSENIVRMTVPTGGGKTISSLRYAIHHAKKFNKNRIFYVAPFNSILEQNYNEIKSFLPDDVSVLPHFGDMLYCNYNESLATEQNIKYMSENWNSYVIATSMVQFLNSLFDGKISSIRRMRGLINSVIIIDEVQSIPYEFIRLFNMAMKFLAYICNCTIVLCTATQPPFEHMDYCLRLDESCEMINDFEDYSEKMRRTRIIDKTIPGGYTADNVADFLHSLSEDCRTILCVVNTKKAAFEVFKSAKHLFEDEKIVLVHLSTNMCPEHRANVIKNMKDEMKNGKRVLCVSTQLIEAGVDISFETVVRSLAGTDSIVQAAGRCNRNAERDIGYVYILNISNEYENVSSLKSIQKGKSATIGLLKRIKKKPDEYEDLLDLKAIKKFYIDYYKNFDKKDLYVEDFTCSIFEMLSTNEKGSYHTKTLLRAAMKTAGECFEVITDINESVLVPYKDGKELISELLSEGYKDYDAIIKKAQRYLIGLPKNKLKDSYISVDKKTGIRFLTDGYYDEIYGFSENPNLDFCYF

SEQ ID NO: 12266 - protein, 884 aa, Eubacterium siraeum CAG:80
MKTSELLAAKSSFEDNTKWLPFNVHANDTAGIIKRLFNKWIAQNVRRRLCAAIGIESSENAEEIVCNYCKFIALVHDIGKLTPAFQRKLKDNIQGLADRLLDAGIDLSGLTQISESPHNIAGQYILKKEFEVAPSTAVIVGAHHGDCSADRGQCSYEANYYGHGNVNVNEWIQIRAEWMEYALSVTGFEDVKNLPNPDVAAQMLITGLLVMSDWIASNTDYFPYIDIEERLNDEQCEERVRRAWNKLSLTDSWYADFISDSDSFFEERFGFKPNSVQREFMNVVSLCNKPGIYILEAPMGIGKTEAALAATEILASRFGYGGMFFGLPTQATANGIFDRIHSWTSGTDDIHSLRLAHGMTDMNDEYCEMFHGRASDISDDDNDNIMVHTWFEGRKQALLSEFVVATVDQFLMASLKQKHVMLRHLGLAGKAVIIDECHAYDRYMYVYLENSLRWMAAYNVPVIILSATLPPDKRAELIRWYTGSKNSFDNSSMAYPVLTWSDGAEVKQKAIPVDIPDKSITVIRREENDSNNIVNLLEDKLSGGGCAAVIVNSVAYSQELADTIAANMPDYRVICFHSRLISTDRAVIERELTELVGKKSTCEKRDKLIVVGTQVLEQSLDIDFDYMITELCPMDLLLQRSGRLHRHNRTRPDKLSEPELCVLIPEDFSKSVYSGWILKQTEKYLPDKLVIPGCIPELVGAVYSEPDNDEQQTAEYREYSDEQKEKKQRARKYCIPSQKINRSDSTLSDMINRRELNNDSDGEAAVRDGQETIEVLVLVKTSDTEYSLFSRDAVFDITSVPDNVQAKLIAKQRLRLPAFFSKSYNFGKTIEILANAMPQAWRNAKWLKGEILLLLDGNNKINLLGRTYKYSTERGFEEIKEEES

SEQ ID NO: 12267 - protein, 808 aa, Clostridium sp. CAG:58
MDRLIAHTRKLNHDQLEWQTLQEHSCNVAKLCSEICEPFGLGKLGLLTGWLHDMGKASQDVQDHILRKTLQKLNHCSAGMYWLWEHKRKQNFTDWVMAQMACLAIGCHHSGRCDYIAPDGCEPWLDRMHSERAGVRYSENVQAFFSDCCEEGFMLTLINQAAEEFSVFEERVRKKIQEKYDPESENAVFWTTYRFQMGFIQRFLFGALVDADWIDTSCYMNQTFLPHSTSLEERQKLWNRLSEKTENYLKGLSRKYTIDELRQEISDQCFSAAQKCDPGIYRLYVPTGGGKTYSGLRFCMEMARRQNASHVFYFAPYKSITHQNADCIRKVLGSEYVLEHHSDVIFNENSEEGRSQWIALSQRWQDVPVICTTMVQLLNTLFAASRQSIRRLPALANSVLLLDEIQALPLQDICLLNLAMNTLAQVFHCTVVFCTATQPALDKAVYPIEFSLEKDLVGDFEQRFLQFKRVQIIPRLVPGGESVSSVADFTKDLLKENRSVLVILNTKRAVNKLFDTLRERISDDVQLFCLTTYLCQKHRDDVMDKIKKHLQKKSGPSLICISTQLVEAGVDLSFDCVIRSLTGLPSIIQAAGRCNRHGNDKCKDVYLVYCADEDLRYLTEIDTAAQATRRLLEELPEGIDLLSPQAIQTYYQIYYGDQEQLRNMLYRIVPENGLETTMVDLLSNNQNGVQAKREHMGLVVKQGKDKFRWVMRQAFGTAEANFEAIQDENIPLLVPYGKEGRHILAKLLEEDSEIPSFAELQPYTVSIGRRDRKRLESALISVMDGAAFMVLPNYYDSEFKGLCFEAQQ

SEQ ID NO: 12268 - protein, 535 aa, Ruminococcus sp. CAG:57
MSGDFEKALDKLNRELSDMPSDNPLRQARSRIQQQAFDNSVNKSHISILDMPTGSGKTLCSLKLALESGKKRIIYVIPYTSIIEQTANKFEKMFGDVLPVLQHHSNYSYDGNTEEEKKTVEKLKRTCENWDAPLIITTSVQFFQSIYHYKGSALRKLHNLRDSVIVFDEIHLIPTELLRPCLKAVGYITKYLNSEALFLSATMPDYSKLFDKFLPDVNYNKLVTDRTNFKYFKKCEYKDMGKTTLETIAENASRCKNALIVVNTKKTAAELYNLVQGEKYHLSANMTPAHRSRVIEVVRKKLKKGEYITVVSTSLVEAGVDLDFNTVFRQLSGLDSILQAGGRCNREGKDAKGYVYVFDIDETYRKGSDLAMRINKTKGLLEKYQDITSYDCIKEYYDGIFDFNQSRIAENSIAKYNEQSNSFDRQGLMSPYSIPFRSYAMQFEYISADTISLVIDDPNDQTCHKLVETLRNGDMSVRRALQKYSVSVYMNVFKDLYSQGVLKDHGTGIFILENQSYYNNETGLDTQAAMQDYFI

SEQ ID NO: 12269 - protein, 733 aa, Clostridium sp. CAG:964
MDINKKLAKPNKTIEQHSKELIEQANLLYKLGYIKSREMYIDLLISCEIHDNGKANSKFQNRVKYGGDFKINNEVPHSVLSVFYIDKEKCINPIAVYFSVLFHHYRGDSPISIFNKERSLIEDSLNELGFSANKAYGRMKEVITKVKNIFKEPLSKADKQYAVLLKGFLHKCDYSASAGITCEFKNDFLNECMDSWKKQTGNEYYSLQKFCRQNSGKNIIVTAPTGMGKTEAGLLWCGNNKCFFVLPLKTAINAMYERIKELCGEDYKHRVALVHSDMKAYYLKSLDKEREGEADQAFDFAYAQNSRQFSLPITVCTPDQIFDFALKYPGYEYKLAMSSYSRFIIDEIQMYDPELLAAIIYAVEMIHTLGGKVAVLTATLPPFVKEELVRVFKGDAELENFSGDGKLRHNVRVFEDKLTSEDIQSIITDTRCGSVKKYLVVCNAINVANDIYEQLKASGIDADINLFHSNFTRKDRVAKEGQILKAAKISNDKLERPQIWVSTSVVEASLDIDFDILITELSDLFSLFQRFGRVNRKGKKDFSKTNCYVFTEIQGNAKYFVDETIHSMSKAAIKNFEGVISEDDKNKLIEDYLSVDKIKGSKYYKKYLSSYNNYRESCDYLKSQNDGIRRIDRIDAIPIEVYNQHKEEIESNVKICTDSNATPEERLRASEGVFDYTVSVRRSRIDTKCKLIYKGHSNIPIINCSYSSEYGVRFDNTVQNGIIKGADKCSNFL

SEQ ID NO: 12270 - protein, 750 aa, Firmicutes bacterium CAG:227
MKAIQDFLAKPNKTIREHSDDLKKRVYYLKEIGYIKGERLFYLLLECCKHHDDGKANFSFQRRVSSKRWIPFDPEKEIPHNVLSVYYLDKTQYEEMDYLKIASAILYHHDYCDEDRVINEKWMLIDENLLEGYSSESLSGDEIEYLMNEGLYGENLIILKGLLRRCDYSASGEYEIEYPNDFLLEKLERMMQRWKEKNENAGWNELQKFAIENRETDIIAVASTGMGKTEAGLLWIGDQKGFFILPVRTAINAIYDRVREEILQEEKLEERVALLHSEALEYYNDNVEELDITEYFDRGKHLSLPLSISTLDQLFNFVLRYKGYETKLATLSYSKIVIDEIQMYEPDLLAVLIRGLGQIHRLGGKIAIVTATLAPFIKQLLKEDAEIEFKEKDFILDKTRHSVSVKYGAIQAEDIVTQYLENKKSGKSNKILIVCNTIKKAQALYEELKTQLGEIEELNLFHSRYIRQDRKKLEKEIRRFGKTYCDEKHKILDCQNGIWISTSLVEVSLDIDFDYLFTELSELNGLFQRMGRCNRKGVKNLDKYNCFVYCAGEEVKRGQKGFLDPIFYEQSRKALQEVDGLLSEEKKMDLINRYFTMEQVKDSSFMKKYREVYNQLMELRIGDFEEGEQLRSIFNQDIIPKLVFDENREFILEQQDRLRKIEKQLRKSKGEERVQYLKERLNCQQNLKEFVVSIPKYEYQNYMEKIWERFGYVGISKYEKIPIMDCYYDEKGYYPLNYKERTIEDEMMMC

SEQ ID NO: 12271 - protein, 804 aa, Firmicutes bacterium CAG:227
MEYYAKSKKRQLSQGEKDKLKEDLEKIKEKLQDELDETEINIINHTIDDLGKDLEEKQKTLKEHEEEIVRCAETFFKQYGAYFSDKEKLLILEACKRHDWGKANLLFQALMSNLEVDEETKLDSRKLEQIPHGFLSAVTISKSEFLKLSEEFSEEDFSPFITAIYYHHDREDDYDGEKIREYGRKYYMQQVSEYLNKDISKLYCSNIYKLLFRNNLYSSKIVEYQYENWSEIWNKYLLIKGMLNKFDYTVSAGYEEAETAVDLHEKKLKKSIEKCLEKYELKPAQQFMTEHKDESLVVVAPTGSGKTEAALLWLNGEKGFYTLPLKVSSNAIYNRVKEKYSYEDVALLHSDSMAKYLKEYKQEEAGICEKYDRAKMLSQPLTVCTVDQLFKFVYRALGTEIFAATLKYSKLIIDEIQAYEPRVIATIVYGLSIIQKMGGKFAIITATFSPVLQHFMKECGLKYSFEDFTDIEEKEINSRHRVKIHDSDIDKSVCNEILEQGKHKKVLVICNTVLKAQQLYKMLKGENVWLLHSRYLRRDRALLEKNIMEFSESDKTGVWITTQIVEASLDIDFDVLYTEMSTADSLLQRMGRCNRKGRYCPEEANIHVYANKNGVGKSSVYENDLYERALECLKKHLEAHKGKPFTEKMKTDYMNKVYNIEEIEGTQYFQEIKEYLKLFKNIHPTEYLAKEVEVRNINSITIVPERIYQEKKEVFDAGIEFLSKPNIGRETRSLIKSKLQDLTLSLPIYQKFPEKVEKKTVGNGRKRKVMDIHRATYKYEFEFETGKGMGLIMQEELETDGEFI

SEQ ID NO: 12272 - protein, 730 aa, Clostridium sp. CAG:356
MNYKYYAKSNPIETIKEHTDKLLENLEILKRTYGAKIVQVIDMPEDRFWQLMEIICKYHDAGKVYSGFQNVIRKAIGEPLLVTKFNNEQIKHEQISPMFIPYKKYELTKTERKLVYQAIYYHHERNNTIHIDGDLLKKIIEEDIKPNIPQIENELQIKVPELKTTYLGMVEGQVRITEFDDIYKNYCIMKGLLHRLDHCSSAWIPVENENKDEISKFVENFMNNQNFKLNDLQQFAKINHNKNVIVIGSTGMGKTEAALLWSNHDKTFFTLPLRISINAIYDRIKETIEYEHVGLLHSTAIDYLDDKNEENEFEKIEQARNLYEKITTCTIDQIFPFVFKYRGYEKIYATLSYSKVVIDEIQAYSPEIVAVILKGLQMINNLNGQFMVMTATLPRIYKDKLEEMGIKFEYNEFIKNTIRHKIQLVESEINQDIEEIKESSKNKKVLIIVNTINKAIEIYKKLKDEDVQNVNLLHSRFIQADRSEKERNIKEFSKNKNEAGIWITTQIVEASLDIDFDMLYTEMSTLDSLFQRLGRCYRSREYDGNIPNVKIYIKDTSGVRYIYDKEIYEKSIELLKPYNGVILQEKVKIDLVDKLYSKEMLQGTGFYKKFKEAFKILDNIIDYDTSKKDAQHILRDIDNIDVIPKIIYDENLNLFGEYENEKEKKKKYELKRNIDKLFISINSKNKWKLNNFITECPYVKGKYIIDTKYDKEIGLLLELDEGYSIDSREL

SEQ ID NO: 12273 - protein, 724 aa, Ruminococcus sp. CAG:379
MEYYAHTREDKNQTVSEHLHGVADMAAGFSIEMLRDAAYIAGLFHDLGKYALAFQDRLLRGSKEAYEHSACGAIEIGKLAQDPTARQMTYMLQYCIAGHHTGLPDGGTPADSPDGDNTLHSRLNRQKNYTGRCDYSGYTQQISLRLPDYRDVLAELMSCRDKTELIERYAFFTRYLFSCLTDADFLDTEAFCNPERERGLQGDFHALERALTQKMNSFVCDTPLKQARGRLQRQALHNSQSSDPVSILNMPTGSGKTLCSLQIALQKCRMQKHKKKRIIYVIPYTSIIEQTADTFAPLCGEHTPILQHHSNFCFDSEGIPDKTSQKLKLSTENWDAPLIITTSVQFFQSLFHYKSSGLRKLHNIADSVIILDEVHLLPVDMLQPCLRGIGYLTRYLNCECVFLSATMPDYKPLFRQYLNGQQGVDLITQKDDFSFFQKCRYTNLGEQDPEHVAELAAKHRSSLIIVNSRRTARQMYQLLSGKKYHLSTYMTPHDRSETIRKIQSALEQDEPVSVVSTSLVEAGVDLDFEAVFRQLAGLDNILQSGGRCNREGKRPMGDVYIFRTQDKPQRDIRIRASIVQDLLDHGADLSTGACVEEYYRRLFDFNAQLIQENSIARNAVGFDSIPFRSYAQANQFIKEETVAVVIDKWERTAQLLEQLFNGDKCVRRELQQYSVALRVYGEFDQALKQGLIRDTGCGVYVLSNPDNYDPETGLDLGIQPIYMA

SEQ ID NO: 12274 - protein, 708 aa, Bacteroides pectinophilus CAG:437
MEYIAHKDGERIQTIKDHLTGTAKLAGNFASKFGKENWGYCCGMLHDIGKYSDKFQKKIKENNNEMVDHSTAGAQLCDKLGGYYPFLSYCIAGHHSGLPDYGNTAIASSLCGRRVKKIDIYEAYKQEIAIPELNSAPIKVEPYKNNDFSLSTFMRMIYSCLVDADFLDTEKFMNNGNEQRASGQSVSVLYEKLQRYIEKWLGNSDTETLNGRRTEILKNCLIEGKKEKGFFKLTVPTGGGKTIASLAFALKHAAEHGMDRIIYVIPYTSIIEQNAQVFRDILGDDNVLENHCNVDYESSEELRPMQLASENWDKPVVTTNVQFFESLFSNKSSKCRKIHNIANSVVIFDEAQMLPLDYLKPCMAMIQQMVENFNASVVLCTATQPAVDSFFTEEKNIVELCPHIEEQFRFFKRVTYHNIGVVTKNNIADRLQNEKSVLCIVNTRKRAQELYKLLKAEGVYHLSTSMYPKHRKMILQTVRKRLNNNEKCILISTSIVEAGVDLDFKCVYRQVAGIDSIIQAAGRCNREGRENPESSIVYIFDFDDNSVSPVQKQQIDIAKSILPDYENICGLDCIDDYFSRLYKFRGKSLDKKNIMAEFKDKKYNFAKVGREFRLIEQNIKTIFINREQEADEILQDLKQKGMSKERMRKAGMYCIQVQNNLFDKLYGSGKLRPVSEDMQDFYELVNGSGYSEECGIDYLTCGGAAVFF

SEQ ID NO: 12275 - protein, 548 aa, Eggerthella sp. CAG:298
MTLEEGLASFYPPKTLLNIKRCAILDQCKEAANGEKGFYSLTTPTGGGKTLASMRFALNHASQPDHMIERVIYAIPYTSIIEQTAQVFRDYLGVDNVLEHHSGFDFGADELGTGASPEKIKIMERLRLASENWDAPIVVTTNVQFFESLYSDKTSRCRKLHNLANSVIVLDEAQMIPISQLRPCIEALKELVEHYGCTVLFCTATQPALSSVFGELDMVHEICPDVPELFDALNRVSYLYQGKLDDETLVDQLFAHKQVLCIVDSRKQVRNLYDLLKGKTGDSESVFHLSTLMHAHDRSRTIVRIKYRLKNQLPCRVVSTSLVEAGVDLNFPCVYRSMNGLDSIIQAGGRCNREGGESPESSHVMIFESDASYIIPLEIRNRASITLSLFNAHGFDQKGSNGKNEPLPLHQPQYVEEYFDHLYEMRRSGMDKKDILRRLSESSVYSIPFRDIGRDFRLIDDASFAVVVPCEETEHEIEAVREGFASANTLQKLSQYSVNIYERVRDELLSSGVIASLYDDVYELQMKDRYTSECGLLLEEVQGEGIMW

SEQ ID NO: 12276 - protein, 926 aa, Clostridium sp. CAG:62
MVNKLLVGKVDDNFNWLPLWVHLQDTAGVMKLLLENWIADATVESCGMQFENFYAIAEFVAATHDIGKATSYFQAIICKKVPILYDNIVSSGLIVCENMLHRGKTPHSYAGQWILQSDTVGINLPESVANVIGAHHGAPCPGKTLNGVDDLLVVYPSNFYGEEDVSSIQSKQWLSIWNEIVNEALMLSGFDSISEMPDLTVDAQVLLSGLLIVADWIASNTRLFPLIGLDDDFEKIDCDTRVEEGWNRLQFPEEWHSEVCNMSKQIFQERFGFEPNAVQEAVIKAVNETNTPGIFILEAQMGIGKTEAALGAAEVIASKCNSKGIFFGLPTQATCNGLYDRLYEWASSVSDETVNAIRLAHGGANYNKNYQQQVIQGKTYVYEEEIDSSVYVHPWFQGNKKALLADFVIGTVDQFLMASLRRKHFMLRHLGLSGKVVIIDECHAYDAYMNQYLEQSIEWMAGYGVPVILLSATLPLSRRKELVNRYIKGIRRNRPKIEKQKPSVSSDWMDNISYPLLTWTDGLEVHQCNILQQTQNRNVKINYLHGVEQTVGLLKEKLCDGGCACVILNTIRHAQEYYRAIKDLIKDAEVLLYHAQFTMEHRLEKEEILLERMGKKSSDQKRNRFILIGTQVLEQSLDYDADILITELCPMDLLLQRIGRLHRHNRCDATHHYSRPKRLQQAECYVLLEAISDGESGLYDKGSQMIYGDYLLIRTLNILPSEIVIPKDIPTLVQRVYDEKDDCDLDITDVRYLQAKEDFIVKKGKKRNNAKAFLLKYPRKTIQGMLTNEYLDKTQKGNMSVRDIESSIEVIIMKRYQQNKIGFVCSDTGNSIRMFDCNFLSEEDGVEIARQRLYLPRLFANPGLLYRAIDELEKMQYEMSVWQRNPWLQGELILLLDADNTAQLCGYDLHYDFELGLVVEKEDKNG

SEQ ID NO: 12277 - protein, 418 aa, Tannerella sp. CAG:51
MQLATLRYSEKEKDIILISPTGSGKTIAFLLPVLQGLDPLCKEIQALILVPSRELAMQINSISHSISSGYKINCCYGGQPIKSEIKSLQQNPAILIGTPGRILDHIDHGRINVSSVKVLVLDEFDKCLELGFQEQMEAIIKHISGICKRILTSATEGEIPEFTGLKTPEKIYFEKKESDKRLSLYSVISPEPDKLKSLETLLRNLSPGPVLIFCNHRESTERIGSFLSEQHIFNEVFHGGMEQTRREKALCRFKNGSSNIFISTDLASRGLDIPEIKHVIHYHLPINEETFIHRNGRTARMFAEGNAYLLINSAENIPEYIQKKQPERFNLSVNIDRLELPPMNTLYIGKGKKEKLNKVDIVGFLIQKGELYKEDIGMIDIKDHYSYVAINRKKINRTLRLIRKEKIKNMKSKYEIAR

SEQ ID NO: 12278 - protein, 817 aa, Roseburia sp. CAG:471
MNKDRNEYLAHVDWVSGRRQSMKEHSDNVAFLASEACMLPELRDFAWMVGKLHDAGKLGSENQQDFENILLHGDEVHRNDLDHSTAGGWTAEDLTEKMIEDPRVNKAVAELLSNAIYFHHGIGDCINLKTGELVTEQRRRKEIAYEEIAQRFFQIYDRNILEEKCVDLRKAYLQIDKKIAVFKRKYNMTKNNCGNPYFYMGMYLRVLLSLLIDADWTDTACFFQNEPLKTRIPSKEMQRIWEKTTLYFENYLATEVQRNPDNGSVLNQIRQKISETCRDAAKTEENLYRLTVPTGAGKTLSSLRFALHHAKEKKKQHIFYVAPFNAILEQNAEEIRKATGNPEIVLEHHCNVVCEEGEEEKYRSLTETWDVPIIVTTAVQMLNTLFSDRKSSIRRIHTLCNSIIIFDEVQAIPVRCMELFYLAVNFLSKFCNTTIVLCSATQPSLAKLQENNICPCKEMVDHVEMYQEQFRRTNMIDGTKLQDRAMTIEDLADFAWQNTEQYHSTLCIANTTATAFQLFQELKRNCTEDYNIYHLSNNMCPQHKLDTLEQIRKALKDRQKKIICVSTQLVEAGVNFSFGCVIRSKAGLDNVIQAAGRCNRHKEFEQLGNVYIVSMSKDVEKIDKLYEIAAAQQALQKTLDDFAANPEYFHQCLDSEQAVTAYYRNYQNQIRPNETKFPVPEYDTTLVELFGRNKTGTSQYCRTHGMKKSETRIPQAFATAGKIFEVIEDNHKINVVVPYCEEARELVEELAACKNSDGSKIIRKLQRYTVGLTMQRKEKMSNAIHGYCEGKIFILADGYYDGEVGVVDESIMQTLLL

SEQ ID NO: 12279 - protein, 741 aa, Anaerotruncus sp. CAG:390
MQYAGAITFEEDIMSKTGFYAHKTDDGRLQTIAEHAAGTAERAGRAAGAFGFGDAARAAGMFHDVGKYAPAFQARLCGSREAYEHSSAGMSLFFERSRKCRSYADMLLAYAIAGHHAGLPDKGSGSDTEDSDTFTAKIKRRAALGCDFGSYSAELGELPAVRELPAAFLPKQYDWYSYQFLGRMLFSSLVDADFLDTEAFMSGGTAARDGGEPFDTLRDRFERYMDRFSGKSGKLNENRAKILADCRCAAASEKGIFRLTVPTGGGKTLSSMAFALDHLRAHGMKRIIYVIPYVSIIRQTVGIFENIFGERNVLGHYGTADFGGGCETGERSPAELAAENWDKPIIVTTNVQFFESLHAAKPSHCRKLHSVADSVIIFDEAQMLPVGLLRPCLRAISELVKNYGCTAVLCTATQPALERLLADNGITAREICPDTARMYPDFARVRYEMLGKCSDDAVCERLRAAGSALCVLNSRAGVRSYYNALAGDGVFHLSTYMTPAHLGRSIETIRERLGRGEKCLVVSTSLIEAGVDVDFPTVFREMAGLDSIIQAGGRCNREGRRATDESNVYVFSREAPSERFSAVSAMTARVYELYGDISTPEAIHAYFERLYAVSPSEVNDKLDEKRILALIDQRESDMRGLNYREIAERFRYISKDQKQILIPNGENAEACAAVRSGRLTRGLLRRIGRDSVPVYENEYKKLREAGVLSQECDGAAVLEDPSWYDPDCGLTFRDTGDALFG

SEQ ID NO: 12280 - protein, 854 aa, Eubacterium sp. CAG:38
MKEYIIPIEDIIVKPELFYAHCDRDNGKKPELLKEHVDRCYHYFEELWEHKNFKAIFENFQKELAPELSDEGIKLFYSLIVNVIIFHDYGKINPRFQSITMKNTLRKWPVINCLDGTKHSMLSAAIYLDYFYEKIQESPLSKDEKNVIHVFMLSNAYVISRHHGNLSGFEAFLGEFQQNQQLADIFSCMNQGDFAEVYYGPFCKKGLHSVNMPMQNKRKYDSFSEKQSLQLGLYAYIRFLFSVLVSCDYYATSEYDNGIEMSAFGTIENTEFATQYEQSERVKQIRRFNPESCVDDKKDINILRNRMFYEAEQTLLENKDANVAFAEAPTGAGKSNLAMNCSLKLLDKNINKIFYVYPFNTLVEQNYDTLEKIYGQTDIFKSIAVINSITPIPLNGTRKFWENLDKEENEKFYQKALLDRQFLNYPFILTTHVNLFQIMFGCEREAAISFYQLAGSVVVLDEIQSYKNVLWTEIMMFLQCYSRLLNMKIIIMSATLPKLDMLTGNHEKVVNLIENPEKYFQDARFKKRVALSYELLYPDKKTEMEELYAHVLGQAQKGRKILMEFITKTSAEMFYHMLAESGREDLQVFCMTGDDNQIDRKRILREMDTADQDKAVILVATQVVEAGIDIDMDIGYKDISKLDSEEQFIGRINRNFKRNGVVYFFDMDDESGIYKEDYRVDTAYTLRKDEMKQLLADKNFGKYYDYILKGIRKYRNDRKNENGIEAFVDKVKKLDFVWISQKMKLIDNNDDWKMSVYFARAITTDNGEIIDGKQVWERYRELLSDITMNYAKKQVLLSEVKSKMSYFIYQIKIDNSLDYNDRIGELYLIEDAEQYFENGRLNTDKFYSQGNLFV

SEQ ID NO: 12281 - protein, 748 aa, Faecalibacterium sp. CAG:74
MEYVTHLREDGSYQPLKEHLEGTATRSAKFAASFGASSHAERTALLHDIGKYSPNGQRRQRDPEHTAKVDHSTAGAKAAADLDDMHAAFAIAGHHGGLPDLGTRLSLDDGTLCARLNKKLTGGDDPSAWRSEISLPTGVQPTPPWLPRNDVRLTAMYIRMLFSCLVDADFLDTERALSKEEKPRGIGDSMPALLEKLQAHVAKWLEEPKSDLCALRNEVLRRCLRGSEDPQGLYSLTVPTGGGKTVSSLAFALSHAVKHGMKRIIYVIPYTSIIDQNAKVFRDILGDENVVEHHSQVDLPDTDAETPDALRKRLACENWDAPVIVTTAVQFFESFYAAKPGRCRKLHNVANSVVIFDEAQTLPISLMRPCVSVIDQLVQHYGVTAVLCTATQPELLSIFSGFTAGTRIQELVPDPDALFSSLRRVTFQQDGMVSDEELAARIRQENAVLCIVNSRKQARSLYEALPEEGRFHLSTLMNAIDRERTIATIRERLDKKQCCRVISTSLIEAGVDVDFPTVYRELAGLDSILQAAGRCNREGKEAAQDSIVHIYQTEHAVPPIMRPNIESCRTVLRLYAEDIGSRKAIHAYFCDLLFKRGENQQRSRPVSSENDLLDTSKTLSSEARFAFRETAEHFRFIDTDTVTVYIPTPENSEDIKALRDGHYSRELFRRLGRCGVSIYRREYQALCSIGGGTEIADAHCGILRRHGNCRCALRHSKRHQIVHAGMRLAGQLHERTGAIRLTYIMKEN

SEQ ID NO: 12282 - protein, 882 aa, Sutterella sp. CAG:351
MTSFIRVAPPAEQCPAKTWIDESGINRLGRSVADHCLIVGTIAKELQKLFPETISSIFPSGSALIAACHDVGKISPTFFLRLELMAGISDGTVKELLQETSFTDNPEAIRQYESERWGGHPGVSFVTMMELTHDHNIATVVGQHHGSLPKKDLQWQRADDEDFGGPLWEKSREKFINECENELKESFPASMTTVQRQLVSGLTTAADWIGSGSIFDNPESPWQPLISQATADAGMSPVSIKGSLTFGEIFKDNDGTPYSPNKFQEALGKVASEPGVYILEAPMGLGKTEAALFAAYLALSSGHARGIYFALPTQLTANKIYERFANFLSAAAPDSDLPGLLHANAEDFFEHLDMGGGEFTPGNSWFSAKKRGLLAPFAVGTVDQALLSVMAVRHSFVRLFGLAGKVVVIDEVHSYDAYTGFLLKELINELAALKCTVILLSATLTRSSRHQLLFPEKAKSSRGRRELSEDERQDFGYPVISYRKNGTVGHISFPPQPDSTVFVSLHHEEQGERDAIEEALKRAENHQQVLWIENDVATSQRIYRLLAARAKEIGVDCGLLHSRFTRGDRQNIESAWVPRLGKSGWAHRLDCGRILVGTQILEQSLDIDADFMVSRIAPIDLIFQRSGRLWRHQKTPRSDAAVREMWILSPTLQEALENPRQNLGSSAAVYSPYTLCRTLETLEPVSELAVPSDIPRLMEAALGDRPETGLFGNLKNDLLYGTPKCPGIYRLIEDARKNLNNPCTSTEDDSTAQTRHSEIPTVDMLLIQNIATENGRTVLTLLNGEKVTFPHEQKDFSKSQWKKIASSLRSSFIHLSVTRAKGFSISFEKAKAFGFGNFIYLGSPNSENLFIALIDQSGTAFNLSRDCTQYYDSTIGWCLEKE

SEQ ID NO: 12283 - protein, 741 aa, Ruminococcus sp. CAG:353
MEYIAHKADDGREQSVKNHLEDVAKLAEKYAAGFLGSAAYTGGLTHDIGKYTLAFQKRINGGARTEHAVQGAVECGKLFGGNILIALLQYCIVGHHSGLPDGGASADGPDSPTLQGRLSRAKKLESGEAYKNEITISALDDSQIIACMNEIMHSSLSDKEKNREYMELYAFMTRYVFSCLTDADFIDTETFCDMQAERGMTGDFEEALRRLDAHMSGFKADTKVRTARRELQHQAYELAQNGSSVELLNMPTGSGKTLCSLKIALEKAVKDGKKRIIYVIPYTSIIEQTAEEFEKILGDSVEILQHHSNFSFDVDKDNKNDKYDENDLTVLKMKHTAENWDAKLIITTSVQFFQSLYHYKGSRLRKLHNLADSVIIFDEIHLLPIKYLQPCIRAVGYITKYLRSTAIFLSATMPDYTGLFGRYLGNDFTQLITDKTHFADFKKCQYIDLGKTSFENVVMKASESMSSLIIVNTRAEAQQVYKMLSGVKYHLSTYMIPEHRSAVIKKIRQHLKDIADNVTDEKLTVVSTSLVEAGVDFDFQTVFRELAGLDSILQAGGRCNREGSRSDGCVYIFDADDTPHKNDGDFGTRRNITKKLLEKFSDITAPECIETYFSGLFEDYDELIQKNSIYECSTGKSLMSIPFRKYAESFQLINDDDSIAVVVEYDENASKLIARLRAGDMKVKRKLQRYSVPVPKKYINELMKSGLISECNGVCLLTNKSYYTDEMGLDINTDLDAQNIV

SEQ ID NO: 12284 - protein, 728 aa, Clostridium sp. CAG:273
MIYAKSDPQETLKEHTDELVNQIKYLRKISSNQVETITNLGDKEFWKLLELACKYHDTGKIFTPFQNLILKQIKQKEIPTEFNYNDIKHEQLSPALIPDDLDLTEQEEKILVQAIYYHHERKQTNEDRKLINKIIENDLMPKIESASKELEIKLNKEPNDMYLCMVGDNKRINSLHKLYIDYVLLKGFLHRLDYSASAHIQVEDTSNEKISDYIEDFFNQNHFKENDLQEFAKNNKENNIVAVGSTGLGKTEAALLWSQGDKAFFTLPLRISINAIFDRIKHSINYKSVGLLHSTALDYLEEENTEFGITNEEWEQSKNLSYRITTCTIDQIFPFVFKYKGYERIYSTLAYSKVIIDEIQAYDPEITAIILKGLQMINHIGGKFMVMTATLPRIYKDKLEEMNVNFSYKEVPSKLERHKIKIEREDLLDSCEIISKKGRSKKVLVIANTVNKAIEIYRKILKYNNQNVHLLHARFISRDRAKLEKDIKEFSDNKKINGVWITTQLVEASLDIDFDYLYTEMSTLDSLFQRLGRCYRKRELKEKEPNVYIFTKENSGIGSVYDKEIYEISKELLEDYNGKILKEEQKMKLVDELYSKEKLRNSDFLNKFELGMKVLDNIVDYNVNKKEAQQLLRKIESYTVIPKSIYDENIELFEKYKKEKNREEKRNLKREVNMLTVNISSGQMWKLHEYIISSMQIDGMKIIDLKYDNNMGLLLENDKDYDYDSRFL

SEQ ID NO: 12285 - protein, 730 aa, Clostridium sp. CAG:389
MEYKYYAKSNPTETIKEHTDKLLENLEILKNEYGDKITQSIEMPKERFWQLMKIICQYHDTGKVFSGFQNVIREAIGEKLIPTKFDNQEIKHEQISPMFVPYKQYEMTKKERKLVYQAIYYHHERNNKIHIDRELLEEIIKEDIEPNIEKIEKELQIEISKLSTLYLGMVEGQARITEGDELYNEYCLMKGLLHRLDHCSSAWIAVEDQTKDEIADFVKEFMKKQNFKENDLQQFEEKNQDKNVIVIGSTGMGKTEGALLWSKNDKTFFTLPLRISINAIYDRIKDTIGYRHVGLLHSTALDYLDEKNEEDEFNKIQQARNLYEKITTCTIDQIFPFVFKYRGYEKIYATLSYSKVVIDEIQAYSPEIVAVLLKGLQMINNLDGKFMVMTATLPRIYREKLQEMGIKFEYNEFIKDTKRHKFEIIDKSINEDIDEIKEKSKNKKVLIIVNTINKAIELYKFLKNEGVEKVNLLHSRFEQEDRSEKERDIKEFSKQKDESGIWITTQIVEASLDIDFDMLYTEMSTLDSLFQRFGRCYRSRKYEGKEPNIKIHIKETSGVGYIYDKEIHQKSIELLQDYNGQILEEKTKIDLVDKLYSKEMLQNTDFYKKFNEAFRVLDNIIDYDTSKNDAQRILRNINNIDVISKIIYDNNLNLFEEYSKESDKKKKYELKRRIDKLFISISSSNKKKLGNLIIECPYIKEKYIIDTKYDNEIGLLLENDEEYSMNSREL

SEQ ID NO: 12286 - protein, 749 aa, Acidaminococcus sp. CAG:542
MNIFDRYAPFVQDFIYSQGWSELRPIQVAAGDVLLNTDQNLLLTASTASGKTEAAFFPILSLFAQNPPKSVGCIYIGPLKALINDQFLRLQPLCEEGGIPVWHWHGDVSQSHKAKMMKHPSGILQITPESLEALLLHKHMAIPRLFGDLRFVVIDEVHSLLRGDRGGQTLCLIQRLSRLAGVNPRRIGLSATLGDPEKVGEFLSLGTGRKTLIPQVKAPGTKWRLSMEHFYVKDAQAGEDRADLQALPALDVKTDQAPAQADPGLGYIFEHTRGKKCLVFVNSREECEGVTTSLRQYCELNHEPDRFLIHHGNLSASYRETAEELMKDESRNLTTVTTSTLELGIDIGRLERAFQIDAPWTVSSFLQRMGRTGRRDLPPEMWFVIREDEPEIRAMLPATIPWKLLQGIALIQLYLEEKWVEPPRLDRLPYSLLYHQTMSVLASNGEMSPAALADRVLRLSYFHRITQEDYKVLLRYLIAEDHIARTEQGGLIVGLAGERVISSFKFYGVFQENEEFTVRCDSQELGTVVAPPPPGEKIALAGHVWRVLEVDRKRHVIYCELVKGKVPAYFGECPGDIHTKVLERMRQVLREDRSYPYLMKNAVARLQQARFTAKASGAAEKPLIQLGGKMWCLLPWLGSYGFLALERFLNLKCAQKLGLKKLDPFRPFFMQFTMEADEETFFQVVEEEIQKEIDPLELVYPHEVPLFDKYDEYLPEELVKKGFALGVLNLEDVRKRVREWSHTGHGMTE

SEQ ID NO: 12287 - protein, 751 aa, Ruminococcus sp. CAG:624
MGNVMDINKLWAKSSGETIEEHTNKLLDAFNEFKTLYGKCFDEITLKTVEYACKYHDLGKCAFVFQKMLGNKAYTNSIPNKKELEKMYSEMGFEKNVPHGNLSPAFISNKEMKAELGQEMTQYLYNAIFFHHNRNRSITPSELDMIYDYELKPLYNAKSKKYMSKLFNSEIEECDWVKYAVILGLLNKFDYYASDTKEKSDIEINGNYNGKYIGDYVYEAITRHYKLRDVQQYALEKHNENIIIIASTGIGKTEAALLWAGNRKLFYTLPLKVSINAMYRRIKDKYGYSGDKVTLLHSDALNELIENNEENDANIIENAMIKYHASKLLSYPVTVCTIDQLFSFVYKYRGCELIIASLKYSVVIIDEIQSYEPEIIAKLIYGLYIITLAGGKFAIITATLPPVLTYFIDKKGIYNIPHAAPAQFLRNDITRHKIHISEADDFDYDEILKYGKTKKVLVICNTVKRAVEVFKRLNPNGRFENIRLLHSKFIKKHRKMLEDEIIRFAESENETGIWISTQIVEASLDIDFDLLFTEMCTADSLLQRMGRCYRNRDYKDDSPNIYIVNNKSGYGTVYKYKEIFDRSFDYLFQFNNQLFTEKDKMQYINQVYDTEELKNSNSSYFNEIKNEIDRRMHTPPFEFSKENAKQKFRNIVSYMVIPESIYNKNNSEFERCRDVLKNKSKYSFNEINSAKMFIENHSIGLGNFDPRVHERCNSFFEKLEYFTLDYKYDFDEELLCGIGLDYDKDEDSNFL

SEQ ID NO: 12288 - protein, 734 aa, Megasphaera elsdenii CAG:570
MKMENYIGHTSEEGRQQLLIDHLKGTSFLAERFASVFDAPEWGRMAGLYHDIGKYSAAFQRRILEDGPRVDHSTAGALLMKKIKNVPLALCIASHHSGLLNTGTKLSNVNDGTLMGRLKKDLKGKLDYSAYRRELPEPVPIRKAPAFLYGKDQFYYSFFIRMIFSCLVDADFLDTERFVNDGKVQRGGFATMEELHDLFFAYYATFGKPTTPINQKRQEIYQQCLDAAEKEPGMFSLTVPTGGGKTLSSLAFALKHAIKYKKQRIIYIIPYTSIIEQTADIFRNILGDGNVIEHHMNVDYDKDYDKDYDKNYDDDKKEDDGLNRKKLATENWDAPVIVTTNVQFFESLFAAKTSRCRKVHNIANSVLIFDEAQMLPEPYLRPCIRSMGELVANYRCTAVLCTATQPSLETYFSRIGEGLKVREICPDTQGLYEFFRRVTYRFMDVDSLESLAEKLKEHEQVLCVTNSKKDARDLYQLMTGDGCYHLSTFMYPAHRRRVLAIIRQRLQDGLPCRVISTSLIQAGVDVDFPVVYREIAGLDSIIQTGGRCNREGKQRTEDSIVSIYDLPKPMNRIPAFVRRPIEITQMVAKDHADIASAESIKAYFDQLHYTLGEDQLDSKDVLKRLEVNKPAFTEIAKDFKLIEEDSRTVFIPIDDDLDNQKILAQLRSGVCNRSILRKANQYMVGVYENQFRKLEETNKLEALEFGLYVLTDPAAYDPDTGLVVNMEDGIGIFL

SEQ ID NO: 12289 - protein, 736 aa, Eubacterium sp. CAG:76
MSKECDGKMLFNIKSLMLPLDSITEFGDECYAHLSEDETQKETLTEHTRRCQKYWFNIVEAKHIETVFIKFEQLYMGDITNEARHIFELMSVNVVTLHDIGKINPLFQKLKMKNSWKVEYAPESISSRHSIVSAIFYLDYFLDIINTAKGDGRINRDESDVLKDFAYIYSYIISRHHSDMNNMEYFFSGLTGKNTEGDNSGKDAYDWYEMFKQELYKEPVVKLRKRDEWLNRMAYQSNEKNIYLYAWTRLLYSLLVAADYYATSEFMNGYENNDYGNVNNIDNIINEYENNDVQKSIRNYEKNIKRLDEEQLAKVNKDTVIGNIKGINVLRTEMFLETEYNLKNNIDSKIFYLEAPTGSGKSNTAFNLSFQLLKKSDYCRKIFYVYPFNTLVEQNMNSMEKIFGQKENIMSNIAVVNSITPYKVKNSSNINLYKDEKYAIEDYQKILLDRQFLNYPIVLSTHITLFDTMFGRSKGSTFGFHQLCHSVIVLDEIQSYNNNKWGAMINFLKAYAQLLDIKIIIMSATLPNLELLTNNNAKAVRLINNREKYFNHRMFANRVKVNYELLNRKIGIAELEEHILQHKNKRILIEFIRKSSAEEFYAYISESAECPVRLITGDSSIQERKDIIADIENMQEVILVATQVIEAGVDIDMDIGYKDISRLDSEEQFIGRINRSCRKDGVVYFFNMDDAKGIYRQDVRVDTDNTLMNEEIREILNYKDFYDYYEKYVISVLKNA

SEQ ID NO: 12290 - protein, 803 aa, Bacteroides sp. CAG:98
MKETNIATASLPQQCRPAVKELLKEIYGYTDFRDFEVYNDLSSGKDKLKISQGQLIEEVIEESEKSMKTDSVYNFLLTAPTGAGKSLLFQLPAIYLGQEYKLLTIVISPLKALIVDQVENLRDLGYEKVSYASSDLSPEEKNEAYRQVREGETDLFYLSPELLLAYDIKHFIGDRRIGLIVVDEAHTVTTWGKEFRVDYWFLGRHLDNLKKNLGYAFPVFALTATAVWNPRGGNDMVFETIRSLRIDPCRLFVGTVKRENIGFDIRLLTIEEDENYDKAKQRVIIGRTDDFLDEHKTIMYYPFAGSIDTRIKMWVRSTNWRLVSSYYGKKDKAQKAAIVEAFKEGDKRMIIATKAFGMGIDISDIDRVYHVAPSSTFVDYIQEIGRAARDKSIKGIAATDFHERDFYFMKRLHSAGAITQNQLGMILKKLWEIYLMKGKSKEMQVSLSDFEFAVKLPRKQNKLEYESDLGQVIKTALLWIEEDLSSRFGGQPIEINSRTLFTDGYVQEKTGDTAFRETYKKFMTPVVGAEGIYKVSFEALWESCFSEMGYREFKRDLYNGNLFEGVRAAAVGKHEVLLKEDAGDICTKLASLLKRLKDLLTVSLYGNKGKFEEDDLRSIFAEYDMDVPSAKRFLSSLLESRVEEGRSVSYISSTKKKDEDKLIFTVTRGFDLLLSRYQKLCSQRITGVKGDLLLFYTTPFSDLNMLLNLLSMLNVVDFTVEGGVPSVEVTVNMPEVLEKEVTSEAYKNFVLENNEKIFLEQIELFQLFFGNTSLDDEQRWEFIEDYFTGMNVEEMKKKYSPLG

SEQ ID NO: 12291 - protein, 722 aa, Clostridium chauvoei JF4335
MYIEYLEEINIDELINKDYKIYAHINENKKETLKEHIDLCKKYLKRIVKDKNLEDIFLKVENIMLEDYSEEARKIYREMLVSTITLHDMGKLNGVFQKKKMNNNLNIEHLKTRNDSNHSIISSIIYLDIYFQKVCKNIKSKKERTGILTFMILNSYIISRHHGGFITDLEEYQMKICKDLRSVLPLLDKYIELYKYAYSREIKLTDKKINSIYDYFKLYMTKLKESEDCIRKINTIYIYERLLLSILIACDYYSTSEFMNNIEIIDLGSIEDCNIFRKAYEGGVIYNSIRNYEKNNYGKINDFTNIDDINILRNEMFLDAEKSLMKSRNSNIFYLEAPTGSGKSNVANNLAFKLLEENKRKIFYVYPFNSLVEQNIKNFKNIYEKTPNVLDKIAIINSLYPIKRVLVKNEEEIKFEEYEKSLLNRQFLNYPMILTTHVSIFRYLFGVNKEDVFPVFQLANSIIVLDEIQSYKNKIWGEIIEFLHDYAEILNIKIIIMSATLPDLDLLLESDTRSVNLIEDRKKYFENRIFKERVKIDFRLLDSKNIIEDLYEMINKHKNKKILVEFISKKSAYDFYSYLIERKELGELEFDIRLLTGDDNTIERENILNEIRTLNNILLISTQVIEAGVDIDMDIGFKSISIFDSEEQFLGRINRSCLKENSLVYFFKLDDIKGIYKEDVRSHEDLTIENKNIRQCLIDKSFTSYYEEVLKRLKKTQKSLVN

SEQ ID NO: 12292 - protein, 750 aa, Hungateiclostridium thermocellum BC1; identical to SEQ ID NO: 11589

SEQ ID NO: 12293 - protein, 800 aa, Hungateiclostridium thermocellum BC1
MLLSHPGKLLLDHLKNVFLIGDCILMQKKTEFESFSEHDIRQLNKLNLLTHDLGKATSYFQDYIRNLDDNTQKNDERKRHGLLSGVLSFKIVNAVMKNEILAFLSYMVVSKHHGELDDFTNFISVISGDEKNKTLLKLQFESIDKGKLQEVITRLGIDFDILSYTVDEFENDIDYITSRKVRKKVKELMGLEIFLLIDYLFSLLIFSDKLEAIYNSENMNIEEFIEKNTNRPRISSDCVDKFKKSLEIKNIRMAEWRNRAYQDVLGSVENLSVEEKILSINLPTGSGKTLTALKAALRLKERLIEEKGYNPRIIYVLPFTSIIEQNFDVFQKVLGTTESNVLLKHHYLSQRVYQWEKEGEIESLSDTVSEHLVESWDSEIVVSTFVQLLHSIFTNRNRKLKKFHNIVNSIIILDEVQSIPHRYWNLVRETFSAMAKYLNCHFIFMTATMPLIFSEENKEIYELVKDKRKYFEEFSRITIDAKRLTDKTTLDEYKTLLLDDILRYKKDDFLIVMNTIRTSIEIYSFIKEELKDEAEIYYLSTNIIPKERLDRIKKIKESKNRKIIVSTQMIEAGVDIDIDRVYRDFGPMDSINQTAGRCNREWGDKKGLVTLVNLVNENHHSRPYATYIYDNVLIEETKKALSGLEMIEEKEIFHLAEKYYVGLKSHGSDESQKLLDCIKELRYREAFECGKDDKNSGVFELIRQDFNTVDVFIEIDDDATEVWQEYQSIKKIKDRFERKRKFNQFKKDLYMYVLSLPEFAVRKQVDIDEKDITFINREMVFNTYDKDTGFMRDLEKDYFF

SEQ ID NO: 12294 - protein, 809 aa, Methanobacterium sp. MB1
MELLAKREVKDKKEFFQTLEGHTIDSLKILKAYIEHNHNVITQFCKKWNLDKELFLKNLFISIYLHDIGKLTEQFQDNISRGKSSQKYPHAYYSFFLLNNVKYTQLLDIPIEKLAVLGHHTQLHSTIYDNDENFGKPKLLNKDITKFFENSINTYKEMDFEKYFKFDGLNINDETIEFKSTRARRLLKKTIKTVPKFGQKVRLKSIFTYFFSILQLCDDYSSANFSKFIERYNGNIKLFDSVIENPREYVPKLNINNPMDVVLGNHDPHDFQSELFEKSPKFSVLFAPCGRGKTEASLLWALKSMENYDRNKIVFALPTQVTSNAMWERLCKMFGKGETDKEKIKDGLKYVGLFHGKSFIKLKSEFMKEKEDLSKEDTEEIQGDVFKGNVFFKPITVTTIDHLIYSFVHGFRQADFALGNLQNATIIFDEVHYYEKHTLNHLTTLFRLLKKFDIPHLLMSGTLPDFIRDELENYVEVIDKEGIEYTPFSFNLSDENIVKIPKNEEPPLINQKVLQEIINNYNLGLKQFVILNTIKRAQEFYKTLQKSLEENCDDPNLILYHSQFIYKDRVKKESEIKKRAKKGPFVLIATQVIEISLDISCDVMYTEIAPPDAIGQRGGRLNRKGKSCCTDGTIHEMKIFAPESYLPYDEGLLEKTKNNLLNGPTSYNNIKKLCDEIYSDYKLEKTNLEQIFKECTLFGYKPSEIAFGDDEGRLLQIREEKVQKIDAIPCKFYKNEEKNLNVENQVQIPLWWYHNDQKEHGEDLEYFDITSKVVGKKERYYMICKIDYNNKIGFNFGKKAQCTSNDNIF

SEQ ID NO: 12295 - protein, 601 aa, Zygosaccharomyces bailii ISA1307
MFAARFDPSKKELPVEHTVVPLKRAADSEEESDEENEDSVDESDKENEEEEDEKSKQLEQLQDNIQEHISSDSDQISRKHGSVLSRFQQTLELQDKLPEADLFAEEEEPESNIHPLEQIPQPAIVKNLHSAEAFGERKSVAWRNTIKIHYDNSMIKPFDSYNDQLQPRLLQNVRRFFSNDTFPIQTVLLDSILPVLNFTVTVTKRNLPRRIGDILVNASTGSGKTLAYSIPIIQALSQRTVNRLRVLVIVPTKLLINQVYDTMSKLAQGTGLIISISKLENSLKEEHQKFKLFEPDILIVTPGRLVDHLTMGSVSMKNLMMLVLDEADHLLNQSFQNWSSELMKNIKTQKIDQMPGNVLKMVFSATLTTNTEKLHGLHLYNPKLFVRDSVKLYNLPDKLQEYNIHVPTAKSLFKPLILLHILDKTKNAKILVFVKSNEASLRLASLLDVMIEQDLGLRHNILSVNSNNTKSENKRLVHEFATSNTSNGNQVLITTDLMSRGIDINDIADVINYDLPISSQQYVHRCGRTARAQEDGNAHNILVGKGERSFWAKIDGDLSRNVSRGTIDASQEDPLIVQVSSEEEEMYKACLEILKNQGSKS

SEQ ID NO: 12296 - protein, 604 aa, Zygosaccharomyces bailii ISA1307
MFAARFDPSKTELLVEHTVVPLKRAADSEEESDEENEMHENSVDESDKEKKEEEDEESKQHEQPQDNIQEHISSDWDQISRKHGSVLSRFQQTLELQDKLPETDLFTEEVEPESNIHPLEQIPQPAIVKNLHSAEAFGERKTVAWRNTIKIHYDNSMIKPFDSYNDQLQPRLLENVRRFFSNDTFPIQTVLLDSILPLLNFAVTVTKRNLPRRIGDILVNASTGSGKTLAYSIPIIQALSQRTVNRLRVLVIVPTKLLINQVYETMSKLAQGTGLIISISKLENSLKEEYQKFKLFEPDILIVTPGRLVDHLTMGSVSMKNLMMLVLDEADHLLNQSFQNWSSELMNNIKTQKKDQMPGNVLKMVFSATLTTNTEKLHGLHLYNPKLFVRDSVKLYDLPDKLQEYNIHVPTAKSLFKPLILLHILDKAKNAKILVFVKSNEASLRLASLLDVMIEKNLGSRHNILSVNSNNTKSENKRLVHEFATSNTSNGNQVLITTDLMSRGIDINDVADVINYDLPISSQQYVHRCGRTARAQEDGNAHNILVGKGERSFWAKIDSDLSRNASRDTIDASQEDPVIVQVSSEEEEMYKACLEILKNQGSRC

SEQ ID NO: 12297 - protein, 775 aa, Candidatus Contendobacter odensis Run_B_J11
MNQTPLFSHYQPTLQLRQHLGQVRAAAQFLLAGHSRQTRERRPETIPVLDALVRGHDLGKGSPAFQSYIGNPVKYRGDAHAKEHSALSAALALLWAKAQGWEALPTLALAQAIAGHHAGFATLDYLENRLCLETDDLLLEQWAGLDRDALEQATGLALNETDGEFEDARRWLFRRQKIGERLRALSLTDAVKFRLWTQFLFSLLLEADKAFLALREEKLRQYFQQPRPVLHSELVDQRLAALTETPLNGLRQQLRERIFSSADQDQRCCTLTLPTGTGKTLLAATWALRQREQLTAKGDPPPRIIIALPFLSIVDQTEQEYRQLLGLDLAHRSQSDQLLASHSLSQREYEIEDKSLGQGYTRFFLDTWRSEIIVTTFDQLLLALFSPRTKHQMRFHALMDAVIILDEVQTLPCQLWDMVDQAFRALTEEGNSRVLLMSATQPALLSGARELAGDATTVAEIFSAFNRYRLIFRHRETRNLDDFIAELLPRLKKWRRVLITLNTRASAKAVWKTVKSTSTIPVFLISADVTPRDRLAKIMLIKARQPCIVVSTQTVEAGVDIDMDVVIRDFAPLDALIQVAGRCNRNNRLGDQGGHVEVVSLQSAKDREYARLIYDPVLLDITREVLANAPETVGEEAVLNLSQHYFSLIKARKNTGAHLTEAFARWEEMPDIHTLLRGREKQESFLVLADGEEWLRDSLEDSLKIADRWERREALRALAGEIQQRTVSVYARRGFHPEDYAEPLGPFWLLRPGYYDSESGLDLRLDEEDPATCIF

SEQ ID NO: 12298 - protein, 1001 aa, Tepidanaerobacter acetatoxydans Re1; identical to SEQ ID NO: 11825

SEQ ID NO: 12299 - protein, 844 aa, Lactobacillus helveticus CIRM-BIA 953; identical to SEQ ID NO: 11799

SEQ ID NO: 12300 - protein, 759 aa, Clostridium tetani 12124569
MEGKLKILDNDTLKLIEEKKAKPDKTIKEHTLELIEVLNLLRDLGYIKNDKIYELVEKACIYHDLGKLNKEFQKRVNGKNIKFNETKEVVHNILSLYFINSKNFENQEDYLKVAHSVLNHHNYCNNFDEMSEKEDLIQNLIDGFKTYKVKRSVKSKLASIVSDIDSIKIKGYLHKCDYSASSGNVAEYPNKFLENGLKDLLMKWRKGNKEATWNELQNFCIKNKDENIIAVAQTGMGKTEAGLLWIGDTKGFFVLPIRTAINAIYDRVRKDILNNKGIDEKIAILHSSSLEYYIRNITGDTNEKEEIDLMNYHKIGKQLSIPINISTMDQIFDFVYKYPGYELKLTTLSYSKIVIDEIQAYGPDLLAYLICGLEKIAELGGRIAILTATLPPYIKDLLQKNIKFIENSTAFTNDMKRHNLKIIDERINSKDIYNKYVENKELNKNNKILVVCNRIKEAQKLYEELKELINNEELHILHSKFIRKDRLKKESEIIEFGKTYDENKNIDKKNGIWISTSIVEASLDIDFDYLFTELQDLNSLFQRLGRCNRKGKKDSSDYNCYIYAEIDTANLINGDKGFIDKRLFDLSKEAIISYDGQISEKQKVSLIDSYLTTENLKGSDYMRKYKEIYNFIKDIPPYEFDLNQIDLRNILSEEIIPSPVYEEFLEEIKEIECKLANENISYYEKIILKDEIRKYTVSVHPNDIRNYERAKQRGEAINYNRVLLSKHKNDYIKVIECEYDKAGYKRIKYNETTRGSNIW

SEQ ID NO: 12301 - protein, 809 aa, Lactobacillus helveticus CIRM-BIA 101
MNEYLAKSLDQSEGNHCETIVEHTNNLLKQYSLLKQAYPDIFQNFWLSQDRFNDMTKQVDIRSKDDWRLLEIACSYHDLGKMNLRFQKKVKAGQSFCKGEIPHALLSITMLPIDELQKHYTKDQIIALIFAIKWHHERNFSEIYEKHYEDEIEALKKEFASFDYSKSSFPIPPQEPAKVDSKYLTGNLSHRLSPNYEPKIYDEFVILKGLLNRIDYAASGHYEIESKSRVCLSQNILQEWHKKNPVADWNELQKYTYDHRNESIVVVGQTGLGKTESALRWLDNSKSFFVLPLKSAINSIYDRISGIVFQNKSHENLALLHSDMMAKALSEKFDDEDNFEEFVNEERSWSKQLSVATLDQIFNFVYHYKNYEPKLATLAYAKVVIDEIQMYSPDLLGYLIYGLGEIQKFGGKFEIMTATLPPFLIDLLESNGLEFKQAPHPFLDPKVNHRHKVKVLHKQINSDDIINLDRHQKTLVVCNTVKSATELYSELKQKGVSDVHLIHSRFIRKDRNEREKEILEFGQKENHSSGIWIGTQVVEASLDIDFDMLITELSELCGLFQRMGRCYRKRNYEGKEPNVYVFDGGDKLTSGIHESKQEYDDKRYHSVVDYHLFEISKRALAQVDGYLTESDKLKLIDENYTTDKLLDENCQLIDKVNDCIDYLNDLTFLDNLKTKEEVVNTFRNINTIDIIPEQVFLENKDKLEAAAKALNNYIRREDFLDQTEYKKQHQILVKEKIKAREVINNYLVGIPLYIINKVSKQDRWIKDKALNEVGYNILPADFNYDSMTGLSYNDNKNKNAEIDDDDNIF

SEQ ID NO: 12302 - protein, 727 aa, Listeria monocytogenes 6179
MHKYLAKSNPEETIQEHTDNLLKNYQRLKKLYPAVEIDWYLLELVCLLHDLGKMNLLFQTKLGNASGKGKEIPHGYLSVAFVPDSKLEEMGYSEDEIKVVYQAIARHHERKYDFSDSEWKKEIIKLEEQWAGFIYSQLGGNAEYSSEVEMLYFYPGSRIFEGNSAADAETFKKYVLLKGLLNRIDFAASGGIDVELENDFLMDSMEVQLAHFKAENPEADWNALQKYMMQHQNENIVVIAETGMGKTEAGLLWLGNNKGFFTLPLRAAINAIYERITKNIVTTNQAERVGLLHSETYSQYLLHEGNAEMDIDEYYTRTRQMSLPITICTLDQLFDFVFRYAGFEHKLATLSYSKVIIDEIQMYSPDLLAYLILGLSYIDKFGGKFCIMTATLPGIVTDLLLENGVDFVQPEEKFVSSRIRHSMEMVHTEIESEFIKPFFNNNRILVICNTISKAKKIYSELKEHFQGEEIHLIHSQFIKRDRSAKEKAIFKDGQKDSTKKCIWVATQVVEASLDIDFDLLFTELSDVNGLFQRMGRCYRNRALDVDTNVYVFDGGAKVCSGIGTFIDKLIFVNSKTILNEHAGVLTEEKKMELVEQVYSTEALSGSEFYNDLIDKLNYVKAFESYLMNKADVRMRFRNINSVSVIPEEVWQDNAEEINSYFVTLRKTSKEISTKEKIIARTNLAEFMVSIPDYLYKKGESVVREINRYESVIEFKCGYSSDVGVFMR

SEQ ID NO: 12303 - protein, 885 aa, Pseudomonas pseudoalcaligenes CECT 5344
MKGFADLSEQARRLWAKSDDGFGHGVLAHLLDVAAVAERMLAHEPPSTLDWAAQALGLEREHVARWVACLVGLHDFGKAIPGFQDKWLAGRQADEALGLAFPDRALGVTDHACASAALLWEHLPKQGIGHLLWIRHVLQAISAHHGYNFNQSEFNRAKPSFEPPAWGEARRQIFAAYWAVLAPQGVPQIEALSQPAVQWLAGLTSVADWIGSNPEWFPLGERHALLAEHHADACARADQALREIGWRAFQPLLTAPATADHLIARIVQRSELTARLLQAQADLLLDGVQGPALLLVEAPMGEGKTELAFLAHLRLQAANQHRGLYVALPTQATGNALFSRALTFLHSFAVGTPLDVQLVHGGAELNEQVLALRGIHGAAGEDVTSSAWFSQRRRPLLSPYGVGTVDQALFATLNVKHHFVRLWGLSNRVVVLDEVHAYDTYTSGLIEALLRWLRAMGSSVVLMSATLPAPRRDALLRAWGVAPESAPELSYPRLLLADDRGLKGDTCDSRPLPPINLQAVPEDIDSLVARACELVGQGGCGALIVNTVDRAQSLYLKLKVELADEVPLLLFHARFPANQRSEQEQAVLARFGDGGARPAKALLIATQVAEQSLDIDFDFMLTDLAPVDLILQRAGRLHRHQRERPEAHRRATLYVAGLAPEGLPDLKSTAWEYVYEPYILGRTWALLSREQALHLPQDIDRLVQAVYDSEDLPADLAEADRAFIEDEAYGSHLGKRQTERMMALNVAIDPEAEPQNAYTQKNRGYEEGEEGLGLPNYTRLGDDSVTLIPVHQVPGGWSLTPSGEAFDPDQPLSNALAKQLHARQLKTSRTALVKHAQVLEARRSFSEHPLLRHLKPLLLTDGCLQLGRLTVRLDDELGLVYQRTS

SEQ ID NO: 12304 - protein, 730 aa, Clostridium bornimense
MKFLAKTIPEVETLREHTDRLLEEFSRLKNIYEDNINDIIRKYIDPSDFWCILNMCCEYHDYGKANKQFQNKLLRILNKEQIENNLEEIPHNFLSPGYLPISFLEYVKERYPDDILYIIIQAIAYHHERNKEPEYTNIKRCIEEDLKKSLLELSESMNKSIKDISSWYVKYISYNERIKASNQYYELYIILKGLLHKIDHAASAHCKIEEVADRGVGEYIEDYMKKNKWIFREPQIFAKENQDENLVIVASTGIGKTETALLWINDSKAFFTLPLRVSINALYSRVKDDIGYDYVGLIHSSALEYLEDNRYENADLLYEESKLLSKKLSFSTIDQIFKYPFKYIGYEKVLATLSYSKVVIDEIQGYSPSIVAVILYAIKQLSEVGGKFLIMTATLPRIYKDKLYEFGIEFKERSFISKIRRHRVSLRNDEIVSAIDEIEEKGKMSKVLVIVNTVDKAIEVYNKLKNKSNVKVLHSLFINEDRSRLEREIKQFTEKENSDNGIWITTQIVEASLDVDFDYLYTEMSTLDSQFQRYGRCYRKRSLDKNQSNIFIYIKNISGAGSIYDKDILEKSINALYEYDDKVIEEDVKVKMVDKIYSKEMLMGTDYYKEFINACRYLENVIPYETTSKEAQKILRDITSIKVIPEDIYNENIELIENFKNSYGDKRRELSNKIGKISVSIPLYKINKFKGINSEIKIIEIEGLSNYSTINVKYSHEVGILLDELNDNIF

SEQ ID NO: 12305 - protein, 901 aa, Plasmodium yoelii yoelii
PDYREIADFDNDILTKLKISKTGECSSINNIKFVYETVNDLNKIDKFIHDEKNFEYYYIPPSIIRKYNEIKIYELYDEQIECLRNAFENEYIESNLNDKKDDIIYDATHVQDINEILNSEFFSAFENFGEKGEMVKCLDNNVMPEHVQEKNMNETQIKNIQNDKEFYKNFLFSMPTGMGKTLIYDIIIIRFILYKGYRVILTLPTVSLINEKYDYYEMLLGNSTVSLNIKKFNSFNFTGYSYSLSTDIALCTYEQANIIINIIIKNNLKSNFIFIIDEIHYINDLQRGFFIESLLTKIKYAQKNYNHIFNLRTYGFSATFSNIDHIGKWLEAKIRRTLDMPYVLDPDHLGYILSEELILKRNVLIFCSTKKQSEKVASFISNVISYYLKNNYFNISIELLEKRKKLINQLNEIKDININILEIEKLIINGIFYHHSELGKNEKDIIENALRNNILFCLCCTTTLSVGVNFNVHTIIIRNIKIGISFLTKDQIIQISGRCGRLKKKNDENNNFTIKPLHSNNKQINDSFYNEIKKDELTNKNNCYIKDYDTNCDGKVIIFLNGKDDVEYLKMLFQDDGEKKTIKSTMENFDLCKFIIELIELNIIKTKKDIIYFFFLYALKFCKYGMETDQIKDKDFPEKYKENILLEIKQIFQYLFDNKLIIIPYEKEQNYYYYIFEKIYNVNLYKIENIFNFNFLNQYININIMIKSNLQEKICLFKNLCNHYKSNNILDQENEKCTIPFITILSIFKDTHINKNIFPNLFVQFIKYLFLININNKQNNFYVYDILEEDDDLTCSEISPYVHSAPTSLDFIFNYSIIHITYVKGFSPDTLLMIFVFCLGSDINLKINFEIYESALLQNNDQINALKIFKYLDLNLDILQKYKMRKNENFKEVSERFLKGE

SEQ ID NO: 12306 - protein, 727 aa, Listeria monocytogenes str. 1/2a F6854; identical to SEQ ID NO: 11873

SEQ ID NO: 12307 - protein, 723 aa, Pseudooceanicola batsensis HTCC2597
MSSAFDKLARPVQKWIRQKGWRELRDIQARSIRTIYETNADLIVAASTAGGKTEAAFLPLISQVLDAPSGGTGFDLLYIGPLKALITDQAMRLEGMCQEAELPVVPWHGDVSQSIKTRALKSPKGILLITPESLEALFIRRGLEIARLFGATRAVVIDELHTVLDSERGVQLRSLLTRLELAIKRPIRRIGLSATLGDMDLAKAYLRPDAASSVQLIEADGGEAELKLQLRGYLSGDEDENSPSATDAIAAHLFKHLRGSDNLVFAGARQRVEIYADRLRELCEREHLPQEFYPHHASLSREHRDFVERRLKDPAKPTTAVCTSTLELGIDIGDVTCVAQIGAPFSVAALRQRLGRSGRREGQPAILRQYAVEAKLAPESSFVDRLRLGLIRSIAMIDLLLEGWCEPPKPQALHLSTLVHQILSVIAQRGGATASVVYNVLCREGPFRKVTTEIFADVLRAIGNPETGLIEQAGSGLLLLGQTGEKLVEHYSFYAVFQTPEEFRLVAEGRDLGTLPIDNVLAPGMLLIFSGRRWMVQEIHDREKVIVVKPAKAGVPPVFGGDAGDIHDKVIDRMFAVLEGNASPAYMDTVSLMMLEEARAHYEQLGFRANNIHSIGEHTLVIATRVGTVKTSTLALALRSEGFSVEQHDGFLLLEAGDETPDLQTVLVHIRSGEPVDLFSGAGNLMSEKFHPYLSLPLLELDALSSRLEPDTLTAMVGRIFPA

SEQ ID NO: 12308 - protein, 727 aa, Rhodobacterales bacterium HTCC2654
MSNAFDKLARPVQKWIRQQGWRELRDIQARSIRTICETDADLIVAASTAGGKTEAAFLPLISQVLDEPFGGIGFDLLYIGPLKALITDQAMRLEGICQEAELPVVPWHGDVSQSIKTRALKSPKGILLITPESLEALFIRRGLEISRLFGATRAVVIDELHTVLDSERGVQLRSLLTRLELTIKRPLRRIGLSATLGDMDLAKAYLRPDAANAVQLIEADGGEAELRLQLRGYVSGDEDENSPSATDAIAAHLFKHLRGSDNLVFAGARQRVEIYADRLRELCEREHLPQEFYPHHASLSREHRDFVERRLKDAAKPTTAVCTSTLELGIDIGDVTCVAQIGAPFSVAALRQRLGRSGRREGQPAVLRQYAVETQLTPVSSFVDRLRLGLIRSIAMIDLFLEGWCEPPRPQALHLSTLVHQILSVIAQRGGASASVVYRTLCREGPFRKVTTEVFADVLRSIGHTETGLIEQSGSGLLLLGPAGEKLVEHYSFYAVFQTPEEFRLVADGRDLGTLPIDNVLAPGMLLIFSGRRWVVQEIHDREKVIVVKPAKAGVPPVFGGDPGDIHDKVIDRMFAVLEGGTQPAYMDAVSLKMLDEARAHYDQLGFRATNIQALSERTSIIATRVGTVKTSTLALALRSEGFSVEQHDGFLLVEVGDETPDLRALLADIRSGEPVDLFAGAGNLMSEKFHPYLSSALLVLDAESSRLSVRALPDVVAAIVRKGSLN

SEQ ID NO: 12309 - protein, 759 aa, Nitrobacter sp. Nb-311A
MFFAHSLEDQNLDLWQPLAEHLEAVSRLTSQRSEKFGAGRLGAVIGLLHDLGKYSREFQDYISGKGPSPDHATAGACEIRKSEAATSADRLAVLIGAYCIAGHHSGLPNWLGDRALLERLGKRIPTVDPIWQKQVSHDAYSDLLPKLMPYRHKGEVDKSRVAFQLALFGRMLFSCLVDADYRDTEEFYSRAEGERIDREWPNLTAIITDLIDRFDVYMKDLPARAGDMPLSVSRAQILAHARGKAGLPRGVFTLDVPTGGGKTLASLGFALDHTKIHGMDRIVYGIPFTSIIDQTVEIFRNVLGHDVVLAHHSAIEDERQDRRLENEEGERFARDKMRLAMEDWAAPVVITTNVQLFESLFASRTSRCRKLHNLVNSIIILDEAQTIPRPLLRPCVAALDELVRNYGCSVVLCTATQPALGEPRFKGGFNLSKDRELAPDPDKLATELQRVRLVYGGDMDDTALVGALARTEQGLVIVNSRKHALALYWAAESAGLEGIMHLSTRHYAVHRREILEKVRHALKTGAPCRLIATSLIEAGVDIDFPKGWRAEAGLDQIAQAAGRVNRERTRWLDESTLTVFRAPDYPPPPEIRSLSGDMARMMHKHDNLFSPAAIEDFFGEVYWRASPQGLDAKSIFDDFKIGGGIVDFSYRTVGEKFRMIEIGMVPVIVPGDDKASELIEKLSIPQISSGAIARELQPYIVQVPPKARERLIACSRAMFAAPKLRLDQFAVLTDTQLYRQDVGLLWEDADYLSAEELIW

SEQ ID NO: 12310 - protein, 977 aa, Pseudoalteromonas tunicata D2
MMVTFVSQCEKNALSKTRRVLDAFANRIGDNTWQTLITEDGLLTVKKMLRKTASRSTAVSCHWIRSRSRSQLLWVVGNRLKFNEQGIVPVNRTEKEVYMDVITDKPKSGVLYANTKLQPLAEHLFAVGYFAEQLHKNLFPDSPQFSMVNFVAGCLHDVGKIDPKFQEWVTNPKKKSFIADDGQHIDDSKFSFEKHPRHNEVSLLLYHLLDSVELKIINPSNKESIKHAIYWHHAKPYRKDKSSFSTYKDIGKKLIANQKGLLLNDILGQVHALLNQVMGIDKKYRSATSSILSKAVNNEIVLEHEFTISSSLHTPSYKEYELEESVSANRANVKINALNNIARACVITADRIISTMSAAELHEAIMQQTLDEKVRELLEVESTLSSNIEACLSAFYPNSERSIKQSDIAKQLTNAEDVAVLAGTAGCGKTKIALEWAKLQGAKRIIWVCPRVQVCQGLFYELTSEQYLPNSTIEINTGEFKFHNHWDNPIPEGENFSGDVVITTIDQILGSVISHTNANTLIDFLNNHVVFDEFHEYVNMPAFNLLFAELIAAKKVKEQQANTLLVSATPHYAFVEDLLGIHPDDIIEMPSFNQSNYQLNFKIFDDTKLDNSNPLFTPQSDCTFVISNMALTAQNGFITNQHIENAVLLHSKFIKSDKQKWFEEVFESYRRGGTRKFEVLRSGPIVQASLNISCDYMIAEITNAEDCLQRLGRLDRFGENEKVNIYTLAVPESIAASKGNSPASRFLAKLYVLKSVREWYQFLLNSLQDKPFNLPEIYRLYKDFHHLENTKKYIESDLVAALKASVMKINGKIIDPIVVPPKKNKEKKRSKISKGSLRGDNRFVQMAVVDLSQSEYQYIEQYAYTMPLDDESDIDNLTYSTNAILGYGQSDKDLLSHMFKKHHNIMGGTKSYNDNALLNEARDPESPIYLSYTTNDLLPVGGESARHPHAIYYAVCDKQPIGAMSIKQINQTTEDEE

SEQ ID NO: 12311 - protein, 730 aa, Coccidioides immitis RS
MDAFKLLTRSIKLKGSQLGSSSISSHLPSAGEANNPQLFPASEADKTRGTKRKRESGEDTELPNEIPVPDFFGSGSTAAESPKAQRKRVTGKDADAEGQHGEETSMPEEERKSILKSHKIKMTDLRTPPFRAVDTDISGKKSKRKKKKVEEPPPLTRKQLKAAQRLYPEPLTSFDKLRTRYHISRRLSDNIASQGYTVPTEVQLGSLPLLLGNAPAPNERTADDESLRSQSEREPDLLVVAPTGSGKTLSFMIPLINKIMKHHHDNPGLKEILAIVVAPTKELVAQIVNEGRKLTAGTGVKVSAVRKGMRIVEERGQETRSLEEENDGDDSTASSDEEIHSSEGEKSKDIPLTKSDILVCTPLVLANALSDGGKRDVAPLPSVQKLVLDEADVLLDPLFREQTLSIWRACTHPQLRVGLWSATMGSNIEELTKSTIKERQELLGLKDESSLIRLVVGLKDTAIPNISHKLVYAATEQGKLLGLRQLLHPTSTSSSTTHLRPPFLIFTQTIARAIALHSELMYDIPAEAGGSSRIAVLHSELSDSKRSDVMAGFRKGEIWVLITTDLLARGVDFRGINGVVNYDIPNSSASYVHRVGRTGRAGREGGVAVTFYTKEDIPYVKNIANVISASENLRGTEEGERIPKWLLDALPSLSKNDKKDLKKYGVKARRPSTISDKTTSKKTRISTKSGFDRRMDNKRKGAIKGSQRRKAREQLNDEESEDDVWNGIDD

SEQ ID NO: 12312 - protein, 1003 aa, Coccidioides immitis RS
MAREDSPKRRKLDPDRYASSSPQPRAPRHVFKRQRRDNNGLSTPRGSHNGSSTPHQHEFDGPEPLVNYEDAMALDRDWYAGDEFGHTFGDETHNPFGGPDNSWKDMQREAALSEKKNNRRFNARAVQKQKDVDAWETNRMLTSGVAQRRDYEADFEDDEDSTRVHLLVHDLRPPFLDGRTIFTKQLEPVPAVRDPQSDMAVFSRKGSKVVRERRQLKERQKQAQDATNVAGTALGNLMGIKEDEGDSAAAIPGEEDHKGGSKFAQHLKKNEGVSAFSRSKTLREQREFLPAFAVREELLRVVRDNQVVIVVGQTGSGKTTQLTQFLYEDGYGALGMIGCTQPRRVAAMSVAKRVSEEMEVKLGGLVGYAIRFEDCTSNETVIKYMTDGVLLRESLVQPDLDKYSCIIMDEAHERALNTDVLMGLIKKVLARRRDLKLIVTSATMNAERFSKFYGGAPEFFIPGRTFPVDIQYSRSPCEDYVDSAVKQVLAIHVSQGPGDILVFMTGQEDIEATCDLIHERLALLNDPPKISVLPIYSQMPADLQAKIFDKAPPGVRKVIVATNIAETSLTVDGIMYVVDCGFSKLKVYNPRMGMDTLQITPISQANASQRAGRAGRTGPGKAYHLYTELAFKNEFYIQTIPEIQRTNLANTVLLLKSLGVKDLLDFDFMDPPPQDTITTSLFDLWALGAIDNLGDLTPMGRRMSAFPMDPSLAKLLITASEEYECSEEMLTIVSMLSVPSVFYRPKERQEESDAAREKFFVPESDHLTLLHVYTQWKANGYSDGWCVRHFLHPKALRRAKEIREQLSDIMCMQKMTLQSCGTDWDIIRKCICSGYYHQAARVKGIGEYINLRTSVTVQLHPTSALYGLGFLPDYVVYHELILTSKEYMSCVTSVDPRWLADLGGVFYSIKEKGYSARERRVTEHEFNRRMEIEAQMAADRERAALIASQEAEKEKLKRRQEATVGSATVGVRSAVRRPASAAATKTSGSVVRRPPAKRVGRGF

SEQ ID NO: 12313 - protein, 733 aa, Campylobacter concisus 13826
MKESILFDEFWSHPNKLLENHIKNMISPNDDELGKQVKLYHDIAKLKNNFQIYIRDTSNDKLDKNHSLLSAYFFLLNSKFDEIPTLFGFLAIVSHHGNVVNLMTLAREANKFFKNQKELGQWDEVAGAARNIKIYSGLSTKKDELLDRAEKLRQYLVLSQYRHKFTYEDFINFKSLYSNLIYSDKFEAIFGIPKQESKDIPPIDVLESDIQNLPPNKKRDTFRKFVLNNFDENYKLFTLTVPTGYGKTLTALNFALKFNKSRIIYALPFTSIIDQTYDIVAKIYKNSDILVSKAHHKTTIDEENLTDEDRYSKIKFLMESFSGEINVTTLYQLIFALFGNKNKDNVKFNQLKNSVVIIDEAQAIPYNFRKDFILLCEIISQRLGTIFIFMSATMPVIKSENFKEISNLDYFSKQDRYVIKWLDIGGEDELLEKICEAASDKNTLVVVNTIKKAQELFTKLRDKFSCFCLNGYMYDDHKRATIEAVRCAIDKSKVDPLASKILLISTQSIEAGVDLDFDIGFREVAPISSIIQTAGRVNRHFGATRGELYVFPEISKFTNLIYGDLYKVSGAILSDLKQKEVRESEILEISNLYFQKISNQLENLHIKSEIEKLEFENINQKIEDIMNDNYKQTIIIEPEENFIKDFEARIFEIKNSPNEKFTIRDLFKNQIRKLSKFSINVALKDMNKLMPNLKQINGLKDMFYLPFGSSYFYSAECGLKKDTNLDIEDEVFD

SEQ ID NO: 12314 - protein, 791 aa, Thermosinus carboxydivorans Nor1
MLDKGLKQSLGDIWAKSPPGPDETAASLVDHIFAVLAQMGDYIRLYEEELRSVKHIDLPRVLLYAALLHDFGKIHPRFQQQLRGYCRFGLRHEVLSLAFLQYLDIPPFERGYLAAAIVLHHKGWRTLTVGEGSTVAYYNRYVPVDAIAPLAELTADLSQDKIGGLKRLLADSANIIKNVTGLTIKPYDYKPTSAIDLRTAIYQSFQDAETIVLQLKKQNRGHRHAAIDWPKAYIGFLLRGLMIAADHLASAAKVDLQTGFSNVEEVLTALNIKLDNLWEHQRLLAKTEGNAILIAPTGTGKTESALLWAALQRDKNKTCGRVFFLLPYRASMQAMAARLGMVFGKDAVAIIHGKSLIYLYEKLLDQEYSPANALVTAKQQEALNRLNVAFLRVCSPYQLIKSFFAQKGYETIICSALSAQLVFDEIHAYDPKITAMLLVAAQFLCERFNARVLFMSATLPSHLLQSIQKMFPSIRAPVKPAVDWLKQVKRHRISRLPFASLSPETVQHIKAAAKNKSVLAVVNRVDRAIRLANMLRKEISDVVLLHSRFNARDRSRKEKQLAPKPGHVLVATQVVEVSLDIDYDIGFFEPAPLEALLQRMGRVNRHGKQVHPADVYIFSPPEGNVTDDWAKPYDAEHLSQVLQVINDFLGSSHCRIWDESMTQSLLDSSYPETLKRKLADELDRAVYEFDQSFAQQLLPYGLQSADTLKELQAQWDRLFNGVEVLPESLVSEAYSCSNYLEVAQLLVPISIGQLRRLQTLGKVYYDNTLKVSIVQSDYTADLGLTLDAEPD

SEQ ID NO: 12315 - protein, 890 aa, Trichomonas vaginalis G3
MTDEGDLEDAFHIDDFGDEVVTEAKIEEKKAAVVETPKERINMAPSQNAQRDLDNNKWEEDLISQSGVNKSLFVRKIDDDETENKICIQVNAEKPEFLTNQNTSRVYKPFVDKRYNLEGEIYQLAKAGSQSVAEWRKRKEKEQLATDLTKSVNLEKISKGKEIIEAETAGDSQFINHLKDTGKINRAKLPIMDFREKILKVISENSVVIIVGETGSGKTTQLTQFFYEDGYGKFGQIVCTQPRRVAACSIAKRVADEMGVELGGLVGYAIRFEEALSDKTIIKYMTDGILLRESLNEDDLYKYSVIIMDEAHERALNTDVLFGVLKKILSRRSDLKVIVTSATMDASKFSKYFGGAPIFHIQGRTYDVEPFFLRSNPQDYVYEAVRQACSIHLKESPGDILIFMTGQDDVECTCQLIREHLAKIENAPEMAVFPIYSQLPVEQQAKVFENLKIRKCVVATNIAETSLTIDGIRYVIDSGFCKQKSYSSKAGLDTLLVQPISQAAATQRMGRAGRTSEGKCWRLFTETSFKYEMLPMTIPEVQRTNLANVILLLKSLGFDDVLSFDFMDPPPLDNFLHAMNQLWSLRALDNEGKLTKLGKDMVQFPLDPTLSKMLLVGNKFGCLEEILTIVSMLSVSEIFYKPHGREEEADAMRMKFLVPESDHLTMLNVFNLWFNAGLNRPTKKEQEQERAIFAKRHFLHNVTLCKALDIRQQLEDIALQGGMKMSHCGLENWDIVRKVICSSYFHHAAHLKNLSTYYNIQTGVECIVHPTSSLAGLSYIPEYIVYHELVLTKRHYLHGVTAIDPLWLSQMAPEFFTATDLYGNPLEEGKPKPEDLDDFSQSQMKSEVKNEVQKEVKEIQPNQIKPQVVPIPFDKPLELPSSARPKRRKL

SEQ ID NO: 12316 - protein, 769 aa, Microscilla marina ATCC 23134
MDILAKSTPPLTLKQHIDDCLGIHKYLPTLFPAIDKLPGFERFWEVLWLAIVFHDLGKAHQEFQKLLRDKKNEWNRQRHELFSVPFIKAFDIDEAIQEVLMLVVAGHHKNFQVLLTDFIEKTYGADEFSFDDDRETFHEVFYAYVDQPKVKELLHSYAVKITTIQAIDIEGFVRRYKKRPWVSSHPNYWFLLLLFGALKHCDHLGSARVAHLPKLENYDFEFLRHLRIRLQLGGKDFYTHQKLCSRVKGHLILTAPTGSGKTESALLWLKNQLAHTGQGRAFYILPFTASINAMYERLSKDMDTEATKKVGMLHGKLSAYLSHYFEEHQYTTSERKEKIRELREKFKHILTPIKVVTPFQLLKHLFGLRGFEQGVFEWVGSYLIFDEIHAYSPQVAAQIKVLLEFMTQHLHSQVMIMTATLPRFLKQELRQVLGNPQEIEADAALYQSFRRHQVVLQEGLLADNYPLIEGELNAGKKVLVVCNTVKQAQETYQYFAEHSATKILLHGAFNGADRNQKEQRLLKGENTQDASPVVQLLIGTQAIEVSLDIDYDVIYSEPAPIDALIQRFGRVNRQQKKGICRCVVFKQSNKADTYIYNKQVVDKTLEIFERNAVNNQGVINENQLQDFIDEVYPAWDEAGQKEFDKTYGYLKQSLKTLSPLVHSKTKEEEFYRQFDGIKVLPQAQRAQFEEYLKDFDFINAENLKVQVREGKFKGWLDNHLVRTNHFTMSKQGDKDGYIQIDYFETRKKYDPALGLLNDEEITWIDDNQL

SEQ ID NO: 12317 - protein, 735 aa, Microscilla marina ATCC 23134
MLSALFTRQVAREYLATTNLGKFEQELLANYTFTVVKRHHGKLLDFEDELYALGNQEEKRAELAQQIEVFAEEETEEIIRSFAQTLGLSYCLEDFKEYIRSEQYTDELEDFYEDEFGTRYGTWQQLPDEVRMDYFFVHQFMFGSLLLADKTEVILDEERHKQRPNLGNDLVETFRKKKGFDQPVSRINQLKNQAYTQALEGLRQRFSPDQHIYSITLPTGLGKTITSFAVALEIKQMLGQQHRLVVTIPFTSIIDQNFEVYRDILNNESSRVLLKHHHLAEPAYKEIEDDESYRPLDVNKSQFLIETWQSEVVVTTFVQLLNSIYSNHKALVMKLPNLANAIIILDEIQTIPYAYWQLINRSFKAIGRLFNCYFVLMSATQPLIFAPEEEIIELVPDYAQYFRHFNRTRLINRCQMPVSMDDFGQTVAQYLQTHPKRDVLVILNTKKLSKQCFEQLRQLANEANDDLYYLSTLITPYERKQIIRKIKTPAHKRKVVVSTQLIEAGVDISVDTVFRALAPLDAIIQAAGRANRYNEKTIQGEVYLYEIEEMRQATSLIYGQELLQKTRNVLRNIQQIEECHYLSLIEAYFVEVRTQSEVIEQPYLEAIHMLQFEQVGAFSLIEEREGASVFVMINDEAQEAWAKYAEIYNDDSLKKYEQKRAFAQIKTVFYDYVINIHPQHAPEDIDKALHFYVVDPATHSEYYTYKPRQQAQNTGYQIIDASAKKTTNPSLTQNY

SEQ ID NO: 12318 - protein, 762 aa, Marinobacter sp. ELB17
MTEQVNYIAHVKQDSKGSWSEPHLLHEHLEKVAELSARFAEKCQSEGWGFAAGLWHDLGKYRSGFQMYIRDASGFERENAHVEQGAHSPRVTHSTAGAVHAINQWPSIPGYILAYLISGHHAGLPDWSGGRGSLEHRLAEATKEYQESLAAGVPEQLLTAAQPAVPDVARSLKSIALWMRILFSSLVDADFLDTESYMSPEKVGKRNQYPQLDELHSLFFEKMSTLQKNAEQTPLNVIRKSIFEACHREAYEAPGIFSLTVPTGGGKTLASLGFALEHAKQHGKSRIVYAIPFTSIIEQNADVFRGFLGDTAVLEHHSSLDIDQRAENAGSRLAAENWDAPLIVTTNVQLFESLFASRTSRCRKLHNLVNSIIILDEAQQVPRDFHAPITQAMQQMSDHFGVTWVLCTATQPELGQQTDAFDRTLHEGLSNISEIIPDPIGLAQNLKRVEIELPQNVDQPTTWESLAWQVANEACALVIVNKRQDAKTVYELLPDDGDTYHLSANMCAEHRSVALKEIRQKLIARRNGDTTPLRVISTQLIEAGVDVDFPVVFRAMAGLDSIAQAAGRCNREGKMPQPGRVVVFQPETLPPPGFLRQAAQTTLELLKSGQLDDPFSPAAMQAFFTKLNYLGNRDAHGICELLHAKTSPDAPLEIQFREAAKKFRLIDDVGIGVVVPFCPEGHEESPVHIWLAALEKDSSQKWAHRKLQRYSVTLPERLAKQLHSAGALYERAGKFVIETSNYHPVWGMQPPGNLLSAAGSVI

SEQ ID NO: 12319 - protein, 996 aa, Vibrio shilonii AK1
MATLIENAIGKSELIWLNLSDSPMSRNDVYESWCKANFIFKEEDVANRISGLRKPQIGGIFAALGFERSDESGAVTIVMPTGTGKTETILSIVVAGKFKRTLVIVPSDALREQTKGKFVKLGLLRELGLIGEGVANPIVTTIKQGVQSDDMLEQLTNANVIVTTASALTHFSERYLNKLTQKCSHLIVDEAHHVTANSWARIKIKFTGKPVFQFTATPFRSDRSRIEGRIIFNYPLSKAQEDGYFKPIEFHPVREFVEEVADVVIARKAIEILKKDIKSGLDHILMARANTINRAEQVFEIYKNEIDLNPVLLTSKVNQKNEVLASIQSGKHRVIVCANMLGEGFDLPQLKISAVHDPHKSINVMLQFTGRFTRTTENVGNAKFIANIADPKVNDNLDELYREDSDWNSIVSDISARKVDDEKSYQSFKEEFSSPSKLLDLGLTPNISTTVYRMNLAKWQPENFYTFGNKHFQVYDSIINDEQDTLVFSVKSYLSVGWTSSKELYDESWDLYIAYYDIKSGLLFVHSSAKDGLVKRLVGIIAKGAVKVQGEQVFRVLAGLSRLKLQNVGLNKNKKGLRYSMHTGTEINDQIPDIEAKRAIKSNIFGKGFENGGLVSIGCSYKGKVWSMDSDSLDNWVFWCKGIGEKILDDTINTNAVMKTAMQTEELEEFPDIPVLSVEWPVTLLRKDNAKIFISGPSWKEPLTHCELSFAPIQSDSHIVACVVLKTEHGDEVITATLNQRGEVQFTHDNLLELHIGEQCVELAEYLNENPPTFFLADTSVIDGGLRYYLSDDYAYLYDIAHLESWSWSGIDISVESQTEERLKNSIQYNVIQSIIDEYDVVFDDDGSGEIADIVAIRNLEDRELTIDLYHCKYCSKSNGVAKPRARVEDVYQVAGQAVKSVKWFGDKEKLIDRLIERERARLRKNKASRIDKGKIEDLLHLSKVARYASFKFGISIVQPAIAKSKISNEQLSVLGATEAYIQEVSGINLRVIVSP

SEQ ID NO: 12320 - protein, 765 aa, Caminibacter mediatlanticus TB-2
MDNILSHIHPTKSPEKLEEHKSLVKKYLDRIIEFKNIDLDKLADVFEIKDREFVKNLIIEAIILHDEGKCNPAFQYLKMKNEEFRDEYEKLDIKDSNHSFLGAKLFYERFIEEVVREEDIDEAYKKLTFLVVLSFLISKHHSKLDGFSDFVDKLKRNLEGEFAEFNIDKEYIDIKKFVAIKFIFSLLISSDYYATLEYMTNLEIEDFGKIDDSFFKDFEKFEIVKNIRENKKVSGINVLRKEIFLEAENSIDNSNIYYLHAPTGAGKTITSINLALKLNPTKIFYVFPFNTLVEQTKNVIETIFRRNFSVINSITPMDVEEDDENLYTKVYLNRLFYHSPLIITTHINFFDILFGINKEDNFPLWQLYNSVVIIDEIQSYNLNVWWFMAEFFEVFSEVLNVKFIIMSATLPKIDYFLESKNNWKSLIKSEKYFKNPLFKDRVECDFNLLEDEYDENKILEIIKQNRRILVEFITKKSAREFYNFLKENLEGYEIYELSGDDNKLIRDYVIKRSKEAKKIVIVATQVIEAGVDIDLDVGIKDISIIEAEEQFLGRINRNAKSKGIAYFFDKDSSYKVYKDVRIEFSLKDKNLQKDFINKDFEAYYLAILEKLKNKNLEFVGSNSRYNEFLEEIKSLKYKEIKKKMKLIDTKHQTLFFPYDIDVREYKIEVLDFVEGNILSGERVWEEFKNLNSIENFAKKEVLKSKINYLMQFFTYNIPIYLKIDEYNDECCGIYLIRDYEEFFDEEFKFNREKFFKKLNREYDFL

SEQ ID NO: 12321 - protein, 762 aa, Mannheimia haemolytica PHL213; identical to SEQ ID NO: 11977

SEQ ID NO: 12322 - protein, 721 aa, Ruminococcus  gnavus ATCC 29149
MEYIAHIDEKDKKRIQTVKNHLEGTAKLSGEFAGKFGKEDWGYCNGMLHDIGKYSVDFLKRITGESNQRVDHSTAGARVCVEKGGKYRFLEYCIGGHHTGLPDYGSNYDNAGDPTLMGRRKKKISDYQVYQTEIDIPEIVTDPFDFKKTVNLDFSMSVFIRMLYSCLVDADFLDTEAFMSRGKKVRNSGEPVGVLLEKLEKHVSEWLKNQDMDTVNGRRTEILKHCLEEGRSERGLFRLTVPTGGGKTIASLAFALRHAVENQMDRVIYVIPYTSIIEQNAKVFREILGDENVLENHCNIAYEVDSQRAEELQPMQLAAENWDKPVVVTTNVQFFESLFANKPSKCRKLHNIANSVIIFDEAQMLPNDYLKPCIAMIEELLNNYKTSVVLCTATQPALKSFFQSEVLATELCPRMDEQFHFFKRTLFENIGTVTEDCLMNKLTEEYQALCIVNTKKRAQNIYKELKEDGVYHLSTSMYPKHRKRVLNEIRERLGENKKCILISTSLVEAGVDLDFQSVYRELAGVDSMIQAAGRCNREGQRKVEESKVLIFRFEEKENILGQRQQIDVTKSLIADGRNLSDRETITRYFEMLYHIKGESLDKKKIMDEFTNKKIKYRFAQVGKDFRLIEQNTKTVFINCEEEADKILRELKVKGFTRSGMRNATQYCVTVYDQTFDKMYGAGMLKPIAENMEDFYELTDESRYTEEMGLELEIDNGMVLFF

SEQ ID NO: 12323 - protein, 961 aa, Schaalia odontolytica ATCC 17982
MARSFWAKSGDSGSWLSVVQHLMDAADVAGLLFDDYLSEHHRRLMASVWGGDRAKARASFVFLAGVHDAGKVSPQFACQRQDLAQLIRSEGLVVMRKADYAERSFLPHGLVSQFALQEEIAAGGGDGSRALQWAILVGVHHGRYPDAGAVYVARQQYKTQEGSREDDPRWGQVRSEILRWMAARSGFPLVAPGTALPELPIAVASAYASALVIADWLASNEDYFPLRPRPVDEAGKLSIDGYPELTADQQRDRVRRAWKRAAFPTPLRISTTPSDEVTDFYRHRFGWPDTYRPTEAQRAAIEIATGEDPDLMIVEAPPGSGKTELAFAAAEVLMRARGLQGVFVALPTQATTNAMFERVTAWLTSILGDEPQKLGIQLAHGRNSLNESFVKLLARGKSPLEVHDDEEDLGLYASRWMGQRWRSTLSPVVVGTIDQVLLAALKSRHVLVRHIGLMGKVVVIDEVHAADEYMETYLEAALTWLGMYGIPVVLLSATLPPARRLALLNAYRRGCGSSGVSAESVDVMIGYPAISTVSAAGVRVHEVVGEAEVPKRIIPTSLGSPQEIAELLDRELADGGCAVVIRNTVRDAQETYEAVRSVFGREQSTLLHSRFLAVERAARDRRMLELFGKDSQQRPFRHVVVATQVIEQSLDVDFDLMLTDPAPMDLVLQRIGRLHRHERDGRPSGLHDARCLVIIDDTTSSPWTYSRGTDYVYARYAVLRTLAIIADREEILVREPLEYEELTTQAYADDVPVGPAQWHEALDAALEERNKARAQAQAKATTWCLGEANTPSWQAPELEEKFLGNAATGDESKGPGVAAARAAVRDGEDQIPVLVVALDPELGNVPMAPPISGAPEGDTPLAVGEYNARGRIADICSWSISLPPWALRARGQSIDEAVDAVAGAIWDDPITTEWSCREHPFLAGELILAMYKTPDGERLTRDLCGHTFTYSLERGMEVQGQ

SEQ ID NO: 12324 - protein, 805 aa, Bifidobacterium adolescentis L2-32
MVLLARKDEEGNTQALYDHLHGAGRLASGFEDEFADISRTAAVLHDVGKVAQQFQTYLLSDDGHRGDVQHARQGAFVVNVFFESKGEIEEIAKEILELAISKHHGGLPDCIDESGNRAFLLGFTESDKSNEKYAYQEIKRGLNGLALDLQSNFRGSAEDIACFLKKIKSLRLSKDSIYFYLGLLVKLIYSRLVDADRTDAACFETRKQYRPNAVDWQNLISRLDKSMRSFDSSSEINRIRHQINEQCCLAGARETGIYRLSIPTGGGKTLASLNFALHHALKTGKRRIIYVIPYLSITTQTAKTFRDVLGLNSDSDVLLEHYSTAGMQRSADVADNASSEFEDAGEHQRKLAAERWDNPIIVTTMVEFLETVMSARGTKLRKFHNMADSVIIFDEIQSLPMNTINLFNEIVSFLSKITNSTILLCSATQPLLEKTKRENLLLSEKPDLIAETESYEDKLRRTRIVASAENKSCDELGQIIYQQARKSGNCLAIVNLKKEAREIFQCLERLDVNHEFELIHLSTAMCGRHRTDCLNRIGALLDPGNPKPVICVSTQLIEAGVDISFACVVRAMAGLDSIMQAAGRCNRNGESVEPKNVYVYPLKDEDSMERYLPDIAMGKQLTLQIMENYPGKDLLSSNILEQYYDMLLRKKDGNGKGGYTDCPIRGRAEGATTAYDLLSFNECDRSQFTNTTGGKYGLCFAQAFQTVSDNFHVIPDVTHNVVVPYGQATELLDMLHRGELPEKISVLRRLQEYTVSLFDDDYRGLARKHAISLANEDFGVFLLNEEYYNDKYGVVREAEMPLLLM

SEQ ID NO: 12325 - protein, 750 aa, Parabacteroides merdae ATCC 43184
MDSRKLLYEMMKEQDFIAHVRVEEDAFRIQTVKEHSVGTATLSESFASVFGAAAWGKQNGWWHDMGKYTKNSFQPYIRNASGMAVEQKVVDKPDHSSAGAILAREKLPGYYPPLAYCIAGHHSGLLDWTSSGEANLNRRLSKTDCYQEMLKDAPEEMQEVVASLDQPLIDDFEKDIHQWIRMLFSCLVDADYLDTERFMHPEQAARRGQYDSMETLKDRFDVYMESLTANAPASFINEKRAAILSRCRKMAESLPGFFSLTVPTGGGKTLASMAWALLHAVRYKKKRIIIVIPYTSIIVQTAAVLRDIFGAENVVEHHSNLQQDSNDERSPSLLATENWDAPIIVTTNVQFFESLYACRTSRCRKLHNICNSVVILDEAQMLPVEFLHPILDVLQSLQASFKASILFTTATLPVFSGRIGTGPGAFDGLKTPVTEITSVHDNLFEAFKRVELHWPEPGTTTNFDELADELSGYDCVLCIVNTRKDARELYRRMPEGTLHLSRMMCSAHIMEVIKLIKQKLKDNEPVRVISTQLVEAGVDIDFPVVYRAFAGLDSIIQAAGRCNREGKLNHVGKLGQVFVFNLENTLLRGLMGKGAAALREILSVSDGSDLFSPECMAQYFSLFYSNCNTFDKANIKGLLYKGFAEMHFMFATAAEKFRLIDDKDSVSILVGYGDGATLLEELKRIGPEFWLLRKLQQYSVSIRKWDFEQLCKQGTVGVYAGIFILEDGRCYDERAGLVLDGAWVEELLLM

SEQ ID NO: 12326 - protein, 789 aa, Clostridium sp. L2-50
MEYYAKSNDTKKEVKNVNDIRNILIYLLGSQMDKLNENESKMIISYLDSLKQQTVQEQKTLREHEKDIVNCAGKFFEIFDMYFTEKEKNLVLEACRVHDLGKANYIFQTIVNPQLTRMAERQIPHGFLSALSLSEKQVKQEIPECTGDDFSVLLTAVYYHHDRKDSFSDKDFYDYYDKWYKKYLQEYLGKEDVKFSAANRNQLLYSNNPTMKLRSVDEQTWCEYMLIKGLLNKFDWTVSAGYEEAELHSDIAEKKLCSTIRDYFSNSLRELQVFMQEHSDDNVVVIAPTGSGKTEAALLWANGEKGFYTLPLKVSSNAIYSRIKDRYMYKDVALLHSDSLSSYFDGTDGQFTDGNTRYEQAKLFSYPLTVCTVDQLFKFVYKAPGTEIFAATLKYSKLIIDEIQSYSPKIVAALIYGLSELKQMEGKFAIITATFPPVLEFFMRKYRLIKDRDYIFIDFSATMGTDRHKIALFHEEFDFDRIAEDGYKKKVLVICNTVSKAQKVYEELSQRTDEVFLLHSRYIRKHRDQLEKMIMDFSSNDEMTGIWVTTQIVEASLDIDFDVLYTEMCTADSLLQRMGRCNRAGKKDITDANVLIYVNYSGCMKNGKGIYDSDIYDRSVQLLEAYNGKLFSEKDKVQYMNEVYDVDALKNTAYFQMIKRNLAKFKSLQPLDYTSKKDIDEDFRGIKSITVIPDRIYQENQYLIEAITSVLDTPYVDSNIRRILKAKLADITLNLNLYSDRRKLDGVDLNCINDRLDIHRTCLLYDFDEMTGRGMGLSLTKYDDEWNFI

SEQ ID NO: 12327 - protein, 725 aa, Clostridium  bolteae ATCC BAA-613
MQYYAHISEDKTRKQTVKDHLTGTARRSELFAEAFRCGAWGYGCGVLHDIGKYSQGFRKRLEGGSITDHATAGAQEMMRLYAGSNPLAAYCAAYCISGHHSGLLDGGRTGDTAGEATLQGRLKKQLEDYSPYKNEVEMPDFPGLPLRQIGKGGFGLSFFIRMLFSCLVDGDYLDTEQFMLGQDAGRGDYDCMDVLLRRLESHVESWLSNDDLTSVNGRRTAILKACLQAGRRRQGLYQLTVPTGGGKTVSSLGFALRHAAEHGLERIIYVIPYTSIIEQNAQVFKEILGKKNVLENHCNVTYEDKESGKELKMEQLAAENWDKPVVVTTNVRFFESLYACRSSECRKLHNIANSVIIFDEAQMLPVKYLMPCIRAISELICNYHCTAVICTATQPSLQPFFPAKMQELKAEELCPDVKGQYDFFKRTKIQLAGRISQEHLVKELEGRQQVLCILNSRKRVQRVYDSIDSRGTYHLSTLMYPKHRKEILKGIRSRLSSGEPCRLISTSLVEAGVDFDFPAVYRELAGIDSVIQAAGRCNREGKRDPEECMTQVFTLEEEEDIHIPRELKLPISVAGQIAQKYEDISSPEAIGEYFTRLYRYKGEGLDAKDVVEQFEQGSRSFMFPFASAASGFRLIESNTRTILIDTEPEAAQIAMQIRQGGHSRELIRQAGQYCVNVYEHDFEALSGAGRLEQIDREFYVLRNKEQYTRERGLVIDVSRGDALMF

SEQ ID NO: 12328 - protein, 918 aa, Faecalibacterium prausnitzii M21/2
MLGTRKAHTGKGAKMRWTLNKTRLLAGKTDPENTSLWLPLWMHLWDTAGIMERLVRQWLPESAKRAMGFEREEALLAHARFLGGIHDIGKATVAFQANILRTLPEARQRLEMLTPLDCPEQNRRESPHARAGEAILLWNDCPGGLASIVGAHHGRPQSCAAVDDQLECWESNYYPKGQKKVWESFWTELLMTVLQDCGFDDTAELYDLDPQEEVLLTGLLIMADWIASNTEYFPLIPVEELGSMEDYPARVDRAWEKLALPFPWEAQPGIADPQEFAVRFGFAPNAVQRAVLEAVDTAAEPGILILEAQMGVGKTEAALAAAEIMASRFGLGGVFFGLPTQATANGIFPRLLGWADTQTEETLPQAIKLAHGMAELNENYLRLQGRGVQLEEDAQEEHRVQVHQWFRGNKQVLLANFVIGTVDQLLLAALAQKHVMLRHLGLAGKVVIIDECHAYDTYMNCYLDRTLEWLGWYKVPVILLSATLPARRRTELVEAYQQKKAAPDAPWETSCGYPLLIWTNGAEVKQTAIPSDAPGQTVQLTTLTEPELPALLRRKLAEGGCAGVIVNTVKKAQKIAQLLRESLPDKEVQLFHAQFLMPDRAARENQLMARIGKGSAPECRNDLIVVGTQVMEQSLDIDLDVLVTELCPMDLLLQRIGRLHRHHRSRPAPLQQACCAVLDTGEDAFDAGSEAVYGQWLLWRTRKFLPRSIRLPEEISPLVQRVYGWEREAPGGAQGEEMRSIYERTQEKMKARAEAYLVPQPETHRLAQLNTLDDWMQNEGARSDPAARAAVRDGDPSVEVLVMQRRADGSIHFLPWQEGGSAVAVDSPPPPETALKIARQKLRLPAVFGKAWKVDGVIRELEADNRSRLAAWQLSPLLHGELILLLDENLTARLAGMELCYDRENGLYYQKEETDEGN

SEQ ID NO: 12329 - protein, 713 aa, Coprococcus eutactus ATCC 27759
MKYIAHINGVSEQSVKDHLIGTARLTAQFADKFGKADWGYCCGLLHDIGKYSKQFQNKIINNTDDKVDHSTAGAKLCMELGGYYQLLSYCIAGHHAGLPDYGNTVIHSSLRYRCEKKKIYDYSSYKYEIEIPELKTDPIILQNLSDADFPLSVFLRMIYSCLVDADFLDTEYFMKNGDVNRNSGENVKILLSKLETHISRWLKNDNTESINGRRTEILKHCLNEGQNEKGYFRLTVPTGGGKTIASLAFALKHAVENDMDRVIYVIPYTSIIEQNAQVFRDILGEQNVLENHCNVDYDGREDFEPMQLASENWDKPIVVTTNVQFFESLFSNKSSKCRKLHNIANSVIIFDEAQMLPTDYLKPCIYMISELVIRYRSSIVLCTATQPALGSLFPENTQFMELCPRMHEQFGYFKRVKYNNIGTISRDKLTSMLKDEDCALCIVNTKRMAQDIYMELCGIGVFHLSTNMYPLHRKIVLKKIRKCLQNGEKCVVVSTSLVEAGVDLDFKHVYRQIAGIDSIIQAAGRCNREGKRNQAESIVNIFDIENCRIPLNQKQQIEVAKSVLCDYEIVDSPECISDYFKRLYHFRGDGLDKKKILGEFVHPEYNYAKVGKEFKIIEQDMATIFVGNTDEAKELMDEIKLKGISKERMRKAGQFCVQVYCGEKSEFQKLYDAGIIRLVSDDVRDFYELTSMEYYSEECGLVCLVDEGDAIFL

SEQ ID NO: 12330 - protein, 773 aa, Hydrogenivirga sp. 128-5-R1-1
MQAKSELYSHPSVFIEDHINRCLELMNFYMEEVPLLDNETKTTIAVSTALHDFGKCTSYFQEYMRALMEGVRPKTDRLKEHAFLSGVYTFYSLKELVDDPHLFLFSFVACKRHHTNPYSFTEETSIIDEDLEFLKKQIESIDEGKANIFLSNLNLPEPVKDAVYFKKREFLDNLPDVLGEIKRLKRDVRKCKTEIKDFVKFQYIFSLILDSDKTEAGAKPFRPERVEKIPPKAVVSFKEKNLKEDSPINRLREEAFREVLEHKIDTSQRLYSITLPTGMGKTLTGFAFALKLRKTIVKETGTVPRIIYSLPFLSIIDQNAEVLERVLEEEFKEVSGRLLLKHHHLSQAGDFGEFEFSVSRVLTEGWNSEVVITTFVQFFEALISCRNSTSRRFNKLANSIVILDEVQSLPTKYWHLLREMIKEVSESLGTYFIFMTATQPYLVEECVELASKERYLKDLDRITAHFDLEEKTIDEFLDGIEFRKDKTYLFIANTIASSKELYEKLRERLEEDICYLSTSVVPYERKERIGRIKKGDYRVVVSTQLVEAGVDIDFDVVYRDFAPLDSLNQSAGRCNRNMARGRGEFRVVRLVDEKGHPFTKGVYDAVLLHITQTLLEDIDSLSEKDFTLLIEDYFKKVWEGMSKDKSEEILEAVKCFRFTGQDVSIRNFRLIDDQPYKRDVFIQLNEEAVEVWERAKTVLKDLRAKKLNVFQAKEEFEKLKSDFYKFVVSVNVRDNQPLLDSDLNMFLVNTEELDRYYDPGTGFISAGGSFIGI

SEQ ID NO: 12331 - protein, 568 aa, Hydrogenivirga sp. 128-5-R1-1
MSHKRILKQPEWEAVKRLEEREGKEFTRFYTLLKGFLLRIDHASSSKHGASVEIKRLRDSEERVKNYLLAKKNSELNDLQKFVLENREDNLLVVASTGYGKTEAGFIFLKDKGFFTIPIRTSANAIFGRAREVFSEEEVGLLHSTAPLFLLENSEDRRNFDKSTIVSDIFLTKNFAKPLIVSTPDQLFPFVFRPKGFEKFLSLFSYSRVVIDEVQLFEPQTLGFLVKAIEKAHQFGGKVMVMTATLPSYVRRDLQGIDLKEGRFITDTVRHNVKLIPMSITSGEGLKLIKSLSERGKALVITNTRTKALELKEALGVGEVLHSWFIQKDRKKKEEEIKDFFDSEEKGLWITTQIAEVSLDLDADFLITELSTADSLLQRMGRENRKGVKPVDEPNVFVFTEECSGIGNVYRKSIHEITKEKLKEGLIDEEWKLGFVEEVYSALEERDREYISKYEEAKRYIDDLWVLREKFFNKREAQEMFRDVLSEVVIPEVFRGEVEPLVEEYLQERDTIRKLELFSEVLGYTFSLPYYREVRLQPVRGLKGIFWASGNYSSETGFVEGEGGGNIL

SEQ ID NO: 12332 - protein, 855 aa, Anaerostipes caccae DSM 14662
MYFDKDVVKIEDLIKQPERYFAHKPKKDDRKKETLKEHTNLAEAYFLKIFEEKNLGHCMEVFEEKYFDQLSWEAKNLFRSMMFGIVTFHDFGKVNPYFQKEKMGHEMPEAKKIFSNSHHSLISAALYFEYFMGKVWELDKNDKKQLKEFLFLNSYLIAKHHSDLDTFEKYLKSFEDEDIYHLIEMLEDQDHLNFYKKPFQCSLKRQRLGKAARNLKKAARDRKSRTRQILFYAYERLAYSLLVASDHYAASEYMSGVQIRHFGGMEHMDEFCRQYYGTELYHGIRKYEQEKYLKEKDLRKEENMNIMRTELFLDAEQELKKHMDQNVFFVEAPTGSGKSNLAVNLSFQLMKQNPGIGKIFYVYPFNTLIEQNLESMEKIFGGSKVMEDIAVVNSMKPIPMDRAKRKTDELQYYQEALLNRQFLNYPMILTTHVSLFDTMFGRRKESTFGFHQLANSVLVLDEIQSYRNSIWTEIILFLKEFASFLNMKIIIMSATLPNLDVLSPGLENAVPLIRNREKFYSHPVFKNRVHADYSLMKKEFTMEDLLDHVLKQQNLKKKILVEFIKKESAYTFFQMLQEDGRLELPTELLTGDQSILERKQVLKKIDTAGKQGMILVSTQVIEAGADIDMDIGYKNWSKLDSEEQFMGRINRSCKKKGAVVYFFEMDDPRHIYRDGDARIENLEYTLANEEMRTILSEKDFQKYYKSVLEVLKQTFMESTGDHGIEAFFATKLGLLDHPEIEKRMQLIQDDMWSMSVYLCRKVEEEDGTVVDGKEIWNKYKKLLMDQKMDYSEKKYKLSEVRSKMNYFTYTIQRTVLMYSDKIGELYMIEDGEKYFQNGRLNKILLEGKDGTPDFL

SEQ ID NO: 12333 - protein, 812 aa, Eubacterium  siraeum DSM 15702
MDHIAHIKNTGGLDNESVTEETVSEHCKKTALLARSYSAPFNMESTVFVSALLHDMGKLNNDFDGYIKQENGIKRGEIDHSYAGAKFLLELVSNDDDKYKKEVARLIARIIISHHGLNDWYTRNNDDYFDYRCSKNERYDEIKSNISELISDSKLDELLNKAADEYRRIFEKMKEICCAKDRKQYFTTLAFYHGLLERLTESCLIDADRTATAEFMEGIEITEPSEDEIRRNWLDMKQRLDNKLSKFSGSDSLISKLRMNISDRCCAFAKNDVGIVQLIVPTGGGKTLSALRFAIEYAVEHKKERIFYISPFMSILEQNGDVIREIAGDDNYLEHHSDMYSKIIDNKHKSKEEVNDELEDYELRCRHWDKQVICTTMVQFFDTLFSSRTEALRRMHRFTDSVIIIDEVQSIPIRCVYLFNLAMNFLSEFMGCTIVLCSATQPTFEQCKYPIMLDKDSSMTGDYTKDFEDFKRTEVVSLLNNQGNTYEEAAVICMDKYRENGNLLFVVNTKTAAAEIFRNVTQLNDEEEIKAKVVHLSTNMCPAHRRKAIDDIRRMLDNNERVICITTQLIEAGVDISFKCVIRSSAGLDNIAQAAGRCNRNGEDDRRNVYIIKLKDEYIEKLGKLKEAQRQCGLIVRKYGCEQLLSVDIMKRYFRDYYEDCACDSNGDMLEYQIRNSNYSLLDLLSCNIIFSNDKGNWKSRQAFKTAGDNFRMIDNNTIDIIVPYNEEASRIIEALNGETTISQALELQRKAQQYIVNVYDYTFKKLAENDALNEIKVRRDEKMYIYALKKEFYNNATGLSTEGKPQEAMFV

SEQ ID NO: 12334 - protein, 807 aa, Clostridium  scindens ATCC 35704
MNDPYIAHFYKDSNNAIHIQSVSEHNLNVAYLAMSNSPLKCLSSVAWVSGALHDAGKYREGVQNYLRRAMNEEQVRRGEEDHSTGGGFLIDKMFPATNLSVLIQMAVFCHHGLHDCFSFEKSTIYIKERLSKKENFQNVEERYYQYLKKEDLEKRGLIAKQEVAGIIQEILGFIRIKNLSKNMYGNRDFFLGMYERTIMSLLVDADRTDTACFMEQRELPAPKSDEMMQDIWGKCITYLEQYLKSMKSESRLDEYRRDISRKCMEAGEREERLYRLTVPTGAGKTLSSLRFGLYHARKYHKRHIIYVAPYQSIIDQNAEEIRRAIHNDEIVLEHHCNVIHDDERERIRYEILTENWDSPIIVTTAVQFLNTLFASGIGNIRRMYSILNSVIIFDEVQALPVKITKLFNLSVNFLTAFGKSTVVLCSATQPLFDELDENRLLPPLSMAGNPKEYAEVFKRTKIIDATKGAGSGFAAEELQEFIWDKAETLKQVLVVVNTKKCAESLYKEIKKKCKGSDYILFHLSTNMCAEHRRDVLKRLEENLENEKKVICISTQLIEAGVNLSFKCVIRSLAGLDNIIQAAGRCNRHGEAGLGYVYVVGISSELENVERLAEIRKMQESMTEVLNQFRKNPEIFDHSLSSEESIRYYYQIYLRKRMPEMEYLVSVNGVDVTLLDLLSTSKTMWESMSESTKKDSKNLLLKQAFKTAGDVFEVIPEDGKVDVVVRYDEKAEKQIAILEDEYATLAEHKKALRRLQPYTVGISEQFRQKLGNAITSVCGGTVYVLSQNYYSRETGVSEEPLGMEFINF

SEQ ID NO: 12335 - protein, 720 aa, Clostridium  spiroforme DSM 1552
MDKKYDVYYAKSINENISIKEHTQMVLDSYHELMKLKKIYFNEKFDKMIELSIKYHDIGKVNTIFQEKMRGHYTNDEIPHGYLSVLAVDFKKIGFSRKEIKEFKIIINSVFYHHRRGEFLKDRIKEFSKAYYEEQLSNYLGDNYYNLSYANLNLIYPRNPTSTITDEEWIEFVIVKGILNRCDWSASGNLAIEIEAEQSMKDNILKRFDLNSVQKFMMENYNENVAIVASTGAGKTEAALLWLNDEKGFFTLPMKVSANAIYQRIKEHYLLPINNQNRVAILHGDCYKLYDNDLANYHNARNLAYPLTVCTIDQIFKFAYKALGTEHLLATLKYSKVIIDELQAYSPDMLATIITALKYIHKIGGKFAIITATLPQFILDELSTCNIKYKRFIGNINNRHKITIHEDDMLNDLDNILDDAKTKKILVICNTVNSAQKLYTKLLELDSNTEIHLLHSRYTKKHRQILEDDVIEFSKSNRTGICVSTQIVEASLDIDFDVLYTYLSSIDSLIQRMGRVYRKRENINQLINVNIYTFKDGIGCVYDKIIYERTLDILKDYHNQMFLEEEKIKCMDRVYDRKELEKTRYMKIYNEKKEYLKDLIALQVEKSEVDNKFRNINSIYILPERFYNLKEVEKLIDCIKSGESQTTKKYELLNNLIDYCIPYTIYKPLKSSDYIDIKSCIKGEAIHRARCKYDFDDKIHKGIGLVINEIDDNELNDKYV

SEQ ID NO: 12336 - protein, 368 aa, Clostridium  spiroforme DSM 1552
MICPRCKNQDPKYFYTFNNTSYCRKCIHIGLANETISNTVKKVNLNADFKLDYQLTPLQEKLSNELLNRYKKHQNTILKAVCGAGKTEITYALIKYALNSGHNVCFTTPRKELVIELAKRFESQFTNVTITCVYGGHTTKTDGQFIICTTHQLYRYPNFFDLLILDEYDAFPYANNEVLKAFLKNSIKGNYVYMSATLLKTPDLSMTKRYHGYPLDIPKCYISNTLLMYIIAVKLILKFKKENKPVLIFVPTIKLTNTAYRYFSVLGIKTKPVSSRTKNIHMLINDLKSGKLDALITTTILERGITISNIQVIILYGDNRIYETATLIQICGRVGRKANFPTGSISIFTPYKTKAIKECIETIKKDNV

SEQ ID NO: 12337 - protein, 761 aa, Clostridium botulinum C str. Eklund
MNNPFLAKTKDRESIIEHTEKLHKNFIKLKNTYPYMLNLNWDLLELACLYHDLGKMNTKFQNKLIKKLNKAELKKGSECKELIQELKDNFLEIEEIAHGYLSPAFLAEEVAEHYCFDERRILYQSIYFHHYREKLKNLEELQKIINEDLSKYIQDFHYKKIGKIEKLNDSFMEYIDRRIPDIEEDSEETIKKYIMTKGLLNKIDYSASADIEVEIKNEDLFEKTSKFLKEGGFKPNKLQEYMINHQDDNNIIRASTGIGKTEAALFWIGNNKGFFTLPLKVSINAIFDRIIEKINFPKEKTGLLHSDTSSEYLKRNNNELNMEQVDRTKQLSLPITVCTLDQLVDFIFKYEGYELKLATLSYSKLVIDEIQMYSPELVGFLIVALKHITEMGGKFSIVTATLPPIFLYFIDKQNIEYNKPDPFYKEVEGKIQLRHRIKVLQEDINIEHIKNNYKNKKVLIIVNTVKQAQKLYDVLNNEIKDETNISLLHSRFIKKHRTIKEEQILELGDLKNKHCGIWITTQVVEASLDIDFDVLYTELSDISGLLQRMGRVYRNRNLVNEDINIFVYTGKDSYPSGISKSERSIIDKDIFELSKKVLINYMGHSDSKTIDEKDKMNLVEEVYSVENLKGGEYFKKIKNIIDKMEDVLAYEYDKKNIDLRNIESTDIIPFSVYEECKEEIEQNLYIIKNSEDFNKRLLAKNKIRELIVSIPTYEFEIANKNARVIMKLELSKYTVIPIVKYDYTFEKGLTRPEFKVEDQFL

SEQ ID NO: 12338 - protein, 484 aa, Clostridium perfringens E str. JGS1987
MKRQQRISSLITIDQIRNWNKGQVVTISAPTGSGKSHFIKNILYLIAKERNQKILFLVHRKRCKQQFYNELDRDKKLDTIDIVTYQTLEKNKKNFDLSKYEYIVCDEFHYFTSDSNFNYKTDISLEKILGQTDKIRIFMSATGDLMTKYIKNIRCIETIEYTIEQDFSWMKLNFFNKKSTINVILDEVIERNEKAIVFIDNVERCYELYKEYKANSLFCCSENNRYYNYVDNEAINYMLEKEKFSENLLITTNVLDAGVNIKDDEIKTIICSIKDVGVLVQCLGRKRRKNNEKVNVYIENFNNQCFGREKSETIKALEMARDLDKIDINEWTDKYSKKDNKLYGTLVYDEGNEKKVNELMKFKLLERNLELFLMTGDKEKKIEGIGYKKYLASKFNTEYETLETYYEHLELEEYLDNIVGKKLYKEEQKELIDKIGLVDGRGRKQKSIGQLNAYLIKNYNKTIINGGRPRVNGKQQTVWIVSDL

SEQ ID NO: 12339 - protein, 820 aa, Bifidobacterium dentium ATCC 27678
MNSKQLLARKDATGAVQTLRDHLHGAGKLARDFEEEFSAISYTAALLHDLGKASEDFQEYLLSAKGHRGSVIHAWQGAFLVDDACALSSEKSAAEQAVQEITREILELAIAKHHGELPDCLDVDGFSTFFDGLATDRKNEIRFSYQEVKDRISYLDLDIAGNYDKSIRDVEHFMQKFNMGGITNSDSFYFYLGLFAKYVYSRLIDADRLDAACFEERRTYRSKSIDWSSLIDRFEKNIRKFDHTSEINKIRNQISEQCRLEGKRSTGIYRLAVPTGGGKTLASLNFALHHAIETNKRRIIYVIPYLSITSQTVKVFREILELDEDDTETLLEHYSSAGGRKDDDTFTNTQSEFDQEEDDEQNAKRKLATERWDSQIIVTTMVRFLETVMSSKSGDLRRFHNMADSIIIFDEIQSLPTNAINLFNEVVSFLSKILGSTIVLCSATQPLLERTSRKNLLLADCPNLIDDSQEYFEKLRRTCVVAATEMKNCDELAEIIYEKAKENGNCLAIVNLKSEARIIYQCLKTLNGDNHFKIIHLSTSMCGQHRTDKLELVRQLTSIDKGKPVICISTQLIEAGVDVSFSCVIRAMAGLDSILQAAGRCNRNGESKSPKKVYVFGIKDEKGLSYLPDIKMGKEITERMVREHPDEDLLSNEMLLEYYQLFFEGIQSGNDNGFGIMDYPIPGKQNLYAYDLLSCNRAARGQYVNSSGTQYLKVYAQAFKTVGNRFRVIPNQNHNVVVPYGRVEKHMERLSRGNLREQFAALRQLQDYSVSLFDNEYRSLDERGAITLENEDFGIYMLNKDYYKEEYGVVTETEMSLLYI

SEQ ID NO: 12340 - protein, 443 aa, Ureaplasma parvum serovar 1 str. ATCC 27813; identical to SEQ ID NO: 11529

SEQ ID NO: 12341 - protein, 443 aa, Ureaplasma parvum serovar 14 str. ATCC 33697; identical to SEQ ID NO: 11529

SEQ ID NO: 12342 - protein, 443 aa, Ureaplasma parvum serovar 6 str. ATCC 27818; identical to SEQ ID NO: 11529

SEQ ID NO: 12343 - protein, 750 aa, Clostridium sporogenes ATCC 15579
MAKTNPRETIIEHTNLLLKGLDTIRNIYPDIKFLDWDILEIACIYHDAGKVNTKFQNKLYKKLGETKLKDDLEYENEIPHGYLSPAFLPKKQLKEKYEDDILRVLYQSIYYHHNREKLDNFDPIKLVVKTDLIKYWQDFQYDKIDKSEKLYPSYKKYLGERIDSGDKVYRNYIITKGLLNKLDYAASGHIDVEVENKDLFDKTYNYLHEGGFEPNELQQYMIDNQDENNIIVASTGIGKTEASLFWIGNNKGFFTLPLRVSINAIYDRVKDNIGFKDVALLHSDTYSEYLKRNIDLETDFYDKTKQLSMPLTICTLDQLIDFIFKYEGYEIKLATLAYSKLIIDEIQMYSPDMIAYLIMALKYITDMGGKFSIVTATMPQIIIDFMKKEEIKFNPPVTYCKKVDNKIQLRHRVTCLDETINIKNILKNYKNKKVLIIVNTVKKAQEIYDNINSELEDSKVNINLFHSRFIKKHRAEKENDILNFGDKDCKDTGIWITTQVVEASLDIDFDVLYTELSDVSGLFQRMGRTYRSRILDIKDSNVFVYLGGDKPTSGVGSGEHSIIDIEIFKLSKSAIKNFKDKELDEEEKMNIIESVYTKENLQKANYYKKIDETIKWVKDIKEYELGKNEARLRNIFNESIIPQSVYEDNKEFVEEALINIKTIKKEIECKKHNISSLKAKIQLEKDKIKNLIVDIPTYEFQKALNADRIVNRVKIDKFNEIAVVAYDYSFERGLTRPKNIDDFDENLQIL

SEQ ID NO: 12344 - protein, 976 aa, Pyrenophora tritici-repentis Pt-1C-BFP
MDRRHSPKRRKIDPEEYSIAPRPKFRKPNQPASSRAHTSRSQEDGDNPKQGSFDGPEPLVEDFDSMALDRDWYGGEENGHTFGDDTHNPFGGSTWLEAQREAALTEKKQNNRASMRAQQKQKDVDAWETNRMLQSGVAQRRRFDDDFDDDEEGTRVHILVHDLKPPFLDGKTVFTKQIDPISAVRDPQSDMAVFSRRGSRVVKEKRQQKERQKHAQEATSAKGTTLGNIMGVKEEDTDSAAPGPEEEKQGGSKFAQHLSKQEGASAFSKSKTLQEQRQYLPAFAVREDLLRVIRDNQVVIVVGQTGSGKTTQLTQFLFEDGYAKQGLIGCTQPRRVAAMSVAKRVSEEMEVKLGGQVGYAIRFEDCTSKETKIKYMTDGVLLRESLVEPDLDKYSCIIMDEAHERALNTDVLMGLLKKVLARRRDLKLIVTSATMNSERFSRFYGGAPEFVIPGRTFPVDINYARSPCEDYVDSAVKQVLAIHVSQGPGDILVFMTGQEDIEITCELVAERLKLLNDPPKLSILPIYSQMPADLQAKIFDRAAPGVRKVIVATNIAETSLTVDGIMYVVDAGFSKLKVYNPKMGMDTLQITPISQANASQRAGRAGRTGPGKCFHLYTERAFRDEFYIQTIPEIQRTNLANTVLLLKSLGVKDLLDFDFMDPPPQDTITTSLFDLWALGALDNIGNLTELGRTMTAFPMDPSLAKLIITATEYECSEEMLTIVAMLSVPSVFYRPKERQEESDAAREKFFVPESDHLTLLHVYTQWKVNNYSDSWCIRHFLHPKALRRAKEIRDQIHDIMTKQKMALVSCGTDWDVIRKCICSGYYHQAAKVKGIGEYINLRTSVTIQLHPTSALYGLGYLPDYVVYHELILTSKEYMSCVTSVDPHWLADLGAVFYSIKEKGYSARDKRIIETEFNRKAELETQMAADKAKEEKRIREEEEGPVVKKAGAVKKVVEDGDGVVKRPVLGKSKFRRR

SEQ ID NO: 12345 - protein, 1434 aa, Drosophila grimshawi; identical to SEQ ID NO: 12032

SEQ ID NO: 12346 - protein, 682 aa, Drosophila virilis
MATFKPKFLKPETDDAIADAGGGQEPQSSAFVFNANHNLGLVEQRERLPIRKYRDQILYCLEHHQVVILVGETGSGKSTQVPQYLYEWGWHSKGMIGITEPRRVSTVTLANRVAQERGELVGDTVGYVVRFLERISSETQIKFMTEGILLRELLADPLLTQYGVIIVDEAHERNMLTDMVLGLLKKILRKRSNLKLIISSATIDASFFSEFFSWPGADSDHPLSVKLSIEGRMHAVSHFYLNEPCADYVRETVETVWKLHQKESLGDILAFLTGQEEVLEALDLLREYIAGAEMTNLKVLPMYGSMTSSDQLAVFFTPPKGVRKVVLATNIAETSITIPGIVYVIDCGYVKVKWYNPATCSDSLVVVPVSKASAVQRAGRAGRVRPGKVYRLYTKQDYDALAPRQPPEMRRSEMSGAVLQLKALGIGNILRFDFPSPPPAKNLLSALETLYALDAIDEQGQLTRPVGFLLAELPFSAMLSKMLYVSGQMGCAEEIITIIAMLQVQSVFSRPASAAAQQSGRIAHRHFEVAEGDLITLLNIYSAFVEEGMTKEFCGQYYLIYRNLKRACELREQLLTLARKKYGIAIFSCKGDVEMLCKCITAGFFTQVAYLHHSGVYRQISSGTELAIHPNSTLYTLPQAQYVVYSELLQTTKLFMNHVTVIKKEWLTELAPHYYQQTTVRD

SEQ ID NO: 12347 - protein, 703 aa, Coleofasciculus chthonoplastes PCC 7420
MNSEFPQTHSIITDQSPQSNIRISRPPRQDGTVQTVKQHLEETGAIAAAVHPLAEIAGKWHDLGKFDPTWQQYLQASMAGNKCKSPGHAIHGAALAWKKGLHGVAFAILGHHSGLPNLGGADGIQQKLKGDQHWQSIQAIAQKELGDNFFTCPSHHPEHPLTEDLLIRIIFSALVDADRESAARFLGDWDTVTPPTIEQLISQFETHYHHLIQNAADTPINAIRRDIYRHCQAAATLKPGFFRLTTPTGGGKTLSVMAFALHHAQNYQQKRIIYCPPFTSIIEQAAQVYRESFSENAVLEHHSGVVFDTHTDELHHYQFAAQRWDYPIIVSTTVQLFESLFSRHPSQCRKVHRITNSVIILDEVQALPTKYLKPIMSMLRGLVDNWNCSVVFCSATQPWYGILDLPEIRDIVPLNQRQSHAKTLQRVEYHYQSQAWDWHDLLQDIRQRSLKNALVVVSAKIDARQGFKVLSELGNTFHLSTNMYAAHRRRVLNQVRDRLNQDLPVYLISTQLIEAGVDIDFTAGYRAIAGLDSIIQTAGRVNRNHKSNHAILTIFELKNQGFPQQDRDKIQITRNLLKAGQSLHDEASCQDYFKSFLANPAVNLDQQEIQKRREGFMFKDIDTHFQMIEDNKVNVIIPLEDTAKQLIELAQKQQRLSQKEWRLLLHYAVGVTPKLADASSQEIFPGLRVWQGDYNPNFGIVTE

SEQ ID NO: 12348 - protein, 715 aa, Ruminococcus  lactaris ATCC 29176
MGYIAHKDGERVQTVKEHLEGTAERAGNFAEKFGKREWGYCCGMLHDIGKYSKEFQKKIQENTNDKVDHATAGAQVCKELGGYYPILSYCIAGHHAGLPDYGNTAISSSLCGRWKKKICDYQDYKDEVEIPDLDTEPITFKEDRNMDFSLGTFIRMLYSCLVDADFLDTESFMKNGDTGRNSGETMVTLQNRLKNHISEWLKNTDADTINGRRTEILSHCIKEGKQKEGIFRLTVPTGGGKTVASLAFALEHAVKNHKDRIIYVIPYTSIIEQNAQVFREILGEENVLENHYNVDYESSEEFKPMQLASENWDKPVVVTTNVQFFESLFANKSSKCRKIHNIANSVVIFDEAQMLPMDYLKPCIAMLQELVDSYSVSIVLCTATQPALDSFFSKNELIKELCPRMEEQFLFFKRVNYQNLGRIREDDLLEKLKKENNALCIVNTKKAAQMIYKELQGEGIYHLSTSMYPKHRKRVLKRIRERLKNNEKCIVISTSLVEAGVDLDFATVYRQIAGLDSMIQAAGRCNREGKRELSESMVYIFDLEESYSVPNQRQQIDVSKGILQDYTDIADLKAIHDYFTRLYHYRGTSLDKKKIMDEFQKMECNFAEVAKEFKLIEENTKTIFINREPEADELLQELRIKGVTRERMRKAGQYCIQVYDNAKSENSFFDRLNGAGMLRPVSEEMQDFYELVDGEQYSEEYGLDFSLEDGMAFFV

SEQ ID NO: 12349 - protein, 728 aa, Aciduliprofundum boonei T469
MVEIIAKTNPIQTLEEHTIATIDVCRNIAETLDVQTKIYRRALLACALHDVGKATENFQKHIRGEKISYSHALASLPISMIIERELIKANVFEEPFIVSTSVVSHHAPLTSRVFDIYKEEKPPKYYVDEILSFLDVISSKIGDAYNLREIAEKYKSMWINKNPYLYLNQVIRTSSHFRKLKNAIWEYATVKALLNSADWIASQNKKEVLVLSKTINEYVKQFMKKQSFVLRKFQEDIQDLKDDILLKAPTGTGKTEALLLWSKNNRVIYLLPTQATSNAMWNRLRRMFGDYAVGITHGRAQLIIRREESLKDNAESENQSWHSKVLFSSVFMRPITVATLDQYLLAALHGRHWENKIFYTSNSDMIIDEVHAYDPYALGLLISTVKLFPPKRLALASATFPKPLVSLFLQELGRFAEVNAEKELWERRRLKVRLEDQNIFSAIDDIVKEAKSGKNILVILNTVANAQKFYREIEYPKKMLLHSRFVFRDREKKEKMLENFGYGKHEKGLILVATQVVEVSLDISFDTLYTEIAPVDALVQRFGRVNRTGEKEIASVRIFLKYGDKSALVYGRDILDFSANLLYAQLSETPTESDFLKINDFLYEEIMNAEKFKNLYEEGKQRVNEFYDILGPYTIDLSDIDMLSKFVTRKTDYITEWVIPIDLWNQEGINLFERGFKWMLPELMVPVPVWWLKEVGYDVISSGIVVAQISYNNETGVDYKRNNLNIIG

SEQ ID NO: 12350 - protein, 838 aa, Streptomyces clavuligerus
MRHPRRSPSRTRCLRGRHLSRTPRCGEGTGPVAPGALTNPPPRASLNDVRAKSTPAEDRERLTTHSRTVHAAVGLIEDRIANAGVLADSPAFWSQVRRAALLHDAGKIAEGFQRQVEPRGIPWGERHEVLSLAYADLLAGAAAWSEDDLTMVATLVATHHRALHNDGGTGHGGKPALSRIYNKETDWEEAFGTSVEDVDGRPVVQVPRFLHRELLAWFCGFLAVDPPSTRPGDPSLAQRARHLLQRLLDTWHHPVRPHRGLLAVLAQGALTLADRSGSAHIGLQTHMPLPYDYLARLPYHPHSHQRQAAETLGHLTLVAPTGSGKTEAGLAWAATQIGTMPGRPRVVWTLPYRASLNAIRRRLSEDLIPVPGERKADIGLLHGTVAQTLLADGLDDDCPGREPNTPPTADQARKARAQAGAMRLFTQRVRVATPHQLLSGAIAGPAYSSVLLEQANCVFVLDELHAYEPRTFGRLCAAMRLWERLGSRFAVLSATLAEVMIRIIEESVEQPVTVHRSPEGSGPVRHRLTLDELPIDAPESVQRIRDWLNEGHSVLAVVNTVARAQELFGQLADDARAARPGDPHAALLLHSRFRNGDRDTIERALLRRHPERRPGDGALRGGLVVATQAVEVSLQLDFDRAAVECAPVEAVAQRAGRVNRRGLHPDGPVEFRVHRVDGPRPYDPDAMDAAWAALRGLVADGATALSEQDIDELLRRAYATEWGKGWEEQARAARDAFAARFLTFTDPFHDRSEFARELSEAFDSTEVLHHDDAEEYRALTRGKAGDPLLASRLLIPLRLGQLRQFDCSFDPYLKVNMTDSAYDPTLGLQPPAARETIL

SEQ ID NO: 12351 - protein, 721 aa, Tyzzerella nexilis DSM 1787; identical to SEQ ID NO: 12322

SEQ ID NO: 12352 - protein, 1045 aa, Bifidobacterium catenulatum DSM 16992 = JCM 1194 = LMG 11043
MENEDVMCDGEIELSDRAKSLWGKTNRVDDTEWLPLYVHMADSAAMAVRIWDTWVPYGTKSIISRDLGNDDDLARKLMIFLAGVHDIGKATPVFQAKPISFGPDAESLAWKPEQAGLPMIAGLRDTSHPTHPIAGQVILERYFSLVHKWGERESRQYACVVGGHHGTPPDKSKLESARLGKTESGLDSEVWTTTQNELIEFIAGTVGIGDEEWKLLSKKRFSAQSAVLATGLVIIADWIASNSDADMFPLVRVHPLWDDDEPFGMTERKYDDIQSWSGLQRRAERAWACVQLPHAWKPANIPSSCQDLFSTRFRLPEGAQPRPVQEQAVRVARDTDARGLLIIEAPMGEGKTEAALAAAEILAQRTGRGGICVALPTMATTDAMFSRVHRWLDALPSCDSTDEKTVWLAHGKAKLNDDFQGIIAASRRHFSSVGQDDTDEPYSRKHGEISPETVVSDWIWGRKKGALANFLVCTVDQVLMGALQMKHVVLRQLAMANKVVIVDECHAYDAYMREYLKMALEWLGSTRTPVILLSATLPESQREEMAKAYLKGWRNSKLELPSEAKRGGIQELKRRQLAAKNEKVYVNEPKLVQERGISSVHKVSSAYPVLTYTSDTEIKHMDVKPSGRSMNVRCQIVDDSDEALISLLDRLLEDGGCVGVICDTVGRAQHAAKLLSDYFGSEYVKLTHSRFMDIDRMSNEAELRQLLGPDSTVGNGERPQRMIVVGTQVLEQSLDIDFDTLVTDIAPVDLIMQRLGRVHRHRRGNNECDRPSLLREAACYIRGIAFWNDNGPEFAKGVDAVYDVASLMESLAVLELTGSSAFCTQCLPKDIARTVRNAYGNDVRSLVPTAWNMQYDKGCEERANKQEKKRADAHSYLIQSVAVMNRKRSLVDWFSPQIDETDDDKGQRAVRDTQDTVEVMLLCKHDGEVCLLPWIGDKRNGIERGAVIPVDTVPCDDVAKVAAQCSVRLPVALCAHGRIDSLIAALEEGCGTEAAYWQESPWLAGKLALFLHEDAEKHLSSDELCGYTISYSRGDGLTYTKKEDN

SEQ ID NO: 12353 - protein, 654 aa, Desulfovibrio piger ATCC 29098
MLWCVAGLVTLADWLGSDEHFFPPDTLLDEDSLRQRAGKAVETIGLGLPPVVQGLDFAKIFSGRAPYPLQAEAAAAIDRPGIHVIEAPMGMGKTEAALWAAYHLLSRGQADGIFFALPTQATSNRMFLRFADFVRRVCPQAVPAQLIHGNSWLQDELKALVCPATPGIEADPCWFNTTRRSLFAPFGVGTVDQALLAVLAVKHFALRRFALAGKVVVIDEVHTYDMYTGTLVRYLCRELEQLGCTVIILSATLTEEARCSLLSLPAGEEGRDIPYPRISGRAASDVLPERCPPSLPDKVVHVMHPGRGEALAQAVELAGQGAQILWVCNTVARAQEDFMELRQRAATRDGGPDVGLLHSRFPFYRREFLEREWMARLGPEGERTKGSILVSTQIVEQSVDLDADVLFSELAPTDMLLQRLGRLWRHPRDGRPVEAPLFCLLREGVPCEEFRHLEAAAIMASLREKAFVYSPYVLLRTLELWEPLEKLTLPSGIRGLMAATYTEKDVPSGWEALYAEDYGRDLADRRLADMGTDIWQVALDDAVALKTRLSADDALMVLARAREGNRIVLLEGGEAAMPSDGRISLAAARRLHRNTVRIPASCLTGKPQDGQLAPYHIDGCLLVGEGVLVAPSLRPGRALYWDEDLGVVIRKEER

SEQ ID NO: 12354 - protein, 749 aa, Thermus aquaticus Y51MC23
MNLLARVNPEEPLSEHLLGVGQLSEGFLAPLGLGLQGRLAGLCHDLGKATPYFQDMLQGKRRKGDPLTWHALPGALFAAWTARRWGLEGDALFLFLAVLEHHGSLSSPWERLPPDLAEGRRPRKGAWDVLPQQLKALDTEAFRALTASLGLPDPGPFLEGEAWEEAERLALEAETLLHQEGRELRDHFRLALLYSALLDADRRLAGQTPPSRPRPIPPGAVEAHLEAKRASGPLGPHRKALFQGVARALEAPLERLFPARLTLTAPTGAGKTLAALRFALGLRERVAKERGYLPKVVYALPYIAIADQVEEEARGVLARAGLDPEAHLLVHHHLALARLREEEAVEEVMALQETWDRDVVVTTFHQVFPALVGPGSGLRPLHALAEGAILILDEVQALPAELWPLLRALLRELPGRVTVVSMTATQPRLVEGEEIAPKLPDYPARVRLAWGEARTLEALAERLLEEPPRPRLVVLNTVREAVDLYRRLRQEGLPHLHLLTSHLMPKHRKARLEAIRKALAAGVPLTLVATQVVEAGVDLDFQEGYRAFAPLESLLQTAGRVNRNALGEGRLWVLDLEGESGKKIYGEVLLDRTRRLLGDLLEGGLEDREAYRLLPEYYRLVEEGISQAKGQKALKALAALDYDRLEGFRLLEEAPSLPIFVEWDEEATQLLRRLEEAFAQKDPKERRKSLRLLLPRLQAYTVSPLLRRALKNLPPPLLGREDWRHVPREAVGDFYDEEVGFLWEMEQFL

SEQ ID NO: 12355 - protein, 753 aa, Campylobacter rectus RM3267
MQISSSFNSHPKKSYNFHVKNISDSFGESDHKETASFHDIAKIAQRFQDYINLEIENFTSKDDFEKARQKLKTTHTLESAFIYFFTRVDKDINFLANFFTILKHHSDLPDLKSFFSELGNIKAKIKDKFKKINEVICRLNLEIRPDVNEFVDYFFDLEAELEKYQILDNYFIFKKRYSRLVLTDKFEAIFSKPYKNVEILSDEKIDLYLNKMEYIIASKQNGSKNKYRTKAKELIFQNFNHNTQKDKFLIKAPTGIGKTFLALNLALQIAKIKGDKRRVITAIPFTSIIDQTHNEYQKIISDQNVLKYHHLTSYKSSKIDKEKDNEDEQEQFMQKVFLADIWHENFIVTTFNQLFYVFFSNHNRDNLKLETLRDSVIIIDEIQNIPRVLLKPISAAFNEFTKRYNIHFILMSATMPHIAAELENFTELSSPVLYERDRDRYELVYKPNLNDFDILKDEILAHKDQSVLCVVNTISKAKKLYEVIKNKSENKDSIYLLTTHQIPLHRVEIIDEIKAKLGNDKKIILIATQLIEAGVDLSFGIGFREFAPFGSIIQAAGRVNREGLSDKPAKVIVFDYLEGKSFPYHDTDLQEDKIKEILSQNIKESEIYNVLESYFESTKNETTSVNLLQYAKNLEFQTLFKKFNENFMPKQDWKVSLFVEQYSGHFSEFLDNRDKLLQSNDDKFKILAEIKDLEKDLGLYTISVGENLLEELKKDYKTTLKDYFGIRILPPGNFYNKFDGFLPKLTIAEEVFD

SEQ ID NO: 12356 - protein, 842 aa, Holdemania filiformis DSM 12042
MLLAHWDGKEHRAQSLKDHSENVARIMEENCFSLGLTSTGRLIGLLHDAGKANPVFQQYMLENQTEKKGKINHSAAGAQILRNLFFGTEFWTMPKKQQQFRILLFQLCSIAILGHHRGLMDIYDPNGNSPFERMLNAEENQLVHDSFFNELNCKEEINQFIEKAQNEIIQLNTRINILVKGHSFEINDDKLKKAKLEEGMFTYGLIERFLFSSLIDSDRLDTACFLDKKNIPVEENRIEIWAELQERLNKELLGLEKLNPSQASSTLNQIRKRVSKSCLNAGNWPSGIYRLQSITGSGKTLASLRLALQHACNFPETKHIIYVIPFLSILLQNSQTIKETLHLEEHSDWILEHYSDFENELINASTDDNLQKQEELQEYELRTERWDSPIIITSLVHFMDTFFSARKKDVRRLHQLSNSVIIFDEIQSIPDNCIGMFNSALNMLEHLTDVKVVLCSATPPLLEKIKHPLQWSQYKDIDTNYSKDMKKIHRVFVTDKTDVQNCFSVERIAELAYEKQQERSNALTIMNTVSGATRVFECLKKKFEQIPERNRPLLILLTTNLCPDHKKRRIQQMINALKENIPVLCVSTSLIEAGVDISFDVVLRACSGLDSLIQAAGRCNRHDHKKLGELIVFYSYEIDFMHESITKNTTVSQLTRKLICSHCLLDKFKKAPEDFENNILSNKALEMYYSRYYEMIQDRVDYPVTSQGFTLYDLNSFCSCWCTEISKAKKSDVNWMMHQAFETAGRYFKVIEDYSIGVLVPYEKGRELIEELNSGNIKFQPDNLRKLKRQAQNYSVNLNESYIRKHKQNFSYFEAADLYCLKEGCYDEEKGVTDFEAQSWII

SEQ ID NO: 12357 - protein, 796 aa, Clostridium  methylpentosum DSM 5476
MNFPAHIKVEEPQKERIQTVEQHCRSCAHYAAAAAPDGLKQLCYLAGLLHDMGKYTEKFKVYITAAARGESVRRGSVNHTFASVRFIFNRWHRDSGQTLHNMTAELLAFACGSHHGQFDCVSLEGKDGYLHRLEAEGVDYEEAIENYLRYCASPEELDRLFEEAEQEVVRAQELLFSCSKTKEEIYFYFSLIARMALSAVIEGDRRDTAEFDQGHALPQQETEPDWDALLSRVEEKLSDFRADSEINRARKHISDLCREAASRGGGIFRLNVPTGGGKTLSGLRYALARAAEGQQRVFFVIPLLSILDQNAKEIRKYLEDPKLILEHHSNVMREKPDKKEIEELDETELVLENWRAPVVITTLVQLLNTLFDGKTSCIRRMTALCGSVIVIDEVQSVPRKMLSQFNLALNFLATFCGATVVLCSATQPCLDQTDHGLRYAEQPELVPYDETLWRVFRRTELTDLRKSLTVEELAAFALERQQEAGSVLVICNTKSEAKRIFEAIRSQYSGLLYHLSTSMCTKHREQTLEGIKDALNPKSPIPVLCVSTQLVEAGVDFSFGCVIRIAAGMDNVVQAAGRCNRSGEFGRICPVYIVRLRGENLGRLPEIRQAQQAAECMLLQFQQNPQKFDCDPTGREAIKTYYQDLYAEMTQGSQDYPLPKLKTSLFQLLSCNGQAEGHCDTASRYLLVQGFRTAGEQFRVFEDNTVDVVTPYGEGKKLIEALGSQFAAWNLEERRKLLRDASRFTISLYEYERKKLADCGGIYSLYGGEILVLQPGFYSDQTGLTSYGDVNLFEEV

SEQ ID NO: 12358 - protein, 664 aa, Neisseria flavescens NRL30031/H210
MAFCIAGHHAGLANGSGEGDNRRTLKQRLALQFGTDIPALDNLWQQEIKLPQNLSAPPLKADAHHPYFSYAFFTRMLYSCLVDADYLDTEAFYLNLENKAVERGGYPDLNALQHNFNQFINAFRRRVSQALAQTEAEKRNAALNRLRSEILEHAVEQAAQPQGLFTLTVPTGGGKTFTSMAFALEHAKLHGMRRVIYVIPFTSIIEQNAAEFRKAFGELGEQAVLEHHSTFDDGKLQNEATKDKLRLASENWDAPIVVTTAVQFFESLFADRSSRCRKLHNIAGSVIILDEAQMLPLNLLLPIMQVIKELAQNYHCSVVMCTATQPAVQAENGFYRGFENMREIAPKSTALFDKLRRTTVQHIGTQTDADLLAKFGKHPQMLVIVNNRRHARSLYDQAKHLDGTFHLTTLMCAKHRSQKLDEIRGRLKKGEPCRVIATSLIEAGVDVDFPLVMRAEAGLDSVAQAAGRCNREGKRPSENSFVWIFSPEDKWKAPPELAAQAAVMRLTADSFSDGLLSTQAVAAYFKDLYDLKGKELDNKQILQMHRNAGQSLDFPFQTIADKFRMIESHLQPLIIPLDVEAENLISSLHHADHIGGLLRKLQPYTVQIPEKALAALYKAGRIEPINEKNFGKQFYTLIGLDLYDEVAGLSWEDMEFLKGESLVL

SEQ ID NO: 12359 - protein, 652 aa, Anaerobutyricum hallii DSM 3353
MDTSKYWAKSDKVTTLVIHNAALREALDKLYELGYIEKEMYELLKIACEYHDLGKINEIFQARMKNKKLHFDLEKEIPHNVLSLFFVDSERVNKINPEDKKNYVRMLFAILYHHYNSDLMRMVSSSKRQLENIFPQDAFPDIQDEIYSLPIGIEEEISEVIGLKDEKAVKMKGLLHKCDYAASGHYPIEFRNDFLLSGLEYLLMQWNNPADQEKQEIQSAEEFALSEQDKNENERATVDWNSLQYFCKEKQNQNIIVVAQTGMGKTEAGLLWIGNHKGFFVLPIRTAINAIYNRLRKDMLVNSDKIDEQVGILHSEQLEYYTKNIEGSDEDIYEYVKRGKQFSLPLNISTLDQLFDFIFQYPGYELKLATLSYSRIVIDEIQMYNAELLAYLIFGLEKIVKMGGKVAILTATLPPFVKELLEQHLNIPKENQEVFIDDKKARHHIKVCDKKINAEDIVKLYLKNKEACKSNPHKGNKILVVCNKIKTAQKIFDDVNELIKAKYDKEEIHIFHSRFIKEDREKLEKEIIEFGQTGNKSENVVEKGGIWITTSVVEASLDIDFDYLVTELQDLCSLLQRMGRCNRKGLKSVFESNCYIYLQIDSADLIGKTKRTGRRGKEKVYGFIDATLYELSKKAISEHEGILTESQKQEML

SEQ ID NO: 12360 - protein, 806 aa, Anaerobutyricum hallii DSM 3353
MELYAKSKAKQLSIKEVEALKETLESFLDSLEGILTPKEEQIIIQQIQKIQNQKEEKQKTLKEHEEDIVKCAEAFFRGYGKYFTEIEKILILQACRQHDWGKANLIFQSKVCQKVRDNLSEPEKKISQIPHGFLSAVSISYKEFQKLYEGLEKDDFKAFMTAIYYHHDRKDDFIQDDIKAYCQKYYLKYLSEYLKEERDKVYSSQMRKLLFRNNMSSIKLDVKPSLWNKYVLLKGMLNKFDYTVSAGYEFAEENSDLEEKRLVNNINKNMKEQKFALKPAQKFMQENVNKNLVVIAPTGSGKTEAALLWLNGEKGFYTLPLKVSANDIYRRIKDDYNYKDVELLHSDAMQKYLEESTNAADSIYQRYEKAKLLSNPLTICTVDQLFKFVYRALGTEIFAATLKYSKVILDEVQSYDPHIIATIVTGLKQITEMGGRFAIITATFPHVLKYFMEKCGLIQGEQYEFRDFSKESDIIRHKVKIKSGEMNFDEILEKGRDKKVLVICNTVTKAQEVYEQIESQLEEKDLHLLHSRYVKKDRLQLEKMIKNFSENEEECGIWITTQIVEASLDIDFDVLYTEMCTVDSLLQRMGRCNRKGRYIPEEPNVIVYDNANGKGTVYYEDMYDRSLEKLYQYEDKIFTEELKTEYINAVYCTEEIKKTKYYEEIEYWLEHFSTIHPIEYTKEDVDKKFRNIHSITVLPDTLYEENQVLFEEGVNLLRKPNINKDIKNIITSKFSSLTLGLTYYRYKDNGLNGIDVTTIGSHGDDRKNNYPVTQIHRTSMKYDFDPDTGRGKGLILGEIDDEACIL

SEQ ID NO: 12361 - protein, 712 aa, Clostridium asparagiforme  DSM 15981
MYKAHISEDKTRSQSVVQHLQGTQKLAGEFAAAFDCREWGDGCGLLHDIGKYSASFKRRIDEGGPITDHATAGAKELYNRGNVFGAYCISGHHSGLLDGGTVGDSAGEATLMGRMKKRLDDYSAFQHEVEIPAFPAPLLKPLGKGGFSAAFFVRMLFSSLVDADYLDTEEFMKEGKTGREPAEPMDILLQRLKQYVAAWLENTDLTTINGRRSRILQACFDKGQAAQGLYQLTVPTGGGKTISSLAFALQHAIRHHLQHIIYVIPYTNIIEQTSQIFRHILGDINVLEDHCNVSYDSPEELKIKQLAAENWDCPVVVTTNVQFFESLFSNRTSKCRKLHNIAKSVIIFDEAQMLPASYLKPCTRVITELVTNYHCTAVLCTATQPSLEAFFPQQLRPVEICPDIQGQYAFFKRTAFQMIGELTEEALVERLNTHGQILCILNSRKRVQSVYKALKGDGTYHLSTFMYPIHRKNLLKKIKTCLENGQNCRVIATSLVEAGVDLDFKMVYRELAGIDSVIQAGGRCNREGKEKPEESRTVVFTLEESEDIHIPGQLKLPITVAGQIARKFEDISSLEAIHEYFERLYHFRGNGLDAQNIVDQFEQASRSMLFPFATVAEQFHLIENETKAILIDKEMRAQEIVESLRNGAHSLQLLREAGQYCVNVYQNDFENLNGAGLLEALDEQIYVLRDRKLYSDEMGLLVNVSRGEAVFA

SEQ ID NO: 12362 - protein, 580 aa, Bifidobacterium pseudocatenulatum DSM 20438 = JCM 1200 = LMG 10505
MKSFDSTSEINKIRQQITEQCRQAGSRETGIYRLSVPTGGGKTLASLNFALHHALETGKRRIIYVIPYLSITSQTVATFRNMLGLDADSNIVLEHYSTAGLQNSGNTGSIGTSEEEDVKERQRKLASERWDNPIIVTTMVEFLETVMSARGTKLRKFHNMANSVIIFDEIQSLPLNIINPFNEVVSFLSTILDSTILLCSATQPLLERTARKNLRLSDEPDLIDNTDGYEEKLKRTRIIASQESKSCEELANIIYEQALRNGNCLSIVNTKSEARKMYQCLQELNADGQFELIHLSTAMCGKHRADQLARIKVLTDPHDSKPVICVSTQLIEAGVDLSFACVVRAMAGLDSIMQAAGRCNRNGESKEIKDVYVYPLQGEERFKDYLPEIHRGKKLTLQIMGEHPDADLLSTGMLNEFYGMLLQSEDRDGGNSLLDGPLWKKENAGKTIYELLAYNESQRKQFENNTMGERYNPFFAQAFKTVGNEYRVIPKITHNVVVPYGNAMELLDMLGHGELREKIAILRRLQEYTVSLFDYEYKILNEKHAISIASEDFDICVLNGDYYKGEYGVVTETDMSLLMI

SEQ ID NO: 12363 - protein, 805 aa, Clostridium  hylemonae DSM 15053
MEDPYIAHFREENGQITVQSVLEHNSNVAFLAEQNSSIEILSPIAGLIGTYHDAGKYLDAFQQYIEKNIEGKKTHRGEVNHSTAGGCLLEQFAAGTMETQMMEFPVYCHHGLSDALSGNGKILIDERLRQRENVQCVSERFYQFHDKQELENKFYESRKKIGEILTALHKYAQSLTQGERSLQKNFFVGMYERILLSLLIDADWSDTACFMENKKIEERIQKNHGRNRIWDECKRYFDVYMSRFSKDSKLSGMRTEILRQCLLQGKTDGTLYRLTVPTGSGKTLSSLGFALNHARVHHKKHIIYVAPYTSILEQNAEEIRKATGNPEIVLEHHSNIFYEGEEEQRRKELLAENWSSPIIVTTAVQFLNTLFSSSSKNIRRMNNICNSVIIFDEIQALPVRTIKLFNLAVNFLTGFGESTVVLCSATQPLLDRIMECSLNRPQNMIEPDKKYEDAFQRTTIHDKTKLTNLGLSAEELGEFILDRAQEEERVLAIVNTKKCAEATYKYLKKKCKDSDYLLFHLSTNMCPQNRQDVLNEIKEKLFEADRKIICVTTQLIEAGVDISFRCVIRSLAGLDSIVQAAGRCNRNKEVENGNVYVIKMSKEAENVSGLRDIVKAQEAMLSVLYQFEMRPSSFNDRLDSGKAIELYYSLYMSSRKEEMSYLVSADGRSDTLLNLLSTNSKVWSAVKRNNKDGHTFLRQAFKTAGDLFEVIPEDGKVDVVVEYDTAAKEQIRILCGQYVTLDEQQQAVRKLQKYTVGISDRMRQQLSNAVTTVCDDKRKILVLSENYYSHETGVSIEPVMEFINY

SEQ ID NO: 12364 - protein, 882 aa, Corynebacterium accolens ATCC 49725
MVDSACAASLVYNSWLSRSVKEFLKAELRVSETDIEVLYVFLAGSHDVGKGVKTFQRLLLDRSDVAHLVHAVSDAGLDIELSASEANMSKLPHGIASGEILAIWLEEQGLTLPKANSVAAVVNAHHGAASGPNKAVRELIQDYPSAWRMVHGELLDAMAQLCGADELARVFAKLPKVSPAAAQMLTGLVVMADWIASNEKAFGLRVQGTQLDRVGRAAELIDLTSPWEPETRLHQDIDEQFRQSFGWPAEFKARQVQQKMVEAARAINEPALIVLEAETGVGKTEAALAAAEVLAARSGAQGIFFAAPTMATANGLLQRTIEWSRNITTDSVRSMYLAHSKNALAKPYTDLKFTEINRYEEEGGNVVASQWMSGRRLGILSNFVVGTVDQVLMMALQQRFSMLRHVGLAGKVVIFDEVHSFDVYSSDYLRSAIEWLGFYGASVIVMSATLPADKRRALVSAYSDGQWPEEEPTGYPLITVATEDEIRSLEVPASPTDLEATISFLAEGEDSLHELLGKWLVDGGCVLIICNTIARAQAAYSELAESYGDCVELHHAGFVAWERVEKEDSLRRQLGPDAHRGAGRPKQKIVVATQVAEQSLDIDADALITDIAPMDLLIQRIGRLHRHARPFSDRPEKLREPQVVIRGLETSSPVPEFESGAEAIYGRAILLSTYAVLPNEIRRPDDIAPLVAAAYDRNFKPPEAWNESWEEAIATRDFEESTAHSASSTFRLPDPWSTNGLDALFARLQDDSADDAEIKGAAQVRDAEPSVEVIPIIETDYGYRPWGWDEEVIEAADIPYKLAFHLASSTVRLPVRMTRYDSDFDAVVNDLEGATPAEWGAHYLLRGQLALPLDEGGETQVGRFVLRYTSQLGIEIMSDGRE

SEQ ID NO: 12365 - protein, 467 aa, Lactobacillus buchneri ATCC 11577
MDIRHISQSKIIDDVLTQVSLARNKGKAYYDLVVTAPTGSGKSLFFQIPGIVLHKEYREITIVITPLQALMKDQADGLSSRGIDFATYINSQISLEERNRRLRKIKNGKYSILYVSPELLLDSKIDKLIGNRRIGLFVVDEAHLVTSWGRDFRVDYWFLGDYLNKLRNGSYYSKTVKRDFPILILTATAVLGGKNDQIGTLIEDLNLRVDENKHMYIGKVRRDQIEFQIHQVEKSEGNTKEDKIEKVVDRIKEFVYKDIKTIIYCPYSSQCATLMLNLRATDEKVRNKIAYYYGSMSSDQKVQNYTSFKNGESTIMIATTAFGMGIDIDDIQAVYHLAPTGGLSEYVQEIGRAARKLDRGYAITDFFKNDLHYARTLWGLGGIRQYQLREIAMQLSNLSQNNKTRNLLVSPESFGHLFDTGDVDQKVKSGLMLLTTDLEERYHFKVITIKNVHSPVYPSIWWHFRTN

SEQ ID NO: 12366 - protein, 894 aa, Corynebacterium glucuronolyticum ATCC 51866
MSDNPPLYLELWAKTINKTGNNGASLYPLLPHLLDTAAVARALYTHWLRPGLQDLVQEQLGPRAVDVVSWICGIHDCGKANPIFQGQLANKKAEEADLWADVRQNIRKSGRCSFDLSDFVRDQCSRRALRRHEQVSALFLSGWETFNTFGEEKWAEIPALGHHGYFDLPFAAPNRDEDHLKHAFREDLDRLGWTDAQCSLNWHLQRALHLSADDLDIECSPTVSVLLSGLTVLADRIASQDSWIAETKRLEETGQLTFTEPLDRWVDTQADRAVDAVDETIGIYRGWKSEEDARADILGSFTPRDAQAVALTCGEGLVTIMAPTGSGKTEAAFLRHSTRDERLVFLLPTMATTNALMKRTQKVFRRQRNVASLAHSSATLEDFYTNSVSVFDDECSGSETGGLFPTSFVRKGLERLLASVTVATVDQALKASLPIKWVHLLLLALANAHVVVDEVHTMDPYQGEFLKNVLYWLGKTRARVTFLTATFPATMMNDFTKAYDAGAGREVPPTDVSFPSLIDGSGAAQELSCGSYNVGFQLEHADKQRIVDKHVEWARNQRNLYPDARIGIICNQVARCQEIASMLRGEGHEVIVLHSSLTALHRSQVSNQLEKLLGPDGTGWGITVVGTQAIEASLDIDLDLMSIDLCPSTSILQRAGRLWRRDDPERVNRVPGASLKTIHILVPHDYASGDHYPYQPALLTRTRQWLENHPSPIAVPDDCQEFVDACTVRLSELDDETDEDVSHDLEYHADVAYRRQTALNRIVKIPDVLEPDQYLSRIGLLSGGPERLDLDFADLTPRLIDRPTRQVITIDATGETPGALLPEKFFTLDLYEPSKNLIRKLLHGSLSISERVSEQFAERLRPPIKSKSVLSRYQILDATGVYDPVTGLRTSLPS

SEQ ID NO: 12367 - protein, 920 aa, Anaerococcus lactolyticus ATCC 51172
MEVMEKFLWAKKNRVKNIPMWLPLQVHLADTREVCGYLYNHWLSQGVRDLLMDSVVTDVEDKDELLLNLCRFLGATHDLGKATPIFQVKKSFNGDFELDNLVLEKLVNAGFKDIDKFSLTKRENIRHNISGQYLLTKFGVNFCVANIIGAHHGRPISEKEADICNSFASSLCQEDKTSSERALFWQNLQKSIFDKALIGCGFSGAEDLPLISQPGQVILAGLLIMADWITSNENYFPLIAIDEVEVSPDRVEIGFKKWLDDRADAWTPHYYFDGIYNERFPFIEKPKDTQKKISKAISNTDEPGIFIIEAPMGIGKTETALIAVEDLAKKTNRTGMFFGLPTQATSNGIFTRVREWLDHIEGEKSLRLIHGKAQLNDEFSKLPKSRNIHGGDEVGVNEWFAGRKVSILDDFTVGTVDQILLVALKQKHLMLRHLGLANKVVVIDEVHAYDAYMSVFLYRALRWLGAYKVPVVILSATLPISKRNALLEAYMIGAELGYDRLPKPEGFEINEAYPLLTYNDGASIKQFADFKKDAGRSYKIIKKSKGESEDLVSLIKENTAQGGVVGVMVNTVRKAQNFARKCIEVFGEDRVELLHSSFISTDRYKKEKNLIETIGKNGNRPDFKIVIGTQVIEQSLDIDFDILITDLAPMDLILQRMGRLHRHKETKRPENLKNPMVYVLNCGGYDFDKGSSFVYSEYILFRTEYYLPERINLPNDISHLVQLVYGDGDLDLDGDLQKLYEKYRDNRDEQIDDKEFRANVYRLDKPLKKIGDKKNLSAWLKNSNKMAESSDVKANAQVRDSSDTIEVIALKACQGGYEFFDKVGTLDPYDNKTAMEIAKRTIKLPNAVYFDKENGYIIDKVIEELEKYYLENLSAWDDQAWLKNSLAIIFDSNNEFRLGDKVLLYDEKYGLSVKKEDKDE

SEQ ID NO: 12368 - protein, 772 aa, Porphyromonas uenonis 60-3
MSNTEQIAHVRALEDGSYETQPLLDHLHGVAELAQSYAERITDYPELGEIGYLLGLLHDLGKYQEGFQRYIRQQSGLDPTLNGWRTPHSPAGARYAYDLKQAGGSQQLLKILSLCIGAHHRGLYNDSEWRGQVVSSSDTKRAVANLVKGLRPEALQLEELLHKASLDKVATMWDKLDEEDYQLLVRMLFSCLVDADFLDTERFMSPDKSLVRQSAKASLEQMRAQLEEYVSHFNREGRINEARAAFLDQCRNHGRTAKRKIYSLTLPTGAGKTVSSMMWALEHAIAQGCERIIYVIPYTSIITQTAQTFRDIFGADQVLEHHSDVDAKERPDEALEYTKLMTENWDVPLVVTTNVQFFESLYAHRVSRCRKLHNICNSVVVFDEVQMFPPRLLNPILRVVESLHYTFRVEPLFCTATLPVFDKDILADSKRIGHEFFFLEERIQEVVPYDAERFAPFDKVRYHWDPLRLSTEELAERLGEHESFLCIVNSRKDAARLYAALQAQDKSGEGLIHLSRRMCSAHIQKRIEEIRHRLKAGEPVRVVSTPLVEAGVDLDFPVVYRAMAGLDSVMQAAGRCNREGRMAEPGEVYIFRLTDGTDIPGEMSWAQGALEDLLDRLTEQGAPQKAEIERYYQAFYNDVDCFDNKKTKEKDKRVSPLLWDVDDDRCEGLRFEYETASENFRYIENQDTPIVIPYGDAGKAIIKKLQSNLPLTRQEYRQMNRLTVGLKRKDCLTLEGNTSVNESGIAYLTNDKLYSSETGIQIIDQTSTFLKV

SEQ ID NO: 12369 - protein, 374 aa, Bacillus cereus m1550
MGRVSECTVLVRGIAERKREKNSNLLQWNGTLSTGQNLAAQGVIEAIKQKESFFIWAVCGAGKTEMLFYGINEALQKGERVCIATPRTDVVLELAPRLQEVFPYIKVVALYGGSVDKEKDAVLVVATTHQLLRYYRAFHVIVVDEIDAFPYCADQMLQYAVKQAMKEKAARIYLTATPDETWKRKFRKGEQKGVIVSGRYHRHPLPVPLFCWCGNWKKSLNRERIPRVLLQWLKMHLNKKYPVFLFVPHVRYIEEISSLLKSLHNKVEGVHAEDPMRKEKVAAFRKGEIPLLVTTTILERGVTVKNLQVAVLGAEEEIFSESALVQIAGRAGRSFEAPYGEVIYFHYGKTKAMVRAKKHIQGMNKNAKEQGLID

SEQ ID NO: 12370 - protein, 374 aa, Bacillus cereus Rock3-29
MGRVSECAVLVRGIAEKEGEMDVNPLQWKGNLSTGQELAAQGVMEAVKQKESFFIWAVCGAGKTEMLFYGIAEALQKGERVCIATPRTDVVLELAPRLKEVFPNINVAALYGGSLDREKDAALVVATTHQLLRYYRAFHVMIVDEIDAFPYHADQMLQYAVKQAMKEKAACIYLTATPDEEWKRNLRKGKQKGIVVSGRYHRHPLPVPKFCCCGNWKKSLINKRIPQVLLQWLKVYLNKKHPIFLFVPHVRYIEKMSRLLKLLDDRVAGVHAEDPMRKEKVAAFRKGEIPLLVTTTILERGVTVKNLQVAVLGTEEEIFSESALVQIAGRVGRSFEEPYGEVIYFHYGKTEAMVRAKKHIRSMNKNAKEQGLID

SEQ ID NO: 12371 - protein, 374 aa, Bacillus cereus AH676
MGRVSECTVLVRGIAERKREKNSNLLQWNGTLSTGQNLVAQGVIEAIKQKESFFIWAVCGAGKTEMLFYGINEALQKGERVCIATPRTDVVLELAPRLQEVFPYIKVVALYGGSVDKEKDAVLVVATTHQLLRYYRAFHVIVVDEIDAFPYCADQMLQYAVKQAMKEKAARIYLTATPDETWKRKFRKGEQKGVIVSGRYHRHPLPVPLFCWCGNWKKSLNRERIPRVLLQWLKMYLNKKYPVFLFVPHVRYIEEISSLLKSLHNKVEGVHAEDPMRKEKVAAFRKGEIPLLVTTTILERGVTVKNLQVAVLGAEEEIFSESALVQIAGRAGRSFEAPYGEVIYFHYGKTEAMVRAKKHIQGMNKNAKEQGLID

SEQ ID NO: 12372 - protein, 696 aa, Bacillus thuringiensis Bt407; identical to SEQ ID NO: 11934

SEQ ID NO: 12373 - protein, 750 aa, Porphyromonas endodontalis ATCC 35406
MEGKIQPLGNHAEEVARRCSKFCTQIDPKWGNVGTLLGLLHDHGKYQKSFQRYIRHSSGLADQGPARAPHSMAGAIHAHSLFKDRNKTLAQILAYCIGGHHRGLYDSAELENALKTADNKAYYQDMLRNAPQAATDLEKRIAQLGTLPNIMEIEEEDRPFFVRMLFSALIDADHLDTEAFMNKEKALLRNESKKIDVSWSTLRDRLKEKTDSFAKDSPLNHARAEFLQKCRIHGSSHDPSIYSLFLPTGGGKTLSSMAWALESAIRNDSSRIIYVIPYTSIITQTAEIFKQIFGEEYVLEHHSELDMGDNEEYDRWKLLTENWDAPIIITTNVQMFESLYASRTSRCRKLHNICNSVIVFDEVQMFPSALLNPMLRAVESLSLCFNANILLCTATQPVFTQSFEVAGRESSNFYSIQIEIEDVVLYDKELFSAFERVRYHTFKEKKKIAILAKELHQQRTALCITNTRADAGKLYDEVVALGRNKEEIVHLSRMMCSLHIRKQIAYIRERLSAGLPIIVISTQLIEAGVDIDFPVVYRAHSGLDSIIQAGGRCNREGRLSSGDVYIFDLEDGSKPWGEAKQGQQASILIYKKIKDDVLNPNDPELIRQYYLEYYGNQVNSFDKRHIEDYLWSYQAKQDLEWDFETASKKFRLIENEDITDIYVPYGQEGEELISKLSQRVLLNRKEFRILQKLRVGVRKKDFETLHSQGVLKEVRLGQLPIWVLTYGYPCYDEARGLKCEDIWTDEIVII

SEQ ID NO: 12374 - protein, 705 aa, Porphyromonas endodontalis ATCC 35406
MFDHILAKSNGITLQQHLEDVAKIAVCIAQNVGLDPEIARMGAHLHDIGKASPIFQERLKQKNLPPCALVFRHEIASLFFLSLIEDVEKRQTITRMIIAHHKSVCEDIGDKGFLDLDDIESECFSYHSKDFELWSKEALGILKELGWQVRPISIEEAEENYDDALEYCSDLTPNCSRWKGLLMAADHLASALEDYTDTALQKLFIKPDLSYYSSRQSPLYPLSQISSDDPRIHTLVTAPTGAGKTDFLLRRCEGRVFYTLPFQASINAMYDRVKQDLKGSEAQIYPLHAASILKLDGKYERVLSHHVGASIKILTPHQMGAIAFGLKGYEAMALDLRGCDAILDEIHTYSFVAQAMVLKIVEILIALGCRVHIGTATMPSILYNTLLNLLGGSQQVYEVKLSDEQLATFDRHVIHKLNTLEEATPIVEETIRQKRKLLFVCNQVKRAQRLYMELHEKYPEVPSMLIHSRFKRGDRSRLEQDLKEKYDKGTEACIVVSTQVVEVSLDISFDVMITECAPMDSLIQRFGRINRRRSYETIGQQKPIYVLAPPDQEAECKPYKLDVLQRSFDALKDGAPFHETEVQSLLDFVYPEIPMVDIELHSIFRGGQWTLKELKHRPKSVLLEMLDIDSVCCITESDYADYLQGNYSSRVELEIPVSEAIRFKGLTQIEEGSYPYIIPDRAYDKELGYVEDFLEEEKNKSFEIL

SEQ ID NO: 12375 - protein, 984 aa, Oxalobacter formigenes OXCC13
MIVTFVSQCEKKALPRTRRVLDAFANRIGNNTWQTVITEDGLIAVKKLLRKTVTKNTAVSCHWIRSRRRSELLWIVGNRQKFNSEGIVPVNSTQKDVFMDITTMKPKQNEFYANTHLQPLALHSFAVGYIARKLLEQAVNDDDYGQLANIAFLAGILHDLGKLELQFQGWVKKGKQKEPDDDGQHIDNSTFSFDKHPRHNEISLFLFNLFENQCKGINNPLKTALQHVIYWHHAKPWRQNDQFTGVVKAYDILLKNISREKIEELAQTTLQLLKRIHHIAQHYDESLNQIEKNLPWSMEFFNTQIEDFCYQKNGTPFPEFKTYMSPDFERLRLNIATNAQHNILRACVISADRLISSLSANDLSDYISQNRLDELLENMQEESTDLSSHLADALTRFPDSERTRKQGEVVRKLAEIDDIAVLAGAAGCGKTKIALEWAKLNNAQKIIWVCPRVQVCQGIFEELTTQYMPEAKIEIFTGEFKYTHSWEKPTPEKDYFSGDIIVTTIDQILGSIVTHTKVNSLLPFMNAHVVFDEYHEYIGMEIFNLLFAELVANKKMRSKGNKNTLLVSATPHYLYLEKVLDIDTTYDAVEMPSFNPSQYKIEFVEFDESDKLNSPFYQAYADNTFIISNTAQTAQLGFIYRQKTEKSVLFHSKFKRSDKKYWFNEVYESFRKNGTRKFDVLRSGPIVQASLNISCDHMVSEMSHPENILQRLGRLDRFGDNTDINVLKIAITDNIKRGKQTDSSARFLAKLHGLRSTKVWYEYLSDKLDDRIFTLPEIYQLYKAFYDDETIRSIISQDLDDALNSSIQLINKKVTEPTRVIKIKTAERKTKISKNSLRGDNRFVQLAQLDVNDFNHPVFINEYAYQPPLNDSNEADNLTESLSFIQNLGLFDFIAQKHGNIDTIHPVKGIPEKKMSARKTVLENYSRDPDYPLYLSYIEDDLNKVGGSSARHSEAVYYAICDKQPVGAIGLKTISTLNPNQTEE

SEQ ID NO: 12376 - protein, 845 aa, Fusobacterium nucleatum subsp. animalis 7_1
MTKFEDIFSFQDKYKYLAHIKDNRKETLQEHTELANKYFEKIVEYKNLKPFFERIKNILNLKNQEEELYYKMIDDVVNFHDFGKVNSQFQIDKMLNEEILKMEDKYNISGVLGSDHSLLSASMFIAYYFGKITDLIEMVETKKIVILLEILFALSYTISKHHGNLDSFEEYIEKLSRNNDENILKELKNISVSNGGILLRAFLEKENITIFFNFIETYISERKKKENISSQEAMSIFVFTKMMFSLLVASDYYSTNEFMQEIKYEDFGNMGNIDTIKKEYENSEIIKSIRDKEKNGIANDEDINNFRTKIFLEAEKNLEKNKEDNIFFLEAPTGSGKSNTALNLSLKLLDKDRRKIFYVYPFNTLVEQNMNTLKNIFGNNKEVIKNIAVVNSVTALTNKDSRDIPIEEYSDILMDRQFLNYPFIVTTHVGIFNSLVGNTKEDCMPFYQLANSVIVFDEIQAYKNTIWTEIIKILNSYAKLLNIKIIIMSATLPNLSYLLDEEEKNNISKLIENRDEYFNNTIFKNRVEVNYDLLSEQKIEYEELLKHITENSLNSQKILIEFISKNDAKKFYELCENNEDLNVDHEILILTGEDNKARRNFIIKKINSKDKKIILISTQLIEAGVDIDVDVGYKNISGLDNEEQFLGRINRSCKKSGKAYFFYLTDAKKVYKNSVIIENKLNLFSDEMRDVLENKNFDVFYSKVLEILKRKAKEKNNNDNFETIIFNKKFRLLKERMKLIEEQEDKKTYFFNRTLTDEEIEEIGENIDGSEVWERYVNILKEENYAKKIVELSKIREKMMYFLYEVKKNTELNYSDIKGSIIYIDDGDKYFTDGIYTGGEGDMFI

SEQ ID NO: 12377 - protein, 1001 aa, Bifidobacterium angulatum DSM 20098 = JCM 7096
MADSAAVATKIWDTWVPQGTKDVIARDLGGDEKLARKLAVFLAGVHDIGKATPVFQAKPITFGAEAESFAWKAEKAGLPMIAGLRDCNHPTHPIAGEAILEGYLMRVHGWDRKTARQYACVVGGHHGIPPDKSKVEDAGLEKRRSGLDSTEWVAAQDELIGFIAGIAGIGQSEWASLSDIRFSVQSAVLATGLVIMADWIASNSDDGMFPLVRTDPWTDDDEMSSLLGDREGDDIQSWSGLRSRANRAWAYVQLPHAWVPEDVPSSCQELFSTRFRLPEGAKVRPVQEEAVRIANKTKQPGIMVIEAPMGEGKTEAALAAAEILAQRTGRGGVCVALPTMATTDAMFTRVHHWLEALPSCDFSNEKTVWLAHGKAQLNNDFRSIIASSHRRFSSVDQDENKWGNPRKQIDVPPETVVSDWLWGRKKGALANFLVCTVDQVLMGALQMKHVVLRQLAMANKVVIIDECHAYDAYMQEYLKMALEWLGGYRTPVILLSATLPEQQRAEMVEAYLKGWGSTECKSGSATGKPSILEMLRAGDSQIECNGSVHSSTPRGEKRVISDAYPLLTYTEGHEIKHVDVKPSGRSMDVRCEIIDDNDEALLGLMDILLADGGCIGVICDTVGRAQQTAELLGGRYGNDLVKLTHSRFMDIDRMSNERELRGLLGPESTVGNGKRPEKLIVVGTQVLEQSLDIDFDALITDIAPVDLIMQRLGRVHRHHRGDGECDRPRSLRKATCYIRGIKTWESDGPEFAKRVDSVYEAAALMEALAVLNLRDAVASCDQRLPQDIAHTVRSAYGDDRRTLIPSAWLARYDDACAKRDAKRAKKKKKAGTYLLQSVKSMNQNRLLVDWFSTQVDENDEDKGQRAVRDTQETVEVMLLHECDGEIRLMPWVGNERAGVENGAVIPTTVMPDDAVAKVAAQCAVRLPMGLCLPDKIDALIAALEDGCASEAACWQESPWLAGKLALFLHEKTNGFVSSELCGNAIAYSRETGLTYHRKEDN

SEQ ID NO: 12378 - protein, 495 aa, Sulfurihydrogenibium yellowstonense SS-5
LDYKNKSVILTASTGMGKTEFALNWVAGDKAFYTLPVRVSVNSMYERISNIFGKDNTGILHANTTDFYLNQSKNLEDNGIEVLINQVQSVRQLSMPITVSTADQIFLATLKYPGFEKIYATLTYSKVIVDEPQGYSPDTLAVIIKGLEEISNLGGKFCLMTATMHPFIKEHLKDKAEILEPVFNPEKKHKIKLVEKTVDEMVDFAIKEYQKGKKVLILTNTVRKAQEVYKILKSQNQTIRVNLLHSLYIQKTKREKEMQIQNTTEPVIWISTQIVEASLDIDYDLLITELSTADSLIQRMGRVYRKIGRTITPDSQPNIIICTKEPSGKGKVYDKEIMDYTLRELKNYDEKILTEEIKQEIVSNVFDLERIKNTNFYKKFDKNMKLLEYGFIADSKSEAQDIFRDIMNLSVIPKVIFDENQEKINALLEKIRQKDKIEKIKAIGELNDFTVSAQFYRVKNIIPLDKEIFLSDIPYDKELGFNLLDKDYREIGEIL

SEQ ID NO: 12379 - protein, 759 aa, Kingella oralis ATCC 51147
MTSKTYYAHSAGNLPYEHWQTMESHARNVGGMAAGFAAYFGAQEIARATGLLHDVGKYSPLFDKRLHGDPKRVDHSTAGAKIAVERWGVRLGKMMAFCIAGHHAGLANGAGAGDGRGTLQQRLDWQFGADIPKLDEVWRQEIDLPETLPAPSVKPDAGDHPHFTCAFFIRMLYSCLVDADFLDTEAFYAKLEQRETVRGGHPDLETLRPVFFDFINAFRRRATQAPKETEEQQRNAALNRLRGEILDYAVAQAQQDTGLFSLTVPTGGGKTFTSMAFALEHAKAHGLRRVIYVIPFTSIIEQNAAEFRKAFGALGEAAVLEHHSSFDDARLQGENSKDKLRLASENWDMPVVVTTAVQFFESLFADRSSRCRKLHNISGSVIILDEAQLLPLNLLRPIMQAVKELARNYGCSVVLCTATQPAVQSEHGFYKGLQNVRELAPNPPALFDALRRTSVQHVGVQTDAELLGILSQHEQMLVIVNNRRHARSLYDAAKHLGGVCHLTTLMCAEHRSQVLDEIRAKLFSGCPCRVIATSLIEAGVDVDFPFVMRAEAGLDSVAQAAGRCNREGKRPSESSLVWIFAPEDKWKAPPELAAQAAVMRLTADSFSDDLLSTQAVAAYFAELYQLKGSELDNKKILKMHNDTGQSLDFPFQTIADKFRMIESHMQPLIIPFDVDAENLINSLHHTDHIGGLLRKLQLYTVQIPEKALAALYKAGRIEPINEKNLGKQFYTLIGLDLYDEVAGLSWEDTEFLKGESLVF

SEQ ID NO: 12380 - protein, 728 aa, Clostridiales bacterium 1_7_47FAA
MYIAHINDSTKEVQTVKEHSENTALLGREFAVPELKDTVYTMGLLHDIGKYQPSFVSRIHGASVRVEHSTCGALAAKEKYCRPLSYLMQYCISGHHTGLPDGGNANDTSDMPTLSGRLQREVEDYSAYKAELKIPEIDEKAFMEFLVTDCGNDMGKLVEKFAFFARYCFSCLTDADSLDTAEFCGGPQNRSLKADFEKCLERVNQHLAGFQCETALQKTRALLQKQVFDKAGEEAEIYLMNMPTGSGKTLCSLKFALERAIRSGKKRIIYVIPYNSIIDQAAGTFERILGKDAELLRHQSTFSYDDREDYSEDYGQTAKLAAENWDAQLIITTAVQFFESIYANKRGKLRKLHNMADSVLIFDEAHMMPQDYLQPCLKAIGYITKYLGSEAVFLTATMPDFRKLVVDYGLPDSRIVDLIDDTAMFPVFQKCVYQDAGLLSDQALLQKAGQSPSSLIVVNKRAAAVRLYRLCGGKRYHLSTYMTAFDRKRVIDEIKKELDRLEKDYPDMSGLPENRKITVISTSLIEAGVDLDFYTVFREVSGLDSILQAGGRCNREGKREHADVFVFRLESEQGKRAMDERPGLSKGLMAEYEDISVPECIRTYYERLFYVKSEQLEQNALGNFCSSIYSIPFRGYADCFELIDTRTVSVAAARDDYSREMVEQLKDSGYGNARKLQNYTFSVYQYEFDDLLKQHVVDDYGSGIYCLTNPDYYDDETGVVFEAKDYIL

SEQ ID NO: 12381 - protein, 567 aa, Perkinsus marinus ATCC 50983
MASLPSHFSAATSPLPRGIIQAQASPQRGKRRNPISGFTIEEAEDERLKFMRCFTDGIDVTRVRGRSTVSVWEKVADKLSRDGGPAQLLRDTSPAPVDAAYWCGAFPWDNEVRRRNQSVQSLRVLVEADCQIRRFTFGNQGGFRPNQLETINAVLSKRDVFLVMPTGGGKSLCYQIPALVNHEARRGGTTVVICPLVSLILDQEAQLSQCGILCAGLSSSAAHTMPPVETFKKLFSGKLRVLFVTPERLSASKRLLDLLAGLYRNSLLHGFVVDEAHCVSQWGHDFREDYLLLANIRKTFPGVPILAMTATAKPDVMKDIMLQLGMPTSSTVVIRTSLNRTNISYSVVKRPSKGKMLESLAGKIRELSGKDGRGSGIIYCMSKKDCEQVSTGLRAYSIKAAVYHADLPQSIRDTNQKLWMDNEIQVMAATVAFGMGINKRDVRFVIHYSMPKTLEAFYQESGRAGRDGRPSYSVIYYDYYSKNRNQWLIEQGGDRSRAGISTHARHELIGEQKKSLLALVAYCESGTQCRRIILLKYLGTEAGPVATCLDSNSLPCDVCIEQQQVRS

SEQ ID NO: 12382 - protein, 762 aa, Neisseria flavescens SK114
MKPLIYYAHSAQDKLGNLLPYEHWQTLQSHLVNVGEMAAEFARVFGAQEIACQTGQLHDLGKYSEPFDRRLHGGPSVDHATAGAKIAVERWGNVIGKLMAFCIAGHHAGLANGNGEGDNRRTLKQRLALQFGADIPALDNLWQQEIKLPQNLSAPPLKADAHHPFFSYAFFTRMLYSCLVDADYLDTEAFYSNLENKTVERGGYPDLNALQHNFNQFINAFRRRIAQAPEQTEAEKRNAALNRLRSEILDHAVEQAAQAQGLFTLTVPTGGGKTFTSMAFALEHAKRHDMRRVIYVIPFTSIIEQNAAEFRKAFGELGEQAVLEHHSTFDDGKLQNEATKDKLRLASENWDAPIVVTTAVQFFESLFADRSSRCRKLHNIAGSVIILDEAQMLPLNLLLPIMQAIKELAQNYRCSVVMCTATQPAVQAENGFYRGFENVREIAPKPTALFDKLRRTTVQHIGTQTDADLLAKLAEHPQMLVIVNNRRHARSLYDQAKHLDGTFHLTTLMCAKHRSQKLDEIRGRLKNGEPCRVIATSLIEAGVDVDFPLVMRAEAGLDSVAQAAGRCNREGKRPSENSFVWIFAPEEQWKAPPELAAQAAVMRLTTNSFSDDLLSTQAVAAYFAELYQLKGSELDNKKILKMHNDTGQSLDFPFQTIADKFRMIESHMQPLIIPFDVDAENLISSLHHADHIGGLLRKLQPYTVQIPEKALAALYKAGRIELINEKNFGKQFYTLIGLDLYDDVAGLSWEDTEFLKGESLVF

SEQ ID NO: 12383 - protein, 849 aa, Leptospirillum ferrodiazotrophum
MLRPKGIKQAEMVPALALEKCLAKSRQSFDGSVRSGRLIVDHCLIVGEVARGMICRMPGWMRSELFPDGSELVAASHDIGKVSPTFQKKIYSAITSETQNIISHLKDVDSDIEKQWGGHAGVSQATEAGLQVGRYIPEIVGQHHGSSPNLSFYNGKSEVFGGDAWFNRRVELLETIKNTLGVDFPEVKTPLQARVLAGLTTVSDWVGSGSLFEDPDDHTWKSKIDEALDLAGFSPPKLITGLSFHDVFRFDPNEGQRCLYEFVNQPGVYILEAPMGSGKTEAALYAAYKMMAMGQATGLYFALPTQLTSDKIHDRVNLFLQAILDDRSSHKKALLLHGNAWLKETEIGEEGNPGRSWFSQGKRGILAPFAVGTIDQALMAVMNVKHGFVRTFGLAGKVVILDEVHSYDSFTGTILDALVATLRKLHCTVIILSATLTQERRSVFLESPSTETAYPLISAQPTQGSLREVVPHAGANTIVSLSLKKEEETIEEALNRAECGQQVLWIENTVGESQSAFKRLSARSKDRGVSCGLLHSRFTKSDRTRHEEHWVRLFGKAGNDERSRQGRILVGTQILEQSLDIDADFLVTRIAPIDMVLQRIGRLWRHEHSWRPASARRESWILAPTLESVLDNPDEFGGTGKVYAPYVLCRTLMILKDLSELSLPGQIRPLIEKAYEKREETGQMKVFLDQVTKRTESLRRLALLGLAEGGKTLPEEKAETRYSTREEVEVLLIRSFEPTQRSLRLLDNTTLNIPSHSRSLNDKDLRSLSLRLMDNTLRVPIHLAPGGVRRQSLSWLADYLYLGNSEESQLRIGIVGEDGQVRSINWGEANERFVIRYDSHIGYQTKKRR

SEQ ID NO: 12384 - protein, 858 aa, Fusobacterium varium ATCC 27725
MFEEELFSIEKYVKDENKVLAHISDIKNPETLLEHSDLVIKYFKKIYEDKNLKIIFDKLADKFWRENESTKKFWNEMIVNTIYMHDIGKLNINFQIDKMKNKIFDRKHLYQSKRHSNLSARIYIDHFGNKVFKLYSEKKLDNKTALKCFIFIILNSYIISRHHSSTKSLSEDFFNEIIKDYEEYKELFEEVNNYCPNLNFLIKESKNLFRILKQLKIGEKEWNNSIETKDWESVDYYIYTKLLYSLLVSSDFYATSEYSSGKPIESLNLLTNIDEYISVFNNTDIYKGIKLHQKTGKIFSKDNINYYRSEMFLEAEQNLGKNIKENILFLEAPTGSGKTITSINLALKLLEKNRELNKIFYIFPFNTLVEQTNASLREIFQGSFLEENISVINSITPIKEVENEDGRAQIDYERSLLNRQFIHSPIVLTTHVHFFENLFGIDRESSFALPHLANSVVIMDEIQSYKNKIWKEIIIFLKKYAEILNIKIIIMSATLPNLSFLLNSEAQIPSLVINKEKYYRNPIFKDRVSLDFSLLEKEYEKEELFDQIEKIILEKYRDKKVVVEFIKKSSAFDFYKRLVEKNEDSKEDIFLITGDDNKAERKKIIKEAKDKKRKSMILVATQVIEAGVDIDMDIGFKNISILDADEQFLGRINRSCKKKNCKVYFFKLDDGGKIYKSDVRIQGRFTLMNEEMREILKSKNFSEYYSKILEVLDDFSNKEDEENIENFRRNKVVQLNFEEINKRLKLITDEMKTKMIFFSRNIKIEGEEIEGNKVWKEFKEVFLNNEIGYAERRVKLSKVMEKVDLFSYNIPKEMTYRLSYQDSIGDNILYIQDGEEYFVNGKFDRKKMQSKNDCEMIL

SEQ ID NO: 12385 - protein, 865 aa, Ruminococcus sp. 5_1_39BFAA
MNIEFIDLTEVQKDVVHCYAHRTGNEKKSMEQRQKETLIEHTELCQQYYEKIVEHKQIQVVFEQFEKLYFSEMSREGIHFFETMRDNVITFHDIGKINPRFQEKNMGNYELKGKARPDNSVGSKHSILSSVLYLDYFLDRVSQIENLEERKSLRDLAYIHSFLIAKHHGALTDFQTYLDSFASLNDTEGTVLGWHAQQWLKKWKEENENQKVRKKVYLKKDKQEDMFERISGDDASRQVYLFGYTRLLFSLLVAVDYYATSDYMNGIKLKAFGQLDDISNIIQAYEKTGTQQSIREYEKTKYPQRRERLVKKKKADVINDLRTEMFLDAENTLKEHINDHIFYLEEPTGAGKSNTALNLSFQIIKKVKNINKIFYIYPFNTLVDQNIENLGKIFGNQKDIMNQIAVVNSLVPMKEEKDEYEDKTKKFYQKVLLDRQFLNYPIVLSTHVTWFKTLFGHEKEDVFAFHQLCNSVIVLDEIQSYKNALWSEIITFLKGYAKLLNMKIIIMSATLPNLEALTDDKEDAVNLIPQKESYFKHPVFAERVIPDYSLLKQKMTLEILCEHVQKQVLRKKKILIEFISKKSAEKFYGMLTDTEIDCETLFMSGDSSIWERQKIIEKLSKLKSVILVATQVIEAGVDIDMDIGYKDCSKLDSEEQFMGRINRSCKGEGIVYFFNLDSARMVYKDGDIRVDTEFTVMKTDMQEILRTKNFSDYYGEILEIERNNKKSENENNIVHFFKKEVGQLAYPKVSDKMHLIDEQREMMNVFLSRTLTLSATEKICGDEIWQEYESLLHDQGMDYSEQRVRLHEIKCKMKMFVYQIEKGNTFAWDEYEAIGDIYFIKDGDSYFENGVLNREKFGTGGEMFF

SEQ ID NO: 12386 - protein, 877 aa, Clostridium botulinum D str. 1873
MYFEKTEKFDISKYIKNSEKIYAHINNKTREKETLKEHVERSLKYFYKLVYSKNLENIFLKFEEKLCREFSDEEKNLFREMIINTIYMHDLGKININFQRLKMHNKYWENHKEFEFNNSNHSCLSSLIYMDYYYKKIKSNSNLNSLESKKLLKIFMILNAYVISKHHTGLDKLEDFKVKLTEDDGEGQRLCSSELSLFEDIYNDKIKFTTNENILKNLFKNTEKNLRRYEEEETNISFVFYIYERLMLSILLMCDYYATSEFEHGDEVKGFNEIENIYDFYDEFNNTKINKDTREYEKNEYDTKRDFSNLKDINILRKELFLDAEKELLKNLDKNIFYLEAPTGSGKSNVAFNLTFRLIEKERNLKKLIYVYPFNTLVDQNIKTIEKIFNNKKDVLNNMAVINSITPIKIRKKDLDDNTIDYNTSLLDRQFLNYPMILTTHVSLFNYFFGISKEDIFPLAKLCNSVIVLDEIQSYKNYIWKEIITFLKYYSEFLNIKFIIMSATLPNLDILMDDESNSISLISNRDKYFDNKLFKNRVKIDYSLLDSADIEDSKDAKLEKIFNHVVEQSNNSEKNILIEFISKDTAVKFHEMLIEYKEEYGLGTQDVRDIELITGDDNSIERNKIINKITKEENKNIILVATQVIEAGVDIDMDIGYKDISMLDCDEQFLGRINRSCLKESGIVYFFNLDSAGGIYKNDYRKPKQLTLISEKFHTRRWLENKEFYKFYKHVLEVINKNGTDKYKENSMTNFVKNSMNKFDFINISERMKLIDDNKMECSVFLNRELELDDGRVLKGYEIWDSYKELLQNNEIDYAEKKVKLSKIVSDMNYFIYKVRKGNFNITECIGEIYYIEDGEKYFENGKFIKSKFQGIDSDIC

SEQ ID NO: 12387 - protein, 760 aa, Neisseria sicca ATCC 29256
MTTYYAHSAQDELGNLLPYEHWQTLQSHSVNVGEMAAEFARVFGAQEIACQTGQLHDLGKYSEAFNHRLHGGPSVDHATAGAKIAVERWGNVIGKLMAFCIAGHHAGLANGNGEGDNRRTLKQRLALQFGTDIPALDNLWQQEIKLPQNLSAPPLKADAHHPFFSYAFFTRMLYSCLVDADYLDTETFYSNLENKTVERGGYPNLNALRHNFNQFINDFRRRIAQAPEQTEAEKRNAALNRLRSEILEHAVEQAAQAQGLFTLTVPTGGGKTFTSMAFALEHAKRYDMRRVIYVIPFTSIIEQNAAEFRKAFGELGEQAVLEHHSTFDDGKLQNEATKDKLRLASENWDAPIVVTTAVQFFESLFADRSSRCRKLHNIAGSVIILDEAQMLPLNLLLPIMQVIKELAQNYRCSVVMCTATQPAVQAENGFYRGFENVREIAPKPTALFDKLRRTTVQHIGTQTDADLLVQLAEHPQMLVIVNNRRHARSLYDQAKHLDGTFHLTTLMCAKHRSQKLDEIRDRLKNGEPCRVIATSLIEAGVDVDFPLVMRAEAGLDSVAQAAGRCNREGKRPSENSFVWIFAPEEQWKAPPELATQAAVMRLTADSFSDDLLSTQAVAAYFAELYQLKGSELDNKKILKMHNDTGQSLDFPFQTVADKFRMIESHMQPLIIPFDVEAENLISSLHHADHIGGLLRKLQPYTVQIPEKALAALYKAGRIEPINEKNFGKQFYTLIGLDLYDEVAGLSWEDTEFLKGESLVF

SEQ ID NO: 12388 - protein, 715 aa, Marvinbryantia formatexigens DSM 14469
MRYLAHINKYGDEQTVKEHLENTAVLCGKFAESFGAYDAGYCCGLLHDIGKYSRKFQQRIRGSEQRVDHATAGAKVCWEKKGMYQFLSYCIAGHHAGLPDTGGSGDISTDGTMTGRMRKKLEDFEAYAEEIKIPMLGNPPFQPVKSENIDFFFSMFIRMLYSCLVDADYLDTESFMNRKEHVREQGETIAVLCDRLEKHISDWLKQEDLSTVNGRRTEILKHCMEMGEADKGLFRLTVPTGGGKTIASLAFALKHAEKHHMERVIYVIPYTSIIEQNAKVFAEILGRENVLENHCNIDYELDEELRPMQLAAENWDKPVIVTTNVQFFESLFSNKSSRCRKLHNMANSVIIFDEAQMLPNDYLKPCIAAMEQLLRYYRSSIVLCTATQPALKNILSEDIDIASIELCPRMEEQFRFFKRVSIHNLERISEDELVHRLETEHQALCILNTRKRAQKIYQQVKGKGVYHLSTTMYPVHRKAILDKIRERLKKQERCIVVSTSLVEAGVDLDFQTVYRQMTGVDSIIQAAGRCNREGKRNADTCFTYIFSLEGREDVPGQRQQTEITESLLYDKRNPDSLDTINRYFKMLYHFKGDNLDKKRIMDKFKKSNFQFATVSKEFTIIEENTKTILITREGEAAEIYEELRQKGFTKGLVRKMGQYCVNLHENDFQKMYAAGMLEEISEDMKQDYFVLRDNEAYTEDMGLTLGVEYGQAVIW

SEQ ID NO: 12389 - protein, 732 aa, Campylobacter showae RM3277
MKESILFDEFWSHPNKLLENHIKNMISAGDEELDKQVKLYHDIAKLKNNFQIYIRDTSNDKLDKNHSFLSAYFFLLNSKFDEIPTLFGFLAIVSHHGDAVNLMTLARDANKFFKNLKELEYWEEVVNAAKNTQVYSGLSTKKDEFLDRAEKLRQYLILLQYKHKFTYEDFINFKSLYSNLVYSDKFEAIFSMPKQETKDIPVDVLESDIKTLPPNKKRDEFRNFVLNNFDENYKLFTLTAPTGYGKTLTALNFALKFNKSRIIYALPFTSIIDQTYDIIAKIYKNSDISVGKAHHKTTIDEKNLTEDDRYSKIKFLMESFSGEINVTTLYQLIFALFGNKNKDNVKFNQLKNSVVIIDEAQAIPYNFRKDFILLCEIISQRLGTIFIFMSATMPVIKSENFKEISNLEYFSRQDRYVIKWLDISGEEGLLEKICETARDKNTLVVVNTIKKAQELFVKLRDKFSCFCLNGYMYDDHKRATIEAVRCAINTNKDDPLASKILLISTQSIEAGVDLDFDVGFREVAPISSIIQTAGRVNRHFGEICGELYVFAEISKFTNLIYGDLQKVSKAILEIFKQREVRESEILEISNLYFQKISDQLENLYIQSEIKKLEFENINQKIEEIMNDNCKQTLIIEPEENFIKDFEAKIIEIKNSQNNEFTIRDILKNHIRKLSKFSINVTFKDKEKLTPNLRQIRGLKDMFYLPFGSSYFYSTDYGLKKDTNLDITDEVFD

SEQ ID NO: 12390 - protein, 750 aa, Hungateiclostridium thermocellum DSM 2360; identical to SEQ ID NO: 11589

SEQ ID NO: 12391 - protein, 434 aa, Treponema vincentii ATCC 35580
MNSLDYSAGLYKTSGETALADIFTIIAFTVTICYPCGMTDFLNIPLYEPFVETLAAGGIIHPTPIQEKVIPLALEGKSVFFESETGTGKTLAFLLPLFTRLMQDEKKTTAPRILILSPTVELASQIKETAAQLQGSGTQYFKTLLCVGGSSLKRQIEGLKEKPAVIIGTPARISDLIGLKKLKLQEITAVVIDEADRQLARESRDALQTVLATLPQDVQALACSATFNGKNIELLNGFLRRSSAAELPECLSIAHTGVLQNSIEHWALFSERRNKADTLRALIHALDNTSVHSAKKMLIFTAPAQEVETLAQKLQHKKIDAVPLYGKLEGSERKQIIARFRSGKTRILITSDLSARGLDIADIDYIVQMQLSKDADAFIHRAGRTGRAGKKGVNIVIGDEYELRILQALEKKLGITVYPKILTGGKIQFPSETA

SEQ ID NO: 12392 - protein, 747 aa, Cardiobacterium hominis ATCC 15826
MPTYYGHSAENRPQSDWQTLKSHAENVAALAAQFAEPFGAADIARYTGLLHDLGKYSDPFQLRLAGSPQRVDHATAGAKEAIARWQLMGKLMAYCIAGHHAGLANGSGEGKGRSTLQERLAAEVPPLNAVWQTEIPLPEHIAAPPLKPNPKYRGFTQAFFTRMLYSCLVDADYLDTEAFYAKLENKTVERGDYPALSALQQAFAQHLQNTRAKAQNSKGGQAELNRLRSEILEHAQQQAALPPGLFTLTVPTGGGKTYTSMAFALEHARQYGQRRIIYVVPFTTIIEQNAAAFRQAFGALGEAAVLEHHSTFDDSTLLDRDSRDKLRHATENWDAPVIITTAVQFFESLFADRASRCRKLHNIANSIIILDEAQMLPLHLLRPVMAAIDELARNYRCSVVMCTATQPAISADNGFYGGFEDVREIAPEPARLYAALRRTTVRHIGKQSDAELLEQLSAQPQLLIIVNNRRHARSLYDSAKHLDGTYHLTTLMCAAHRSQTLETIRARLAAGEPCRLIATSLIEAGVDVSFPRLMRAEAGADAIAQAAGRCNRENQWQAEDSEVLIFCPEEQWKAPPELATFAACMRGIVRQYGADLLSPDAITAYFADIYHFAGNELDKHRILEEIQNAGRELNFPFQTIADKCRVIESKHMLPVLIPFNAEAEQLINALEHADTIGGLLRKLQRYTVQVPESTLRELSKAGLVEVINAKHFGNQFYALVPGSSLYDAAAGLSWDNTVFIEAEKSVL

SEQ ID NO: 12393 - protein, 729 aa, Listeria monocytogenes FSL R2-503; identical to SEQ ID NO: 12000

SEQ ID NO: 12394 - protein, 727 aa, Listeria monocytogenes F6900; identical to SEQ ID NO: 11873

SEQ ID NO: 12395 - protein, 358 aa, Enterococcus faecium TC 6
MFDQPEAKPREVVFFWTGQLTEKQTEIAKRILCHSEKRHHLIWAVTGAGKTEMLYPILVETLKAGGRVAICTPRVDVCNELFLRYRYVFPEEKITLLHGNTATAYTFTSFVICTIHQLYRFYRSFDLIVIDEIDAFPYNGDAGLAHAVQTAIRSNGRFIYLSATPDEKLLKEIKQTFELHKLALRFHRRLLPEPVLVFMNNWRQKCGNKKKINSLVRIIQQLIKENRILLFCPSITMMHRLKITLQEAFPEYEITDVSSQDDQRAKKVQKMREAIYEILLTTMILERGVTFERISVIVLGADHPVFTKSSLVQIAERADRKGPYTNSRVYFFYEEKTSAIRKACQEIKEMNEEGKQML

SEQ ID NO: 12396 - protein, 809 aa, Lactobacillus helveticus DSM 20075 = CGMCC 1.1877; identical to SEQ ID NO: 12301

SEQ ID NO: 12397 - protein, 845 aa, Fusobacterium nucleatum subsp. animalis 3_1_33; identical to SEQ ID NO: 11990

SEQ ID NO: 12398 - protein, 793 aa, Blautia hansenii DSM 20583
MEYYAKSKEKGKTEREKKKIENLLQKILQDSSCELEEWEIKILEDEIEKIYVENIEMQKTLKEHEKDIVACAERFFVRYDQYFTEKEKRLIIEACRIHDWGKANLLFQAVVNEEVKEELSSYNKNKKQIPHGFLSALSISVDEFLQISDCFKREDFDMFLTAVYYHHTRNDEWDSAEIKEYAEQYYREHLEKYLGRGKVLIRSSYRNKLLFRNNNNCKNLPIKWEKWVLYSTIKGMLNKFDYTVSAGYENAEINPDLEKRELIKNVEEALKNYNLRPVQTYMKENVEQNLVVIAPTGSGKTEAALLWLNGEKGFYTLPLRVSSNAIYERIKVRYRYEDVALLHSDSMQVYLKESDDTDTYKKYERAKLLANPLTICTVDQLFKFVYKALGTEIFPATLKYSKIVLDEIQAYSPQVIAAIIYGLKQIVSMGGKFAIITATFPPVLEHFMKQHGLLKEENYQFQDFSNSSEWLRHKVDIRDGEMDIDEIAEQGLEKKVLIICNTVSKAQEIYKELEEWTEEVHLLHSRYIRRDRNQLEKMIMQFSEDRDVAGIWVTTQLVEASLDIDFDILYTEMCTADSLLQRMGRCNRKARYQPEEANIIVYANENGVGDKSVYGKELYSRSLDKLHQYVGKTLSEKEKIDYINQVYCAEEIMDTSYYKEIEKYLKHFEELTPLEYSKQETDEKFRNIQSITVVPDSIYDENQIIFEKSIEVLECPHIGRNVKSVFTAKLNDLTLNLNRYGNMKGVDVATVGEKGNCKILDIHRINLKYEFDRETGKGCGLLLKQIEDEQFFI

SEQ ID NO: 12399 - protein, 763 aa, Vibrio metschnikovii CIP 69.14
MSNYFGHSGNKEDKSDWQPLQDHLCRVALCAELNSKYFKAAKLSYLAGLLHDLGKYTPEFQARLEGASSKVDHATAGAKIAAEILPDEKFNNFPFYKFVAYAIAGHHAGLSNGTGEGDGRRALKDRLELQFGKDLPVLDSETWQSELVLPSIESLIPEISPNPDADLQGFQYAFLIRMIFSCLVDADFIDTDEFYKRLEGKPLLRGDYPQLSELKIQFDQKLADKIKSTDQTKTVNQLRKEILDTARLKAKLTPGLFTLTVPTGGGKTLSSMAFALEHALAHNMRRVIYVIPFTSIIEQNAQVFRDAFGELGEASVLEHHSNFDDRKIKDKEGAEETRDKLKLAMENWDMPVVVTTAVQFFESLFADRPSRCRKLHNISGSVIILDEAQTLPLKFLRPVMAVIDELARNYGCSIVLCTATQPALCEPDFTNGFTNVREIAPEPKRLFDELSLVSVSHLGELSDDELVSRIQANNQILTIVNNRRHAQSLFRTLNTQQTVGVFHLTTLMCPAHRTATLDEIRKRLDPKKPQPCRVISTSLIEAGVDVSFPCVMRAEAGLDSIAQAAGRCNRERLWGKEDSHVWIFRSPDWPIPPELKGLSADMRAVLRKGHDNLLDQLAIKEYFSNVYWRKGEELDQKQLLKACRIGASKLDFPFQSIASVFRMIDSFMCPVLIPYNDEARKLLNELESTDDVSCVLRKLQPYIVQIPQNGFDSLRLAKVIQTVAPYRFEEQFWELVNMDIYHPKSGLSWSDPNFIKAENLVFC

SEQ ID NO: 12400 - protein, 810 aa, Jonquetella anthropi E3_33 E1
MEHFICWGQRRSQTLKAIAHTRREEDHLIEQTVEEHVRGTAALAESFANQWGDGFWGRLAGMYHDLGKSACQWQEYLRVQDYDESASSESSEDEDKDDDKKKNPIHKVSHSEAGAAAVLEGFWDNWDEPNVSGPLTGLAYAIAGHHAGLADWRTGGRGALINRLATKNGDLDVSRLLNPLRQALGTGARQVDYPAELTRLDSVALNLNEEIRQWLEKWFADDGSEDVPREYLNLWVRMLYSALVDADSLDTERFCRPDQAAQRSRQFDMQDLKHRFDSYMDEKERLAEKSPVNEVRSKVLGWCRQAGHCEPGFFQLTVPTGGGKTLASLAFALEHCLTNGRRRIIYAIPYVSIIEQTADVLRGIFGDTGAVLEHHSNILPERETLQNKLAAENWDAPIVVTTNVQLFESLLSDRRVLCRKIHNISRSVIILDEAQMLPLQHMRGVLSVLKGLVKHFGVTVLLCTATQPALTRTFSDGQNVSFPGLPEPRQIVPAGADLYQKLLRAEWVRDYNPTQPRTWDELADDLLKHQRVLAVVNRRGDCRELYEVIKSRSGENLFHLSADMCPQHRSDRIGEIKALLKDESRTVRVISTQLIEAGVDIDFPVVFRALCGLDSAVQAAGRANREGQLNKLGKLGQLYLFSPMKPSPVGLLLKGEQTFKAMLGQKTEFDLFCPSVIKEYFNRLYRDVGTFDQSKYYELLVENAECFEFQFRTFGRDFHMIDDEGRQSVFVAYGAGAELIGELKRNGANPQLLRALQRYSVSIPESKLKELRYSGAVDETDEGYFVQSEAFVYDLETGAIGQPSVGFFIR

SEQ ID NO: 12401 - protein, 752 aa, Selenomonas sputigena ATCC 35185; identical to SEQ ID NO: 11820

SEQ ID NO: 12402 - protein, 762 aa, Mannheimia haemolytica serotype A2 str. OVINE; identical to SEQ ID NO: 11998

SEQ ID NO: 12403 - protein, 762 aa, Mannheimia haemolytica serotype A2 str. BOVINE
MEEHTIQSFYAHSGKLSDHSDWQTLLSHANNVGLLAAEFAAPFASQEIARCTGLLHDLGKYSERYQKRLHGGERVNHSTAGAKIAVERWGPLGKMMAFCIAGHHAGLANGSGEGKNRSTLTQRLQEQFGYGHKDLPVLDAIWQQELNLPEKLPLPPLKPSKNEPFFSYAFFIRMLYSCLVDADFLDTEAFYANLEKRPLERGNYPNLTALHQQFNQFIAQFRERIATQTPNTQEAQRKAEVNRLRSEILDYAVSQAKQETGLFSLTVPTGGGKTFTSMAFALEHAKQYGLCRIIYVIPFTSIIEQNAAEFRKAFGELGTEAVLEHHSTFDHDSLPDKSSRDKLKLASENWDAPVVVTTAVQFFESLFADRSSCCRKLHNIAGSVIILDEAQMLPLNLLRPIMAAIDELARNYQCSVVLCTATQPAIHQANGFYKGFENVREIAPNPTALFEKLKRTTVKHIGIQTDVELQSKLADNPQMLIIVNNRRHARALYDSAKQLEGAYHLTTLMCAKHRSQTLTEIRLRLKQNLPCRVIATSLIEAGVDVDFPLVMRAEAGLDSVAQAAGRCNREGKRLSVESNVWVFQPEEQWKAPPELGLLSGCMRSTVQVHADDLLNPKAINHYFQAVYEAKGKELDKPNILKACHDAGQSLNFPFQKIAEDFRMITSHLIPVIIPFDQEAENLIDRLRYADQVGGILRKLQPYTVQVPEKALAELYNAGRVETINETNFGKQFYCLIGMDLYDEVAGLSWENVDFLESEKLVL

SEQ ID NO: 12404 - protein, 675 aa, Verticillium alfalfae VaMs.102
MADFDVNSAFIPALHKPAALLPIAKHREGLLYLIETKPVTIIVGQTGSGKTTQIPQFLEASGWADGGKVIGVTQPRRVAATTVALRVAEEVGCEVGKEVGYSIRFEDVTSSSTRIKFLTDGLLIREALVDPLLSRYSVIMVDEAHERSISTDILLGLLKKIMRKRPELRLIISSATLQADAFLKYFTPAPDSGAPEPQIPESPATVVNIEGRAFPIDILYLEEPTEDYFERAITTVLDIHTKEADGDILVFLTGREEIDRAVQAVADRLLEMGPQERTLEPLPLYAGLSTEQQMFIFDKPPENKRKVVFSTNIAEASVTIDGIVYVVDCGFVKLRTYDPDLGIDSLTTTPLSKASAMQRAGRAGRTRAGKCFRLYTEETWESLADANVPEIQRTNLAPFILQLKALGIDNILRFPFLSAPPAKLMAKALELLYSLGALDEYAKLTRPLGYRMAEIAVEPMMGKTLLSAQSFGCLSEILTIAAMTSVAGNVWFYHDGERKRMESSRRKFAVEEGDHLTLLNVYLAFITKGKKEARFCHDHNLNFKTMTKAVSVRAQLKRYIERFGIPVDESLGTKLTQQDMLKKAEQIRRCLTSGYFAHAARMRPDGTFQKVAGDMTLHAHPTSLLFSRKADWVIYHEIIETSSKVYIRDITKIERNWLLEYAPDFYKISKPADRV

SEQ ID NO: 12405 - protein, 719 aa, Bacteroides fragilis
MGSRYDYILAKSESNGATSLKSHLESVAFWAQTAARYAGMDENVVRIGALLHDIGKASPFFQIRLQVKKKPNEKVFRHEVASLFFLKLIDRSLWPEVIDMIIAHHKSVYKDRSCNGLLDLKEYYGEENTFRDHVSGFSSWSIDAIGILRELNFPGVSADSLLSEEDALEAYRYAIEHCRRKPKGWSKWKGLLMGVDHLASATEEFKERIPTLFSIPDVGFYNRQHPLYPLSQVLSEANKKHTFVKAPTGAGKTDFLLKRCQGRIFYTLPFQASINAMYERIRRDLNGVVEDVRLLHSMSRLVIEGEKAWEEKVIQDKIGASIKVLTPHQLASVSLGTKGYETLLFDLCGCDIILDEIHTYSDIMQSIILTMIEVLVHIGCRIHVGTATMPSELEQKILDILGRDQTQQVELLSSVLDSFNRYIVHKVTDFYSVLPVLREAIENDQKILIVCNRVRNAQILFEKIDELYPEVDKMLIHSRFKRKDRNRLEKELQDIYNKVLQACIVVSTQVVEVSLDISFDMMITETAPIDALIQRFGRINRKRKPKEERTLKHIYVIAPPDKKEDCLPYSQEILQRSYDALPQDSLLEESSLQRLIDQVYPQVNVIDLSLDAAFADGKWRLKELFHLPKSAFIEKLDIDSVSCITQEDADTGKYREATAEERVLMEIPMRYSSLRWKNLETFPYGSHPFVIPDIAYSSDRGLDITRMGTENYDTNYQIL

SEQ ID NO: 12406 - protein, 946 aa, Slackia exigua ATCC 700122
MGDSGEIARLLWSKWLPRTVKKLIAQDLSDSAAESLVAWMASVHDIGKATPAFQYKVTDRAESVRETGLEIPAGIDSKSHAFMGQVILEDWLFDRAWSHPNIFSCVVGGHHGAPPDSSTILDNLRDSLLPKEVLGESTWTTVQIELLDYAFVLSGAFGHEGELKELELPQHTQVLLTALVIMSDWIASNADLLPLVSGIASTADFRARAREAWERLALPAAWVPSLHGEPAEARFHARFDNIPEAARLRPAQILAVEAAESLEDPGLIIIEAPMGNGKTEASLLCAEILAEKFGSGGIAYLLPTMATSNAMFSRVENWLSHMADADGSSRQSMQLLHSKSALNKDFASLRTWNHTWMGDERNQQRSKNPNDESIIAHQWFGGRKRGLLASFVVGTVDQLLMAALKAKHVQLRHLGLAGKVVVIDEVHAYDAYMSVYLDRVMTWLGAYRVPTVLLSATLPPQRRKQLIRAYRGKDARSTGRPSKRRLIDPPRRATGEPAYPLVTVSGRDLDSERYCDCEVASRGTDVEISFLLDGDDDLLATLRDRLSDGGCACVLRDTVSRAQETYEFLKTAMDAEVRLVHSRFIAADRLSNDAELLKLLGPNASRRPRSLVVVGTQVIEQSLDIDFDFMITDIAPIDLLLQRMGRLHRHQRGEGQSERSAKLRTAQCFITGSKDWSVEPPEFDKGIIAVYHPALLLRTILALKVRCDGAGGSRINLPHDIAGLVETVYEGLEPGSNDFLLDGLKDDAWRDALLGAQDDLRQYRMSQESKASNWLLGKERTKPGKVFDLVGWLGNRFSLSDEETGRAAVRDSQESLEVVALHCDAGNLSVFPWVALQEGVEEKYTALGDGTTAPDDCAACLAATCTVPLPPLLTKPWRIAGIVSALESATNVSGWQESRWLKGQLPLVFDRNGVAVVDCERERYHLGYSRELGLRLLEIEHKEVEQ

SEQ ID NO: 12407 - protein, 851 aa, Neisseria lactamica ATCC 23970
MYGLFVKFCTFQIWRIDVNFDYIAHARQDSSKNWHSHPLQKHLQKVAQLAKRFAGRYGSLFAEYAGLLHDLGKFQESFQKYIRNASGFEKENAHLEDVESTKLRKIPHSTAGAKYAVERLNPFFGHLLAYLIAGHHAGLADWYDKGSLKRRLQQADDELAASLSGFVESSLPEDFFPLSDDDLMRDFFAFWEDGAKLEELHIWMRFLFSCLVDADFLDTEAFMNGYADADTAQAAGLRPKFPGLDELHRRYEQYMAQLSEKADKNSSLNQERHAILQQCFSAAETDRTLFSLTVPTGGGKTLASLGFALKHALKFGKKRIIYAIPFTSIIEQNANVFRNALGDDVVLEHHSNLEVKEDKETAKTRLATENWDAPLIVTTNVQLFESLFAAKTSRCRKIHNIADSVVILDEAQQLPRDFQKPITDMMRVLARDYGVTFVLCTATQPELGKNIDAFGRTILEGLPDVREIVADKIALSEKLRRVRIKMPPPNGETQSWQKIADEIAARPCVLAVVNTRKHAQKLFAALPSNGIKLHLSANMCATHCSEVIALVRRYLALYRAGSLHKPLWLVSTQLIEAGVDLDFPCVYRAMAGLDSIAQAAGRCNREGKLPQLGEVVVFRAEEGAPSGSLKQGQDITEEMLKAGLLDDPLSPLAFAEYFRRFNGKGDVDKHGITTLLTAEASNENPLAIKFRTAAERFHLIDNQGVALIVPFIPLAHWEKDGSPQIVEANELDDFFRRHLDGVEVSEWQDILDKQRFPQPPDNSFGQTDQPLLPEPFESWFGLLESDPLKHKWVYRKLQRYTITVYEHELKKLPEHAVFSRAGLLVLDKGYYKAVLGADFDDAAWLPENSVL

SEQ ID NO: 12408 - protein, 121 aa, Heterostelium album PN500
MVLAERGVSQTVICEVHRYDKQQPSNFLNRVIALGRVSKQLDHQARWRVWAMIVFNNFIENHCNGVLTWGSSTNCQNFTRHLVSKLDLVWPDDIPIASDYAPMAIDLVSFYRDIEISSNTN

SEQ ID NO: 12409 - protein, 853 aa, Peptoniphilus lacrimalis 315-B
MVENKFDNLFAHMDQKDPKRRQRLISHLINTAEESRKIGEKVGLGNLCYIVGVLHDIGKIKEDFQNKLKGNSSKKVDHSSLGGVFILKLLNDYEENYDLKEWDKLNNIFNADEFAVDEFDYYNNILIYSIMSHHGQYNMVRKNKEGEYIYTNKYREIKEKKENKNLDEDFICYIKYLEKNNIFLKDIYIEGFKEYLKIIKKLRNLTIRTSEKKLEAFYFYKTLLIRLVVSILKSSDIKDSINSYEKIIKDEDLIEKENLIKKFEENINRKYQSFGKAQTKINKIRNKISNKIFERSKEDTGGIYRLNLPTGAGKTLLSLRYGINQMRYQTKERFIYVTSYLSVLEQNASEIKTILNNDDYVLEHHSNVVEYDEKSYDEDDDSFESIRKKYLLDDWSSPVILTTMVQFFNSVLKGKSSNLTRFKSLINSVIILDELQSLPTEVIYLTNLFLNFMKVVMNSNIVLSTATQPIYDDINLKHRLDYGDAFNKNTDIISLTGDDEKTFERVKLKLYKNPREEYSIEDLKYLILENKDKSTLIILNTKSVVKKLYELIEEDYSEKDLYYLTTNLTAYHRLEKIAEIKNRLKAGDKICVVSTQLIEAGVDVDFDFVVRSLTGMDSIIQAMGRCNREGKKEEAFTYIIKLHKEIEKTSMLKGIDDRKMACDAILDEVKKEQNIEKLVNDYFGKLYANLKEKDLIGILNLLSLNKNMKEEIIKFCKNNPDNPYISCRDDKYVEDRESTLGLNLFQSFKEAYDGFQLIDNSQKTAVVMYKETEDSINRIRCLEDDFKETYNMNILKEIKKLIKFLSRHTVVVNEKDLTYCENILDGMIYVVPEIYYSKKFGLDFENTSGLLSH

SEQ ID NO: 12410 - protein, 744 aa, Prevotella oris F0302
MERSILLAKSNPKISLNEHIDDCLSICRQLSMVISNIPVEDKASFWNIVRKSLIMHDTGKGHVEFQKILLGKASLWYHQRHELFSIYFIHNSNLSESEKTLVSFGVLGHHKSLGDLFDFVNRNYYNDEDWDEEGLSYADECDKLCYEEIKEILDRYELNLITKNVPCIKSILRLAKNKNVEGKANIENILFIGAIKQCDHMASAGIKHLYRLEKTDFAFLYKYPFFTHQLRDAEASCSVILNAPTGAGKTEAALVWLKNQLEHRGQGRVYYILPYTASINAMYKRLNSCIGDSSKKVGLLHGNLMQYLDLQMENHSIDTIELQEQVEDFKSMLMPLKIVTPFQLLKHLFGIKGFEKGIFEWSGGYFIIDEIHAYEVKVFAQIIVLLSFAVQYLKVRVHIMTATLPTFMRCKIASVIGPYQEIIADKQLYLSFRRHRLFCLDGLLTDYLDNIQVDINQGKKVLVVCNTVDESQMVYKYLHASKKVLLHGRFCAEDRFKNEVKLKEDDVSLLVGTQAIEISLDVDFDLIYTAPAPLDALLQRFGRVNRKREKGICPCYVFKERNDADKYIYKNAGVIERTLEVLKQIEQDEGGIIQENKLQALIDVVYPCWSEEEQEDFSMIKTLFEDYVEKDLRPLEYSAEREEEFYKQFDDKKVIPAALVPEYQSRISNLQFVKAEGLLVSISKRRFANMLHEGNIEQKTFVYSKNEDKQIISIKQYVINSEYDERLGLVFSETEKQIGGDIFL

SEQ ID NO: 12411 - protein, 750 aa, Hungateiclostridium thermocellum JW20
MYFAKPVDNYEGTYEYHVKRCAEILEFEIRSKYPAFKRILSSYGFDVEDFIEKMKTAVVFHDFGKLNPYFQEYMKRKIEKKKLSGIKHFRHEVLSCLFLMSNEKSKEAYFPYHILAVLGHHKMLSSDLKSFERERVWQDRWPEISEDAVKHAMEIASEFGIKVDGRSGPQGKSANNYLNALLKLALMLYEKDREKLKVVYSVSKGLLHNCDWIASSNLDYNRVCLIGVSANDIEKKLKEKLEKENKKYVRREFHSICANAVGDVVAIAPTGSGKTEAALMWALNSETTKIIFLMPTMVTSNSLYERLSTHYFPKESCGLSHSGAETYFYKKSKEDDTENDYDWSQILHQKAFIPAVMVSTVDQVLSTEFHTGLWNQKEYALVGSSVIFDEIHAYDGYTIGLITGVIKKIKKYGGRVMLMSATMPKFLRNHFLDLLDSKCLVVAEELMERASNEWAYLDTDLEGIREKVLKEVSEGKKVALIVNDVETAKKEYKYYSKKGFDVLCLHSEFTMKDRQEKEGRLTSKEGNPYRLVISTQVIEVSLDVSFDVMFSECAPIDSLVQRAGRCNRHGLINFGRFYVFNPSDTAVKYVYRKQKDILDKTVEVIRKNSGRLTEKQIMAMVEEVYEGFNLYDEDYKLGIDIVRDIEQRYNFFDVNIFQENENLSTRKFDVVKVPVIPADEYMEIVEKLFESKDYKMISLYEIPVSISKFKKYIRRLEISNKYNLPIFKIKYSSEYGIDYEEDDSNTCYLY

SEQ ID NO: 12412 - protein, 800 aa, Hungateiclostridium thermocellum JW20; identical to SEQ ID NO: 11590

SEQ ID NO: 12413 - protein, 910 aa, Pyramidobacter piscolens W5455
MILQELNKVWGKFDVESGRKQPLVAHLTDVAAVFEQIMDGALFQRHFQRVLGRPLSETLRERLCVLALWHDYGKISPKFQLKYREKIEKLTPKRSINHIDTAFNLSSIRYKGKIWNELLDVMHFWENEDQKRILHDYLTWVILAHHGAVPTQERCDMAQDNSSRKCWERGVNLDPQKALGELAALSQRWYPAAFAAGGGLPEEPCFQHLFAGTLMLADWIASDRSLFPYCGECDARGEQRPSPEEEDSLSYSRRQAEKVLASLVWTLDDKRPDRAPDFAAQFGFSPNGIQQAVDKLVLSPDGGLYILEAETGSGKTEAALRLYTRLLAAGYVDGLYFANPLRFAATQLFERMVKFSASSFGQEQIPVTLAVPGYLRVNDREGLRVGRFEVDWREVNDRAVGWYAEQPKRFLASPIASGTIDQALLAGLRVPHAHMRAAALQRSLLVVDEVHSSDAYMSALICGLIELFRRVGGHVLLMSATLGSESTERYLKVWNENGPQRPEQTETERLPLTEAVKVPYPLLTSSAEPPLTAASPSRGKSVRMQREPIQQDPQAVAQLATQNLAPFDEKGPCVLILRNSVRQARRTFRALRKILPAEKIFSVNEIPTLHHSRYAPEDRRLLDREVGRRFGKEAVPPDQLRDCCVLVATQTLEQSLDVDFDLIITDLCPADVMLQRIGRLFRHQRRRPAGFERPRCVVLLPDADCGWLLGAEARSYGYGTERAYVNLPSLAATWRLLEENEMWNLPEQNRFFVEQSTHPEALRRLVNGLGAEKWQRALNEVEGLKLAQGWIARTARLRWDEAFKDVKIACGKEMERIATRLGVMDLSVKCDKSVASPLKGEKLKSFSIPAWLLGTDAAALEAQKKKEDGTYLVEPRPEGGLLSFALGSRKYYYDSEGLLSQFDLDERDEE

SEQ ID NO: 12414 - protein, 823 aa, Pyramidobacter piscolens W5455
MLCSRKARDGSDRREALADHVRLVADLCERSCRKFGVPSLGRLVGLVHDAGKSSEQWQRYLLSDEQSEMIPHAPTGAKLLCRIAQEFPDESYERYVAEIAELVVWGHHSGLPDMVEPDGAASYEERLQEPPDAAQAEAIARFQQGVVPQDDIRKLLKSAAEELRTIMKVFTERCNADVYPEDVRQENRSSGEKRKILHRRAEKREFFRGLLTRMAFSCLCDGDRYASACWENRLEAATYTTDPKLWAELAAKLEKRLDGFPDAPINTARRQISDECLESAKKMREPSGIYRLNVVTGGGKTLAVMRSALYLARKFGKDHVFYVAPFTTIIDQTAQNLRETFGRGDILLEHHSNLVGPGTDENEKRLHEKEDQLDKFAERWDIPIILTSQVQFLEALFSGRGQCVRRMHQLCNSVLIFDEVQSVPVKCISMFNLAIDFLAGFCGCTVILCSATQPALEEIARPLRFSEPADLVRDVRKRFPVFDRVQIVDKTQEEPYTAETLSEFVLQLSREIRSVLIVLNTKKAVKEAYAQLKAKGRAGVAFFHLSTNMCGAHRLAKIAEMNSLLAQHKAVICVSTNLIEAGVDISFDAVIRSKTGLDSLTQASGRCNRNKFVERGYVYLIRYEETGLAMLPDLRRAQDAMTRVLSDMPFFPVQDYFSEETLRAYYRYYYHGQRGSMDYPAPHDAGRTLFDYLAANRTARVEYESRHERAHHGILHQAFRTAGREFRVIDENTTGILVPYGKGIELQRQLLSASDYLDKKTLFRELQRYSVSVYPDGLRKLEKDHKLLFFEDLGIYCLLDEESYDDEYGIVFEGGVDPAKYIC

SEQ ID NO: 12415 - protein, 762 aa, Neisseria subflava NJ9703
MKTLIYYAHSAQDKLGNLLPYEHWQTLQSHSVNVGEMAAEFARVFGAQEIACQTGQLHDLGKYSEPFNHRLHGGPSVDHATAGAKIAVEHWGNVIGKLMAFCIAGHHAGLANGNGEGDNRRTLKQRLVLQFGADIPALDNLWQQEIKLPETLSPPPLKADAHHPFFSYAFFTRMLYSCLVDADYLDTEAFYSNLENKAVERGDYPDLNALQHNFNQFINTFRRRVTQAPEQTEAEKRNAALNRLRSEILDYAVEQAAQPQGLFTLTVPTGGGKTFTSMAFALEYAKRHGMRRVIYVIPFTSIIEQNAAEFRKAFGELGEQAVLEHHSTFDDGKLQNEATKDKLRLASENWDAPIVVTTAVQFFESLFADRSSRCRKLHNIAGSVIILDEAQMLPLNLLLPIMQAIKELAQNYRCSVVMCTATQPAVQAENGFYRGFENVREIAPKPTALFDKLRRTTVHHIGTQTDADLLAKLAEHPQMLVIVNNRCHARSLYDQAKYLEGTFHLTTLMCAKHRSQKLDEIRGRLKNGEPCRVIATSLIEAGVDVDFPLVMRAEAGLDSVAQAAGRCNREGKRPSENSFVWIFAPEEQWKAPPELAAQAAVMRLTADSFSDDLLSTQAVAAYFAELYQLKGSELDNKKILKMHNDTGQSLDFPFQTIADKFCMIESHMQPLIIPFDVDAENLISSLHHADHIGGLLRKLQPYIVQIPEKALAALYKAGRIEPINEKNFGKQFYTLIGLDLYDEVAGLSWEDTDFIREESLVF

SEQ ID NO: 12416 - protein, 865 aa, Frankia sp. EUN1f
MISRAPSPTAASQPQAGEPGDDVGRLDVILAKSPRSRRPGERLTAHSLATLRAAGEIRDRLGAAPPVVAEAADLGDRFWILVAWAALLHDAGKIADGFQRMLADGTPWGHRHEVLSLGFLPRLLEDPAERGWVGLAVATHHRALISSGDGGAPSLRQLYGDGTVEWLRSELGPSDPAACAELSTWFGRQGAAAGLLPSTDRDDPRPDAAPATRSKDIADRPKDADVVDDAHRLLAEILNTWGRSVRSDRGLAAVLLQGAVTLADHLSSAHGALHTTQPFDGDYPARLTARLATQGHRTRSHQAAAGAVDGHLILRAWTGSGKTEGGLLWAAGQVEAIRRQSGGVPRLFYSLPYLASINAMANRLAAQELADHGGISAVGVSHSRAASYYLSRSLCGDEPEAGPDDRAPATAADKAVARAHATRLFRETVRVGTPYQQLRGVLAGPAHSSVLLDCANSVFVLDELHAYDPQRLGYILATAGLWARLGSRIGVLSATTPSRLVGLIRETLTEIGTSGGDSTVAATVTVIDADSGTAPVRHRVRTAGQPLTDPATIAAIRRRLAAAESVLVVANNIADAQHLYAELAPHVAPGPDGSPPAHLLHSRFTRRDRTRIEQALTSRYRNGLRPADRQPGLVVATQVVEVSLDVDFDVLVTSAAPLDALIQRFGRVNRTGVRPPADVIICPAEPRTRRGNSTDLFADGVYDYSPTEATWSVLTRHDGQDVSEADLARWLDGLYDSDWGHTWEADVRRHQQKWKTTFLRFSAPFTDRSGLADEFDRMFDGVEGVLAADTDEYSRLLTAGNGPSAGRLLAADLLIPLPHYARGLGRWDRDLDVLVIDGDYSPATGLTDIRPTKRTSVTYELGELI

SEQ ID NO: 12417 - protein, 760 aa, Neisseria mucosa ATCC 25996
MTTYYAHSAQDELGNLLPYEHWQTLQSHSVNVGEMAAEFARVFGAQEIACQTGQLHDLGKYSEAFNHRLHGGSSVDHATAGAKIAVEHWVNVIGKLMAFCIAGHHAGLANGNGEGDNRRTLKQRLALQFGADIPALDNLWQQEIKLPQNLSAPPLKADAHHPFFSYAFFTRMLYSCLVDADYLDTEAFYSNLENKAVERGGYPKLNALQHNFNQFINDFKRRIAQAPVQTEAEKRNAALNRLRSEILDYAVEQAAQPQGLFTLTVPTGGGKTFTSMAFALEHAKRHDMRRVIYVIPFTSIIEQNAAEFRKAFGELGEQAVLEHHSTFDDGKLQNETTKDKLRLASENWDAPIVVTTAVQFFESLFADRSSRCRKLHNIAGSVIILDEAQMLPLNLLLSIMQAIKELAQNYHCSVVMCTATQPAVQAENGFYRGFENVREIAPKPTALFDKLRRTTVQHIGTQTDADLLAKLAEHPQMLVIVNNRRHARSLYDQARHLDGTFHLTTLMCAKHRSQKLDEIRGRLKNGEPCRVIATSLIEAGVDVDFPLVMRAEAGLDSVAQAAGRCNREGKRLPENSFVWIFAPEEQWKAPPELAAQAAVMRLTADSFSDNLLSTQAVAAYFAELYQLKGSELDNKKILKMHNDTGQSLDFPFQTIADKFRMIESHMQPLIIPFDVEAESLISSLYHADHIGGLLRKLQPYTVQIPEKALAALYKAGRIEPINEKNFGKQFYTLIGLDLYDEMAGLSWEDTAFLKGESLVF

SEQ ID NO: 12418 - protein, 712 aa, Dethiosulfovibrio peptidovorans DSM 11002
MALELARRFRIPIEISLLEGAAMTHDLEKANPLFQSYLLGRSRTGVNHACPSSCFSLHLTGSLWATEAVRRHHTHMVNAKDSKQFWIAREDSLSEIQGHMSSVIPSWRRWMSQEDWEDFIDTLWEPRVSEGDWLTLRSLLSLLVTADRMDAIGVRSLLEEPFPAFLPIDFSVRKPTSVDYWRSEVHDECLQSSRGITSPGLYTLTLPTGAGKTVTGLEIAYEIASRNGYKSIIYALPFISIIEQNSSVAKELFGIESVQEDHSQMISGKEVPDDDDVYSPWDKMSVLFRYWRSPVILTTMVQLWNSIYDPRANSSMDFHRLSRSVVIMDEPQGIPPKFWSGMGKTLDFLSEKLGTYFILMTATQPQIGEGIEISPKRYHFPNVRHRYKVLKDKFPLDDLPDLLFESLPVARGSGLVVLNTRKSAIRTYNLLKERLEGDVYFLSAWMTPIHRRKVLKRIKQAQLSGEPYYLISTQVVEAGVDLDFDWVFRDMGPLDSVVQVAGRCNRHGDPSRMGKVLVAEIIAENKVPYCSYVYDDVLLERSRRILRDRGNFDERDIPQIVQTYYGEIMDGISFSPVWEKLQKGLWGPEEKEELIPRDFKGFRVFVELDQDIRYILLRLRDDKWTLESLDEKKRLAKITQQYAIEVPIEELKQWRGELARFLTEDDIPPLGPFLGDDSWFLTSAAVGDIYDDQVGFVPVSLWGGGDGGALFL

SEQ ID NO: 12419 - protein, 358 aa, Enterococcus faecium D344SRF; identical to SEQ ID NO: 12395

SEQ ID NO: 12420 - protein, 769 aa, Anaerobaculum hydrogeniformans ATCC BAA-1850
MLSSEPLAKSGDSQITLKQHLSEVAHYVDTVIEAYTSIWRMVLDEDCVNQLANALKIAALSHDLGKAAKGFQSALNGSKYHWEFRHEVLSTAILLASYDLVGNHSRNSFKEAFYLAASAVLTHHRDIQDQQLNSDAGLASLPTPKVVCKINNKFREKVHELEDAWDWLCQFWKSHSEFNFLKFPDNHDFLTPPKDFLKQIQEQIQDLHPFYDSRVLVLILMRGWLMAADHAVSAGVKDFKVFLPTISLSPLRPFQRYLGTYKGDMFLEAPTGSGKTNAALLWALNNRIKGERIFYILPYQASIEAMADTLENIFGRENVGVLHSRALDYAFREHFEQSESYQESESYAKKDTALNRLAHKPIKITTPFQLLKWFFGITRFEIGISEMTGGIFIFDEIHAYDTHVTALIVEMVKILKKMGARLLFMSATFPSFLKELLREAVGYEISSTSLETCNQDDWTKKFLTLARHRIRLHDTSLENLLGEIAKSVKDGKRVLVVANRVAQAQDIYCKLKEDLKGYDIRLLHSRFIRRDRVEKEQDIIKALKFENSEEVQVLVATQVVEVSLDISFDVIYTEIAPVDDLLQRFGRVNRYGHNPDGAEVHIATEFDQKRLSNVYDEEILIGTLKNAPHDGTHLTVGITTEWVSKVYENGWPSKGQKRYEEASVAFQYVIQALRPFQELQEGKEEFHGLFQSVEVLPRCLYDEYQEALIQKQYLLANELLVPINLGSYHMLKAQDRIIITKDGVVIIDAPYDCNLGLLLEKSEDNAYII

SEQ ID NO: 12421 - protein, 924 aa, Megasphaera genomosp. type_1 str. 28L
MKEEKKRHCLWAKKNECKGLLKWLPLWQHLTDAWFVMGFLWDTWVCDGQKEELRNACGQLSREKIKLVLQFIAYIHDIGKATPVFQTMKGYGNSSDLDTALLEKMERGGFTGISALTLHERIHHTQTGQVILLHLGVREDIASIVGGHHGKPLDEDWKDDDISYSAQYYQVEDEYNLIYQKWQEVQQEIVTTALAKSGFDCVEALPEITQPGAVLIEGLVMMADWIASNERYFPLISIEEEGCMTDDEERAQTGCEKWKQEWQSHNWSPQEIPIENIYRTRFGFAPREEQKKFSEAVAAVENPGMFIFEAPMGLGKTEAALVAVEQLAYKKKQGGLFFGLPTQATSNSMFDRVLHWLEAVAKEEDSLLGIRLQHGKAALNETFQHLSSSMDPDGGGSVVVNQWFGGRKTTALDDFVVGTVDQCLLLALKQKHLAFRHLGFSKKVVVIDEVHAYDAYMSQYLYRALTWLGAYHVPVVILSATLPKERRKKLIKAYMKGCGYKEKDFIMRTAAWDTEAYPLVTCTDGQQVKMMKDFPKKENTEIHLEKTAQPIIELLPPAAKGQGIIGIIVNTVKKAQEIAEECVNVYGEDCVALLHSRFIATERIKKEKQLSAMIGKGGVRPDFKIIIGTQVMEQSLDIDFDMLITELAPMDLLLQRIGRLHRHEKVKRPEIYKKPKVYVVGCSDTLDFDKGSTFVYHPYILTRTQYFLPNQVHIPADISPLVQRVYGEDNIEVSAHVKGMYEDMKIKWQIITENKENKAGTYRIEPPVLEKKKTQRSSLIGWLENSNQAANESEERAYMQVRDIQETIEIIALQKVGSGYGFFHERKDISKDIENPETAKRVAMETLSLPAILSNPNNVDETIKLLENQNRKELSLWQEQLWLKGALGIIFDEKGEAVIQGIKLKYDSVYGLQYEKVQDGTERM

SEQ ID NO: 12422 - protein, 864 aa, Streptomyces viridosporus ATCC 14672
MRAVRGSLVVSLSVGCRPEVWCGGSVGAGVVGRKGVWPGWWVGLDGWVAGVERGGVDVRGGWGKAGGGRVPHPLICHALDTAVVAEGLVDVLVGPHCRAELDRAFGPLGDAVGWVSVLCGVHDLGKLSPTFQGLREDIAAPAMGPVAAGYIRRLTRWRGPGARTDCHHGLLTAVHMARILKAWGTVPATARTIAWALGGHHGVIPSAASVRQAREAVGDHGGPWWAGVCDDLVRRVVALWGLPEPEGLAWGEVRLSPEAVVALAGLTSVSDWIASARPEKDYVGTGVELAGYLRQARWDEARKIERLAWRGWRPPRETGFRALFPLEGRPHPVQEAVETVVGRMRGSGIVVVAAPTGEGKTKAALQAAATLVRRFGLRGFYVAMPSRVTSNQAFDAVEQLLAGLGEKAPPVRLLHSAAGDYLKDRRAPADGAEGLRPVGVDVDGQDDGDGEAAEWFAHKRGLLAPLGVGTVDQALMAALRSSHVFVRLAGLSGKVVVFDEVHGYDVHMSTLMDRLLWWLGRLRVPVVLLSATLPARRQHALVESWRAGAAGRIPLEVEAPAAQAYPRVAWADTESDAVETVGVEASLLNSDRTVELVRVGFEARAAWAVEQASAGRCVAVVHNLVRHAVEAHEQILQRVERLPVEERPEVFLLHAKLLQAERARVEAEIRAKFGRPDDREEDLRPRRAIVVGTQLLEEGLDADFDVMVSSVAPIDSLIQRMGRIQRHDRGGSRPPLLLALTGVEEEPGKIAFPRYTTNVYAEAILLRTWALLRGRDRVCCPQEVQHLVDLVYGPDELLACPEGWEKQWARAAEQLGRSIARKERGAEAVRLPQPRDDVQLWELTAKATSASRTRQESYRRDDAR

SEQ ID NO: 12423 - protein, 405 aa, Enterococcus faecium E1636
MERLGNWILCHRCGMRTSVIDGQLADYGYFCTHCLYLGRCDTQQDLYLFDQPEAKPREVVFFWTGQLTEKQTEISKRILCHSEKRHHLIWAVTGAGKTEMLYPILVETLKAGGRVAICTPRVDVCNELFLRYRYVFPEEKITLLHGNTATAYTFTSFVICTIHQLYRFYRSFDLIVIDEIDAFPYNGDAGLAHAVQTAIKPDGRFIYLSATPDKKLLKEIKQTFDIHKLALRFHRRLLPEPVLVFMNNWRQKCKNKKKIKSLVRIIHQLIKENHILLFCPSITMMHRLKATLQEDLPRYEITDVSSRDNQRAEKVQKMREAKYDILLTTMILERGVTFERISVIVLGADHPVFTKSSLVQIAGRADRKGPYTNSQVYFFYEEKTAAIRKACQEIKEMNEEGKKML

SEQ ID NO: 12424 - protein, 405 aa, Enterococcus faecium E1162
MERLGNWILCHRCGMRTSVIDGQLADYGYFCTHCLYLGRCDTQQDLYLFDQPEAKPREVVFFWTGQLTEKQTEIAKRILCHSEKRHHLIWAVTGAGKTEMLYPILVETLKAGGRVAICTPRVDVCNELFLRYRYVFPEEKITLLHGNTATAYTFTSFVICTIHQLYRFYRSFDLIVIDEIDAFPYNGDAGLAHAVQTAIKPDGRFIYLSATPDKKLLKEIKQTFDIHKLALRFHRRLLPEPVLVFMNNWRQKCKNKKKIKSLVRIIHQLIKENHILLFCPSITMMHRLKATLQEALPRYEITDVSSRDNQRAEKVQKMREAKYDILLTTMILERGVTFERISVIVLGADHPVFTKSSLVQIAGRADRKGPYTNSQVYFFYEEKTAAIRKACQEIKEMNEEGKKML

SEQ ID NO: 12425 - protein, 803 aa, Selenomonas noxia ATCC 43541
MKQYLAHIRRDGSAKQTMRAHLLRVGDLMAASAAGIGLSATARLIGVLHDLGKCTKEFADYLDWCRKPGNYNEGKKVDHSTAGGQLLMRRYGDRDVDGLLTVHIAALVIFSHHTGLMNYLGEDGTSDFLRRMEKIDVPNVDLSYYYDTVISESELDLLFEHAVHEFTVLDAKITALDPERGEKYHFYWGMVHKLLLSMLVDADRLDSAEFELEKPLTDEWDTAEIWADFSDKLEQKLTGFSIPPEPKAEKIARLRQKISDDCLESGDESPGIFRLCVPTGGGKTLASMRFALRHAQKYNKKRIVVVIPYTSIIDQNVKEIRDIFHMDEAILEHHSNVITEDDGEDTESMDFRRILTERWDVPVIFTTQVQFLNTVFAGGNSSLRRLHALEDSIIIFDEIQTLPIRCTYLFNAAMNFLKDLCRVTALLCTATQPPLEQLDVPIEMRDNADLTSDLAEVFEGFQRVQIKNICEDGGVSINEIAGEIVHSAEEIGDVLCIVNLTEQARSLYEKVSELAQISERDIHVVHLSTKMCPAHRKEVLRTVREELDTRQEYPEQRLICISTQLIEAGVDVSFPVVYRALAGFSSIAQAAGRCNRHGEMERGIVRLFTLEQENLSNLKDIQQGKKIAQIMLYQQMENEIVTPQIMDEYFRRFYRDHTEKEMCYPIKGRNTIFDLLSANNAGWNACQGRGDKIDLYFMQAFHDAGNMFEVIDTYTESVLVPYKDGDSLIPLFDGKTADKKVFFREMKQAQQYAVNLFSYEIQHLEAWGAVWRTESGVIALRKEYYSENFGVQLEEQQNDYCMV

SEQ ID NO: 12426 - protein, 961 aa, Schaalia odontolytica F0309
MARSFWAKSGDSGSWLSVVQHLMDAADVAGFLFDDYLSEHHRRLMASVWGGDRAKARASFVFLAGVHDAGKVSPQFACQRQDLAQLIRSEGLVVMRKADYAERSFLPHGLVSQFALQEEIAAGGGDGSRALQWAILVGVHHGRYPDAGAVYVARQQYKTQEGSREDDPRWGQVRSEILRWMAARSGFPLVAPGTALPELPIAVASAYASALVIADWLASNEDYFQLRPRPVDEAGKLSIDGYPELTANQQRDRVRRAWKRAAFPTPLRIPTTPSDEVTDFYRHRFGWPASYCPTEAQRAAIEIATHEDPDLMIVEAPPGSGKTELAFAAAEVLMRARGLQGVFVALPTQATTNAMFERVTAWLTSILGDEPQKLGIQLAHGKNSLNESFVKLLARGKSPLEVHDDEEDLGLYASRWMGQRWRSTLSPVVVGTIDQVLLAALKSRHVLVRHLGLMGKVVVIDEVHAADEYMETYLEAALTWLGMYGIPVVLLSATLPPARRLALLNAYRRGRGSSGVSAESVDVMIGYPAISTVSAAGVRVHEIVGEAEVPKRIIPTSLGSPLEIAELLDRELAYGGCAVVIRNTVREAQETYEAVRSVFGREQSTLLHSRFLAAERAARDRRMLELFGKDSQQRPFRHVVVATQVIEQSLDVDFDLMLTDPAPMDLVLQRIGRLHRHDRAERPSGLRGARCLLIIEDMTSDPWAYSRGTDYVYARYAVLRTLGIIAGRGEILVREPRDYAELTTLAYDDDTQVGPTPWREAFDAALEERDKARAQAQAKATTWCLGEENTPSWQSLELEEKFLGNATTGDESKGPGVAAARAAVRDGEDQIPVLVVALDPELGNVPMAPPISGAPEGDTPLAVGEYNARGRIADICSWSISLPPWALRARGQSIDEAVDAVAGAIWDDPITTEWSCREHPFLAGELILAMYKTPDGERLTRDLCGHTFTYSLERGMEVQGQ

SEQ ID NO: 12427 - protein, 727 aa, Listeria monocytogenes J2818; identical to SEQ ID NO: 11873

SEQ ID NO: 12428 - protein, 814 aa, Parascardovia denticolens F0305
MIMEDLLARRDQSGRTQTLQSHLSGAAALSGAFEGEFSSLARLAAFLHDAGKASKNFQDYLLSDDGIRGSVIHAWQGAFMINDLDAQNGYAKIAQQLLELVISKHHGELPDCVNQDGMESFFDNFSAENKQGEKYSYNEVKRNLNDLQPQISRLFLEATDKIGSFWTKMSEIRNAQGNQLSGESKFFYLGLLAKYIYSRLVDADRTDAASFESRTTYQPKIVQWEELISKLDKKMSGFDSTTSINAIRSKISQACRQASDRKTGIYKLAVPTGGGKTLASLNFAMRHAQKQGKRRIIYVIPYLSITTQTSQTFRDMLDLSENNDLILEHYSSAMNETIEEITKERTDEEKEEESAKSKKRKLVAEQWDNPIIVTTMVQFLETIMSARGTNLRKFHNMAESVIIFDEIQSLPTDTINLFNEIVSFLSEILDSTILLCSATQPLLEQTNRDNLCLASEPNLIKLNEHDLGLFKRTNIVASTKDKDCDELAEFAFDRARENGNCLIIVNLKSKAKNIYRALRKLDEDKQFDLIHLSTSMCGKHRKDKLNHIRNSSKSSEAKPIICVSTQLIEAGVDISFSCVVRAMAGLDSILQAAGRCNRNGESPTPKNVYVFPVKDEKGLSYLPDIKLGKELMSQLIREYPDEDLLSDAMLTEYYRRYFARLQPDDRKQFSKMDYPLKGFHTSAYDLLARNRMWRGTYKNRRGADFPYYYAQAFKTVSDNFHLIPGAACNVIVPYGDSGELLELLSVSDMDTRYKALHNLQDYTISLFEWEEQSLRESHAIDLVDDTFEIYVLDQEYYNEEYGLAVEAPMPLQMY

SEQ ID NO: 12429 - protein, 900 aa, Komagataeibacter hansenii ATCC 23769
MLDAGDDMLKFFWGKAQSGDEKKPGEPDYHPLVAHMLDVAAVAVLLPGNVHTGLDRRQLGLLVALHDIGKIMPAFQAKVPACWPHQALGPYADAVTLSRHDVDGLLLLDYVCEDVLAPLFGVDDNGFDWSPVDKRQIWRAIAGHHGQPVAVTGNRARGLQKAVCGVYARQFCTLLFDIFRPPPIPCLSPQDLLRLEWRLAGLTVTADWIGSRREWFPYVTPDAVQDAAGYFWNHALPHARTAIARAGLGPVDVAPFRGIGRLFPRVSIPSPVQALMEGIDIPEGPTLVVIEDMTGAGKTEAAMVAAHRLMASGHANGLFVALPTMATANAMFDRLASAYRGLFQPSSHPSLALAHGRARLDERFVSVVAPDDHVDGMSVQAERTDAAEICCSAWLGSEARRALLAQVGVGTIDQAFMAVLPVRFATIRQAGLAGKILLVDECHAYDPYMHEEMAALLRFHAAMGGSAILLSATLTQSVRHKLTMAFREGLHHEGGAALSSTAYPLVTLVARAGVEELPCAPRPGLRRDIAVRCLADGQAVMVAASNAARQGAAVAWVRNTVDDVIATAKLMAQEGTAVTVFHARFAMVDRLAIERDVLARFGRDGDDTVRAGVLVASQVIEQSLDLDFDVLFTDLAPMDLIIQRAGRLRRHERHGRPVDREEVWVLSPEPVDDPDPQWLARLLPGTAAVYRDPALLWRTARVLQRVGRICTPDNIRALIEEAGDDRMVPPGLMAASDEARGKGWAARGAASRNVLNYATGYAPDGALWERDVSTPTRLEERPYVTVRLAVIRDGQVLPWAVLKDSSLAPPEALRRAWALSEISVARHSLAACAVPAVWAGAVMTARAAWSRWEREDETQFLLLLLDEGEDGMEGRGYDEKGKEIVIRYDQQYGLQMLPVS

SEQ ID NO: 12430 - protein, 773 aa, Clostridioides difficile NAP08; identical to SEQ ID NO: 12161

SEQ ID NO: 12431 - protein, 852 aa, Clostridioides difficile NAP08; identical to SEQ ID NO: 12159

SEQ ID NO: 12432 - protein, 802 aa, Clostridioides difficile NAP08; identical to SEQ ID NO: 12160

SEQ ID NO: 12433 - protein, 891 aa, Roseomonas cervicalis ATCC 49957
MFNEKILALWGKATPGSKTDILFHPLLAHMLDVAAVAWGLPHLALTGIPRSTLAFFVALHDIGKVSRSFQALAPAAWPTALLGSLPEHRVAAPPRHDVLGLYWLECELTDLLEDLLPRSGGWRSRAARRQLWRALAGHHGRPVEPLSTAPGPAILCEDCRLAGRDLVLGLKELFQPEPWILPLGSDLKAISWHIAGLVTHADWIGSRQAWFPYTAPDDVADVQTYWQRARAQADKALAAAGVLPVTIAPSGGWTRLFPDIQQPSPVQAWAEAVDLPEGPCLAVIEDLTGSGKTEAALLLAHRLMAAGGAEGLFVALPTMATANAMYGRLQDSAPRFFQAGAVPSLALAHGRADLQHAFRETILPDPAFSTPATALEPGEETAEVQCSAWLAEDRRRALLAQIGVGTIDQALLGVLPVRHAALRLRGLASKVLVIDEAHAFDPYMDEEVLTLLRFHAALGGSAIILSATLPQKKRAALIGAFREGLGVTQPPELTASSYPLATLAGAASLVEEPCAARPGLARDLPVRRLPDAGAALAALRQAHSAGAAAVWIRNTVDDVLAAAEALRGQGIEPLVFHARFAMQDRLLIEAEVLRRFGKSSSGKARQGILLATQVVEQSLDLDFDVLVSDLAPMDLLIQRAGRLWRHRDRNGRPVPSPELLVVSPDPVEAPAADWLRAALPGTAAVYHDPALLWRGARALFQRGQICAPGELRSLIEAAAEGETPPHLAAAADKAFGEDRAAGGQARQQVLRWAEGYTTTSGDWRPDTVTPTRKQDDPRVTLRLAVLRQGSLTPYAEAEEIRQAWSLSEISVSRRRVVACPVPAGLEAEARAVRAAWGQWLSEAPDVLLAILEPEPKGTGYRLAVESRSGDAAVLRYDARQGLILHRPASAG

SEQ ID NO: 12434 - protein, 852 aa, Clostridioides difficile NAP07; identical to SEQ ID NO: 12159

SEQ ID NO: 12435 - protein, 802 aa, Clostridioides difficile NAP07; identical to SEQ ID NO: 12160

SEQ ID NO: 12436 - protein, 773 aa, Clostridioides difficile NAP07; identical to SEQ ID NO: 12161

SEQ ID NO: 12437 - protein, 836 aa, Neisseria polysaccharea ATCC 43768
MNFDYIAHARQDASGNWHPHPLQDHLQKVAQLAKRFAGRYGALFAEYAGLLHDLGKFQKAFQKYIRNASGFEKENAHLEDVESTKLRKIPHSTAGAKYAVEQEHLNLFFGHLLAYLIAGHHAGLADWYDKGSLKRRLQQADDELTASLSGLAESGLSEDFFPLSEDDLKRDFFGFWKDSAKLEELHIWLRFLFSCLVDADFLDTEAFMNGYADTDAVQAAGLRPKFPSLDELHRRYEQYMAQLLEKTDKNSTLNQERHIILQQCFSAAETDRTLFSLTVPTGGGKTLASLGFALKHALKFGKKRIIYAIPFTSIIEQNADVFRKALGDDVVLEHHSNLEVADNKETAKTRLATENWDAPLIVTTNVQLFESLFAAKTSRCRKIHNIADSVVILDEAQQLPRDFQKPITDMMRVLARDYGVTFVLCTATQPELGKNIDAFGRTILEGLPDVREIVADKIALSEKLRRVRIKMPPPNDETQSWQEIADEIAARPCVLAVVNTRKHAQKLFAALPSDGIKLHLSANMCATHRSEVIALVRRYLALYRAGSLHKPLWLVSTQLIEAGVDLDFPCVYRAMAGLDSIAQAAGRCNREGKLPQLGEVVVFRAEEGAPSGSLKQGQDITEEMLKAELLGDPLSPSAFAEYFRRFNGKGDVDKHNITRLLTAESSNENPLAIKFRTAAERFRLIDNQGVALIVPFIPLAHWEKDGSPQIIKANELDDFFRRHLDGVEVSEWQDVLDKQRFPQPTDNSFGQTDSPPLPEPFESWFKFLESDPLKHKWVYRKLQRYTITVYEHELKKLPVHAVFSRAGLLVLDKGYYKAVLGADFDDTAWLPENSVL

SEQ ID NO: 12438 - protein, 775 aa, Finegoldia magna ATCC 53516
MNDIEDALIKEIYSNNLAKPDETLYEHTKLLLDNFEILKNLGYLNSNVNDIEEILYLSCLYHDMGKINPVFQERLKNKNKFDKNVEVGHNILSTFLVNSFLDDKSGRKNNLIRCAILNHHNYIENFTYLDAEINEELIEKNLLEINDKFLHLDSENIEEMMDETLDFQNIYEMKRIQKTYEYIIIKGLLNKCDYAASAHMKCEIKNDFLLNSLESLNYNWRDIQQFCIENRNDNLVIVGSTGLGKTEASLLWGADNKIFYVLPLRTAINAMYERIKNLVKNDYDKKVAVLHGQTDSVYLKELNNDFSVKNENEKFYEYYKNTKKLAMPITVATPDQLFDSVFKYNGYEFKMATFSYSRIIIDEIQAYSPDILAYTIYAIRLINDLGGKIAIFTATLAPFVKDLLTKKSSITSEYKFKDFECKYHCFLSENKRHSMKIVEKELDSEYVEEILNKRENIRTCLIVRNTIKSAQELYNQLNNNLDCSKYEVNLLHSKFTVEDRKQKEVEILKDGNPKNVNDKIKVWISTQIVEASLDIDFDIMFTELSELLGLFQRLGRVYRKRTLESDIPNIYVFTEISEKQISSAYNSYGFIDQTLHDLSKTALKEKGDGIITEEEKMNMINQYFTTEKLRNSDYIKKFNQVFNKIQSLSPGKMELSDVKKEFRNIVSFRAMPINIYNSGDIAKLIEQINNCYRDMIALDGEQKNAEKLKLIKLQDKLSDKTLNVNISDINPKNFFTAANEKIYITEKFYDNEYGLLNDELVDKFDLQPNSGGIFI

SEQ ID NO: 12439 - protein, 749 aa, Pseudomonas savastanoi pv. savastanoi NCPPB 3335
MNSQASSSDSSAFQRLHPNVQQWVWSQGWTSLRDAQEWAIPALIDADRDVIIAASTAAGKTEAAFLPILTHLLNNTDAPGAVLYISPLKALINDQWDRLTRLCEHLEIPVVGWHGDVSASRKHRFLKSPSGVLLITPESLEALFVNRGSALAGLFQPLRYIVIDELHAFIGSERGKQLQSLMHRVETVVGKKLPRVGLSATLGEMALAREFLRPGQGQRMDEIISQTSGQDLQVQVRGYTMLPMKKLAANLQMVVTKDDDNDQDEEQKEDVSGTRHAIAAHMYKVLRGSNNLIFPNSRDKVEWYADRLRHLCENDGLPNEFLPHHGSLSRDLREDTERALKAGSPPASAVCTTTLELGIDIGNIKAVAQIGPPPSVASLRQRLGRSGRRAGEPATLRAYCQEDTLTPDSDLSDQLRQNLVQTIAMIRLLIEKWFEPPRANGLHASTLVQQCLSTIAQQGGAHASQLWNELIASGTFAAVDKNDFMALLKTLGEKKLIVQDSSGLLLPGEIGEKLVNHYEFYSAFSSDEEFRLLLDGKPLGSIPVSRPLTLGQRIIFAGKRWQVMDVDLEKKVITVKRARGGEPPVFDGLGAKIHDRVRKEMRAVLTEVTPCPFLDANAQVLLAEARQTFHRLGLADQCLTGSTSNSYLLTWAGDYTNDALCLLLNQAGVMCTASGLVLEISASQESVLTALGRIAELDATDVEPLLKDVKNLIREKWDWALPNSLLIKSFASSQLDIPNAIALAKTLTA

SEQ ID NO: 12440 - protein, 721 aa, Desulfonatronospira thiodismutans ASO3-1
MQYYAHTLENKPQREWQLLEVHLRQVAEMTAKHARVFSASDWGYILGRLHDIGKYRQEFQDKLEKQSSRRVDHKGVGARLAWEYLGQPGKLVSYCIAGHHGGLPNYGHSQTDTSTSLMDLLQQAGVLPDHAPDPVSDISLPSLPFQPRSAFQLAFFTRMLFSALVDADFLDTERFMEPEKYAARNPGPALADLLQPLNAKLAGFSNEGRINLLRREILERCRENASLEPGLFTLTVPTGGGKTLASMAFALEHSQKYGHRRIIYVIPYTSIIEQNAQVFREIFPPDSIIEHHSNFDERSLPEEADQFGPGLRHRLACENWGAPVVVTTNVQFFESLYASKPSRCRKLHNLAGSVIILDEAQMLPVKYLNPCLRALEELAENYQASIVLCTATQPALRKRDDFKHGLDGVREIAPEPKRMHREFLRTRLKDAGRLDLEEVANLIRDKEQVLCVVNTRARAGNLFDLVQNEPGARHLSALMCPAHRSLELKKIREVLMDGAPCRVVSTQLVEAGVDVSFPEVIREMAGLDSMAQAAGRCNREGELDDLGKVTVFTPSEGLAPAFSQAAGSAHSTLRHYGHDPFAPDAVEYFFSETYWLQAQRLDEKQILDEFRAPAPKWAFRDVAKRFNLIENFMSPVIISFNEEAENLIERLRFAVAAGGTLRKLQHYIVQIYTHELAALDEAGAIEYVDGQYPVLIDKELYSAKQGLKVPREPKTPDGFVC

SEQ ID NO: 12441 - protein, 711 aa, Prevotella oris C735
MIHEHILAKHEGMGAIPLAAHLQEVAAAAVVIARNGGLNESLAHKGAILHDIGKVSPLFQAQLKYGYVRPPHFIFRHEIASLFFLSLLKEEERPEILEMIIAHHKSTLNDVSHKGLLDLDDNLRDCFKTHICGFQDWRISALEILEDLGIQGREISVEEARDNYDYAVDYCWSMNDGCSRWKGVLMAADHYASALSEKSETNLEKLFVKPNLTFYNRENDLYPLSLISTVDRRLHTIVTAPTGAGKTDFLLRRCKGRVFYTLPFQASINAMYDRIKSDIGDTGAQIHLLHSTSELKVEDCCLEEQIMQRHIGASVKVLTPHQMSSIVFGIKGYEAMAEDLRGCDVILDEIHTYSGEIQSIVLRIIEILLVLDCRVHIGTATMPTVLYKKVLALLGGPTHVYQVSLPNPILQTFNRHIIHKINNWEDGYGIIDYALKSGNKALLVCNQVKQSQQLYAILSDLYPNVKKMLIHSRFKRQDRQRLETALKEDFNMSDESCIVVSTQVVEVSLDISFDLMITACAPIDALIQRFGRINRKRTKQTIGHYKDIYVIKPPKEKSDALPYNLDVLRRSYDALPSDCILEEMHVQEMLDKVYPQIEVANIDYSGAIYVNGEWQIKQLCHHGKSALLDTLDIDVAVCIVESNRELYEQGHPNERIKFEIPISYKAIAYKKLDVSQQGHHPYIIPDRAYSEEMGLLIDYVNPEYYQSFEII

SEQ ID NO: 12442 - protein, 742 aa, Lysinibacillus fusiformis ZC1
MFEKLLAKSATKTSAAQTIIEHTNHLIKKWEIFRKIYPNALSKKDWDILLQAVKYHDLGKANTKFQNKVRTIEERIEDLFPEIDEIPHNYLSCAFMPIKNLITHYGKEDATLLILAVYYHHERAEQNMYESGDEIKKDLQKYVSLLNDDFNIREEPKFDYRKFTDRTFLKNREQLYRFVRIKGFLNKLDYAASGDYEVEIPPEDLPQKMKKYFDNKKRTRNELQDYLYTLQQENHIVIASTGIGKTEAALWWLGNDKGIFTLPLKVSINAIYDRLINEIGCSKKNTGLLHSGMHAEYVKRADEQDLDLKTITHAKNLSMPLTVTTIDQIIDFVGLYPGFEMKLATLAYSKIIIDEIQMYSARLAAFIVLGLKYVTDIGGKFLIMTATLPPLFIEALKRLEVPFEKREDPFLKFAANNQPIKRHFMQIVEKDLTIEEILKHPMEKKVLIIVNTVTKAQQLYKEFEETGVKASLLHSRFITKHRQEKEDAILALGNKDCLNTGIWITTQLVEASVDIDFDILFTELSEASGLFQRMGRIYRTRDYVKNIPNIYVFTGEPLPSGIANNKKSVVDFTIFSKSKEVLLQYNNQLMDEKIKMEIVEQVYSREALGAECEYIQTFDETLAWYEDLLPYQEENKPTLRDIQNQLVIPYGVYRENELEIENIKNELSKRLAWQAKINLLIELQKFTVPIATWAYDNARKRKNGEVTSTIRVDRYTEYPVVTYQYTEELGLIFVNDVDAFFQ

SEQ ID NO: 12443 - protein, 805 aa, delta proteobacterium NaphS2
MDCIAHSAPKKHPGRKPHLYSDHISEALQYGLSQLDHLLSFSNFSSQEKERIRDSVVAAIMLHDMGKLDELNQEILKGEKSGRLPVDHIEAGVAIAASIQNELMGWLIRGHHAPGLPSKKNEKFFIKQLNTETGCKFLPTSLRGRRYKRSKADAKTKEDYQSHFQAVERTEGNLPDYKKLQEGSCGGWPEISMQLPQSGLTTRLLLSCLVNADHESAATYTNNSEMPVFEPATTRWEERLAALSRYVKELPRDPQNKRHNLRDLFYKHCREGELFSSKIMMCSASVGLGKTTSVMAYLLRKSIQDHSSRIMVIAPFSNIIDQTVKTLRKSIVLDGEAPEEIVAAHHHKAEFSDENMRQYATLWQAPIVVTTAVQFFETLAGAHPSKLRKLHSIAGASIFIDESHACLPVEFLKITWYWLRKLCDEWGCNIVFSSGSMVEFWNDPYILGSEDEGKARLEVSCQKLPDLFPKELQRNTQKCETKRVEFRKIQNPLSLDGLIALIQSEDVWENYYKSEKPSCLVILNTVQSCAIVADSLARALDDYSKEKIENKKVLHLSTALAPKDRERILKEILRRQDDSEWNTSPWYLIATSAVEAGVDLDFSIGFRERCSVTSFLQVSGRINRHGKRGAGVLYDFSIIPDDGLTLHPGFREPSMVFDSLWEELTSPELSLTSISTRSQRKEFSRFNEKKERRNLLCLEEAKLNFQEVAEAYKVIDSDTATVIVDNGIVRKMEIGIPVSWRDIQENSVQLWSNKISKLNLRPIRNSSQDRIYSWIDTYEYDSRFLGIMGGLLRIENFFKYDGGVF

SEQ ID NO: 12444 - protein, 922 aa, Peptoniphilus sp. oral taxon 836 str. F0141
MNTEFNKINKFLWAKKNDKNGVYKWLPLRVHLEDTRQVIGLLWEHWLSEGQKNYINESIKDNGENYGKKISTFLGACHDIGKSSPVFQTSISYIGKNDFDNLLVERLENDGFANLSNFTDAFRNKSHHTIIGQTLLDFYGVSEDISAIIGAHHGKPINYLKEVRDQVDSYLYNYFQSSDKKNSTYIKWEREQKIIFDWALNSSGFNSVADLPKIPKPTSVILSGLLIMADWISSNEDYFPLFDIDTYEVCDSNSRIENAWSKWWTSDKLQINNISNYLDIYKKRFNFASANEVQKVFSETILDCKNPGIFILEAPMGIGKTEAALSGVEELIYKKELSGLFFGLPTQATSNGMFKRVEDWLNSLAEENNERLSIHLVHGKAALNEDFAKLSQNIDQDSPESGGALTVNQWFSGRKKTSLDDFVIGTCDQFLLVSLKQKHLALRHLGFSGKVVVLDEVHAYDSYMSNYLYMSLEWMGAYNIPVIILSATLPIERRIEMLRAYMRGRGLKWRKVNKTNDLESFAYPSIIYSDGDTIKVKNRFKKLSDKKVKIIRENKDNLVNLLIDLYKNKGVIGVILNTVRQAQELAKICKEKFGDDSCYLLHSNFIATDRAQKERELLNLVGKNAKRPYRKIIIGTQVIEQSLDLDFDVLISDICPMDLLIQRIGRLHRHDIERDSYYKVPKAYVLGCNKDYDFDDATKAVYSPYILMRSQYFLPKEILIPTDISPLVQKVYADEKISLDETLMSFYEKYKIEFEVKVGRTNNKASVYKLEDPGYSEDEKYTESLVGWLKDIDISLTEEKAYARVRDINDTIEVIALKKIGEGYGSFIDNIDISREIESPKIGKEIAKQTLRLPLVLSMYGNFDKTIKELEDYNRKFLKCWQDQRWLKGSLGLIFDENNTALLNNYRLTYKRDVGLIYQKEG

SEQ ID NO: 12445 - protein, 729 aa, Listeria monocytogenes FSL N1-017; identical to SEQ ID NO: 12000

SEQ ID NO: 12446 - protein, 778 aa, Thermoanaerobacter sp. X561; identical to SEQ ID NO: 11626

SEQ ID NO: 12447 - protein, 982 aa, Streptomyces viridochromogenes DSM 40736
MRRHFFIWAKTDQRRISRRRGGPAWNPLLAHALDTAACVAQLWDRYLPLTAWARLADAFGGGREDTARRVVMFLAALHDLGKGSGCFLRMFGTSRWDGPYLRQARAMWEQQARAAGLPLGENLDAQPGARHEHITALHMPRLLGCTCEDCGGAGSPSTGLHTAAALLGGHHGDIPSPDTIGRAAMAADIAAWLPIYSELIQDTAELIGVDLTTLPKLVVPERPSAMVLFAGLVILADWIASDESHFTYRSLTTSPPQWWHASNMQARAAVTRLRLDAWQPDPAADWTDLFPDTRPRVFQSAAMAALPAAGPALVIVESDTGSGKTHLALWCAHHLAVTCGYQGLYMAMPTRAAANQTAREIAAFMDRALGEQNTANLAVVHATAEATDFVHQLLDAGRTRAQAALDGLEDFISTPSPDDPLQRRAVLSPWYLRRCLGLIAPFAVGTVDQVALAAQPSHHWMLRMFGLAAKTLIIDEAHAYELFQQGLLEAAIAWLADAGASVVILSATLPTATQTALTRAWCEGHRVPVTERGQTGPITVVDHHGIITRTGRTDDTDRSSHGERTAPAELHTFIDFLPDPGTAALAARLFDEAGKGGITVVMRNRVATAVDLYRSAAHCAQTHGWSPSEIVLLHGQNLPRYRLPGEDLLTRHLGPGKDRTRRNPERPDRLLVIATQVAEQSLDIDFDRIYTDLAPIDVLIQRRGRVHRHQVNDSSRPEAFRRPRMTILIQPGANELPMVEPPNPGEARPQGNPDSHVYPPYLLAATWYALVQRAREDGTVHLITPADTTPLIEEVYGPKPTVAHALGELLDRTSRRLQSEHGKEEGQSLSRAFRPFTRRGRSIPVTDLASGKSHGSGDSDGIVGIRAISRLSEPPIDAILLYKQPNGILSYDRSGQRRADLARHGADSPARRRQQKDLLLNTASLPAHWFTGNNALPPPETWPPIPRPALRNRYVALLNPSTGACISGPTGITCSPATGLAR

SEQ ID NO: 12448 - protein, 774 aa, Desulfovibrio sp. 3_1_syn3
MLYAHSLPDQPVSLWQSLEQHLRKSAQRAETFGRAFGAGDWAALAARLHDLGKASPEFQAYISGQGGRRRIDHSTAGARLLLRHWKTRGKEGEHMALWLAYCIAGHHGGLPDLGDGASDAGSLRSRLDPSYAVPDYSAGLDLATPADIPQPGALPFPFRLSREHAAFSVSFFVRMLFSCLTDADFLDTEHFYAPENRQQRDRWPSLDTLCERLHDFLSAQGFLLATSGDSPIVAARKEILQHCLNAAALPPGAFTLTVPTGGGKTLSSLAFALEHARRHHLDRIILAAPYTSIIEQNARVLRDALGADAVLEHHSNYVHPVEQAAADQTGESDALQGAAALPFRLAAENWAAPVIVTTAVQFFESLFSSRPSRCRKLHNMTRSVVILDEAQMLPVPLLEPSVLALRELTEHYGASLVLCTATQPALRRDGPLKNGFAKNSLRELIPAPRMAELFKTFTAHRRLTISQPGKLSDEELARRLLREHQVLCIVNSRAQARAAYESLERDDDAHFHLSARMTPRHRLLVLDTIRQRLRRGLPCRVASTSLIECGVDISFPCVYRVRCGLDSVAQAAGRCNRSGELPSGSLHVYTPERPVSRAQADLYLRARFFSQVAEKHADILAPEAVEAYFSELYGFADLDAKHLLKTLREKNRRFAVPHIFDFRTMDALYQLIPEDTAPVIVTHGVNDGGDLAEKSHALVRRLETEYPPHRLTLRLLQGFSVQVYPYELERLRAAGNLERLHGCFDVLRSGAGYDPKLGLLVDDPTRQTPEDCLF

SEQ ID NO: 12449 - protein, 775 aa, Paenibacillus curdlanolyticus YK9
MKADVYMVCIQNQWKAAWTLELQTDMAFWQHEWREEAVMWRWDAKLPLSLAEEAVSRWHEGEGDEREQGESLRLMQRCIEAALLANEKGSCKGGAFRRVDLQLTETRGAAAVPEHVLQAVAARLQGRATLAGEALALLAASSELACVAIAAGGWSALAPALQLASLRGLLRLRSAVAPLPPPASPWRRLLPAPLRRGRPWRRRCLRCGSGEARMNRTACAACGSSACAYCEACLTMGRSRECGLLILGGGDSRLADAHGAASAGRLAAPGFAAARAAAAPAPSAEPSPRWGLSPAQHAAASAALRYARPRLAALAAAAGTAAQDAPRSEAGAWPSLPGRVPAAAVQWPIADRARPPEPACPSLPGRVTATATQWATANRAHPPQSACPSPPGHLPTTAESPSLPPIALAPSSAHSPSQPAAPFLLWAVTGAGKTEMIFPLIEAALATGGRALIATPRRDVVLELDPRIRRAFPEASVATLYGGSDQRWEDGQITLATTHQLFRLHERFELVVVDELDAFPFHGDPLLYYAASKAGKPGGATILLSATPPAHLQRAARKQLIEYARVPVRFHRHPLPVPAYLRMPRVAQVLARQSIPDLLRRKLQASIDRGAQCFIFVQQIRHAEPLAALLRRAMPNLPIGATSSQDAERSEHVVMFRERKLRMLVTTTILERGVTVPNSDVFILDADGKLFDEASLVQMSGRAGRSKDDPAGRVYFCASNRSEPQRRAIKQITSMNKEASVRGFLLPSAERARPPKASHSQQQSTRPISKRGRLR

SEQ ID NO: 12450 - protein, 915 aa, Peptoniphilus duerdenii ATCC BAA-1640
MLAKNFWAKKSDRDGTLKWLSVIDHLQDTAGIIGRLWELWLDDSQKKMITENLICEEDGKKLATFIAYVHDIGKVTANFVTKKSFTNSEDLDSEVLIKLERCGFKGIHNLELANANKSHHSIAGQVILEKFGVKRDVSSIVGSHHGKSVNSLEDIELQLSSYSANYYGEENCSSDNLFRKAQEELFNWALKKSGYSSVEDIPEISVPVQMILTGLLIMADWIASNEYYFPLIPIDDESACNPQVRIIDGFNKWRMSDTWIAEDVYEASKIYEKRFGFNTPRHEQQVLFDVIEQIDEPGIIIFEAPMGMGKTEASLIAAEQLACKIGKSGLFFGLPTQATSDGIFPRINDKWLKSISEDMGEKLPIRLKHGKSSLNDIYRHLSRNIYEDDFTPGTFVNEWFSGNKTSVLDDFVVGTVDNFLMMSLKQKHLFLRHLGFSKKVVIIDEVHSYDSFMASYLYQSIKWAATYNIPIIILSATLPSERRKELVKNYLIGKGIKNIEIKKQLSSLNTDSYPLITYTDGEEVRIFDEFKTKHSKTIEIIREDSENLLNLVEDFSNEGGVIGIVVNTVKKSQEIAKDLTFKFGEENVELLHSSFIATDRIKKEKNLMKIIGGKIEDRPKFKIIIGTQVIEQSLDIDFDVMISDLAPMDLLIQRMGRLHRHKNIRPEIFKEPKFYVLGTSDVLDFEKGSIAVYDGYNLTRTQYFLPDKINIPEDISPLVQNVYGESEIELKEELLPIYKDYKYKFEAYTKNKKQRAETFKLREPYERSRFTDVNNLIGMFTTSKDFSGKSEEQIYAQVRDIKETVEVIALKKVGEGYGIFGEDVDISKDLENVETLREISKHTLRIPSSLTFSSAQVDRLILNLENYNNKYLRNWQDKSFLKGCLGIIFDEEGEFLLDGVRLKYDEKLGLMYERM

SEQ ID NO: 12451 - protein, 789 aa, Erysipelotrichaceae bacterium 3_1_53
MKILAHINSNQEEQSLQEHSVNTFAAIEKYAAARGLTNCMKLTAFLHDCGKASQSFQEYIRKAALENIFLPKVNHSSAGAQILLEVCQQYTTNDDTLVKLMLAQTIVSHHGLSDFFNVSGENMLHKRCYPEKELDMKHIKSYVDKVTNSQELSTLFIAAQQELFKYVTDIVQQNTTKDYIDIFFHLGALQRLMLSLLIHGDREDTRNFMEHTRTASYQEDSIWKAASENLESHIVKITKKSTKNKINELRTDISNQCKEFGCQPSGIYRLSCPTGSGKTLASLRYALQHAQVYRKKHIIYVAPYKTILEQNAEVMKQFFSEDIVLEHHSNIIPSEYTDYDYYSSSWNKPVILTTAVRFFDTLFKDRTTDVRRFHQLADSIVILDEAQKIPVKTVSMFNEMMNFLACHCNTTIVLCTATQPLLEKTTYPIRLASNSEIVQQTEELHEQFKRVHIEDACRSDGYTMTDVSDFIFQKLKPGNSLLAIVNTKAEALDLYHACKLHHELHDMYLYHLSTGMCPDHRQDKLKEMEEHVIKKDTVLCIATNLIEAGVDLDCDIVIRSLCGLDSILQAAGRCNRNGKNDDLGTVYLINSSEEHIDKLTDVKKGQNETSILLAQLHKSKEGSNVDELLSLSYIEQYYESYFFSRRHDMGYSTVVDGKKVTLFDLLTQRGHPTKNSEALFHPYLGQALKSAGHKFEMIDSDSIGILVPYGGGSELIAKLQSSISNAEKYALLDQAQRFMVNVYENKYKEMMKEDMLVQLEFNGMLVLKEGFYKEDTGLEIKKELEDMFV

SEQ ID NO: 12452 - protein, 918 aa, Faecalibacterium cf. prausnitzii KLE1255
MLGTWKAHTGKGAKMRRTLNKTRFLAGKTDPENTSLWLPLWMHLWDTAGIMERLVRQWLPESVKRAMGFECEEALLAHARFLGGIHDIGKATVAFQANILRTLPEARQRLETLTPLDCPEQNRRESPHARAGEAVLLWDDCPGGIASIVGAHHGKPQSCAAVDDQLEGWESNYYPKGQKKVWEDFWTELLMTVLQDCGFDDTAELDDLNPQEEVLLTGLLIMADWIASNTEYFPLIPVEKLGSMEDYPARVDRAWEKLALPFPWEAQPGIADPQEFAVRFGFAPNAVQRAVLEAVDTAAEPGILILEAQMGVGKTEAALAAAEVMASRFGLGGVFFGLPTQATANGIFPRLLGWADTQSEETLPQAIKLAHGMAELNECYLRLQGRGVQLEEDAQEAHQVQVHQWFRGNKQALLANFVIGTVDQLLLAALAQKHVMLRHLGLAGKVVIIDECHAYDTYMNCYLDRALEWLGWYKVPVILLSATLPARRRAELVEAYQQKKAVPDAPWKTSCGYPLLTWTDGAEVKQTAIPPDAPGKTVQLTTLIEPELPALLRRKLAEGGCAGVIVNTVKKAQKIAQLLRESLPDKEVQLFHAQFLMPDRAARENQLMARIGKGSEPERRNDLIVVGTQVMEQSLDIDLDVLVTELCPMDLLLQRIGRLHRHRRSRPAPLQQACCAVLDTGEDAFDAGSEAVYGQWLLWRTRKFLPRSIRLPEEISPLVQQVYGWEREAPGGAQGEKMRCVYEQTQEKKKARAEVYLVPQPETHRLAQLNTLDDWMQNEGARSDPAARAAVRDGDPSVEVLVMQCRADGSIHFLPWQEGGSAVAADSPPPPETALKIARQKLRLPAVFGKAWKVDRVIRELEADNRSRLAAWQLSPLLHGELILLLDENLTARLAGMELCYDRENGLTYQKEETDEGD

SEQ ID NO: 12453 - protein, 849 aa, Lactobacillus iners LEAF 3008A-a
MEKYLWAKKNLVDGVPMWLPLTVHLNDTAEICGLLYEHWLSDGVKYFLEKAIISDVENKEDLLKNLCKFLGAVHDIGKATPIFQTKQSFCGDRELDNLINEKLRQAGFKEVDKYIAERKNNVLHNISGQYFLNKCFKVNLCVANIIGAHHGRPVSQDQVMRECKSYTSSLYQDDNEKTPLAMFWKEMQRGIFDRAMEACNFSCVEDLPRISQPGQVILSGLLIMADWIASNEKYFPLIPIDTDKVESDRVEKGFTKWYRDRAETWEPESYCNDIYQKRFGFEPREVQKKVSDIISKIDNPGIIIMEAPMGIGKTETALVAVEELAKKNSRTGIFFGLPTQATSNGIFSRVEDWLKHCEGEKSIRLIHGKAQLNDQFANLPKSRNIHDEDSIGVNEWFAGRKVAILDDFTVGTVDQVLLAALKQKHLMLRHLGFANKVVVIDEVHAYDAYMSVYLYQALMWLGAYGVPVILLSATLPISKRNELLKQYMVGAGYRFKKLDKPQDFDNNENYPLLTYNDGEKINQFSDFSQECGTDYKVIPKAKDESENIVDLINELTTNVGIVGVILNTVKKSQKFAEQCVNAFGEKNVELLHSSFIATDRYKKEQELINTIGKNGKRPKFKIIIGTQVIEQSLDIDFDVLITDLAPMDLLLQRMGRLHRHSDTKRPENLKKPQVYILNCGNYDFDEASTYVYAKYLLFRTEYFLPNKVNLPNDISHLVQLVYSDNALNLSEDSLNKDYTTYQGKYNADIDKKEQQAEVYRLVKPLKKISQEKNYQIGLKIPIIVQNYQTLMLMLKCEIVLIVWKLSLSKNVKVVMSFLINQGNLIQLIIKLPWKLLSVPFNYLLLLTTA

SEQ ID NO: 12454 - protein, 771 aa, Porphyromonas asaccharolytica PR426713P-I
MSNTKQIAHVRALEDGSYETQPLLDHLYGVAELAQSYAERITDDAELGEIGYLLGLLHDLGKYQEGFQRYIRQQSGLDPTLNGWRTPHSPAGARYAYDLKQVGGNQQLLKILSLCIGAHHRGLYDDSEWRGQVVDSSDTKRAVANLVKGLRPEASQLEELLHKASLDKATKAWNKIEEDDYQLLVRMLFSCLVDADFLDTERFMTPDKSLVRQSAKASLEQMRAQLEEYVSHFNREGRINEARAAFLDQCRNHGRTAQRKIYSLTLPTGAGKTVSSMMWALEHAIAQGCERIIYVIPYTSIITQTAQTFRDIFGADQVLEHHSDVDVKERPDEAMEYTKLMTENWDVPLVVTTNVQFFESLYAHRVSRCRKLHNICNSVVVFDEVQMFPPRLLNPILRVVESLHSAFRVEPLFCTATLPVFDKDILSDSKRFGHEFFFLKEPVQEVVPYDAERFAPFDKVRYHWDLLKLSTEELAERLTEHESFLCIVNSRKDAARLYTALQAQEKASEGLIHLSRRMCSAHIQERIEEIRRRLKAGEPVRVVSTQLVEAGVDLDFPVVYRAMAGLDSVMQAAGRCNREGRMAEPGEVYIFRLDETVSLGEMSWAQGALEDLLDRLAEQGAPQREEIERYYKAFYNDVDCFDNRITRREDKRISPLLWDVDDDRCEELRFDYETASENFKYIEDQSTAIVVPYDKAGKAIIKKLQSNLPLTRQEYRQMNRLTISLYEKDCLTLGSSISVSESGIVYLADDKLYSTETGIQIIDQTLIFMGV

SEQ ID NO: 12455 - protein, 596 aa, Listeria marthii FSL S4-120
NFSYEKLQDNAEYKETISLDYFYPGSRIFEGNSAADAETFKKYVLLKGLLNRIDFAASGGIDVELENDFLMDSMEVQLANFKAENPEADWNSLQKYMMQHQNDNIVVIAETGMGKTEAGLLWLGNNKGFFTLPLRTAINAIYERITKNIVTTNQAERVGLLHSETYSQYLLHEGNAEMDIDEYYTRTRQMSLPVTICTLDQLFDFVFRYAGFEHKLATLSYSKVIIDEIQMYSSDLLAYLILGLSYIDKFGGKFCIMTATLPGIVTDLLLENGVNFVQPKEKFVSSRVRHSMEMVHTEIESEFIKPFFNNNRILVICNTINKAKKIYLELKEHFQGEEIHLIHSQFIKKDRSAKEDAIFKDGQKDSTKKCIWVATQVVEASLDIDFDLLFTELSDVNGLFQRMGRCYRNRALDVDTNVYVFDGGAKVCSGVGTFIDKLIFGNSKTILNEHTGVLTEEKKMELVERVYSTEALRGSEFYNDLIETINYVKAFDSYELDKADVRRRFRNINSVSVIPEEVWQDNAEEINSCFVALRKTSKEISTKEKMIARTNLAEFMVSVPDYLYKKGKSVVREINRYENVVEFKCGYSDDIGIFMQ

SEQ ID NO: 12456 - protein, 726 aa, Listeria seeligeri FSL N1-067
MQKYLAKSNPPETIQEHTDNLLKNYQTLKKLYPEINIDWYLLELVCLLHDLGKMNRLFQKKVGNGSGVGKEIPHGYLSVAFVPYSKLEDLGYSEDEIQVVYQAIARHHERKKDFTEQEWETEIEKLSEQWETFFYERLADNADYSSKIDEIYFYPEARIFEGENTVEIETFKNYVQLKGLLNRIDFAASAGIDVELENDFLQESMEHQLANFQEKNAAADWNLLQKYMLQHQNENVVVIAETGMGKTEAGLLWLGNHKGFFTLPLRTAINTIYTRVTREIVTDKQAQRVGLLHSETYSQYLLHEENTEMEIDEYYTRTRQMSLPVTICTLDQLFDFVFRYAGFEHKLATLSYSKVIIDEIQMYSPDLLAYLILGLSYIDKFGGKFCVMTATLPGIVLDLLHDNEVDFIQPEEKFVSERVRHSVEVVHTEIDSVFIKPFFHDNRILVICNTISKAKKIYSELKAMFPNKKVRLIHSQFIKKDRSKKEEEIFEDGQKDNPESCIWVATQVVEASLDIDFDLLFTELSDINGLFQRMGRCYRNRALDVDTNVYVFDGGEKVCSGVGQFIDKTIFMNSKKALEKCNGALTEMKKMEIVEQIYSTEALKKSEFYDELTQALNYVKSFDSYELDKKEVRSKFRNINSITAIPATVWQENKEEITSYMEILARSSKEVSKKEKMIARTNLAEFMLNIPDYLYKKSEGEVHRINRYETVIEFKCDYSEDIGIIM

SEQ ID NO: 12457 - protein, 801 aa, Fusobacterium gonidiaformans 3-1-5R
MIDVKKIKNEFLAKSNPLETIMEHTEILLQEYDRISTIYPNFIEKIPKVWKVLYLVCVYHDWGKINFPFQNRILTGKKQWNELPHAILSIACLNAEELSKEFPREEIQLLYSAILFHHNREDLLSYEIDQIRSQLQEMSEDVKQMWEIICMNPQQYPLLNQKKIYFDSNLYFEDSFYQEFPVDILNPKECEKAVFYILLKGLLNRIDYAASAHIPVEHKNDFLEKGLETFMQDLNVERTSRGMEKSDWNNLQEYMKSHQEDNVIVVAQTGLGKTEAGLWWIGDHKGFFILPLRTAIDAIYDRIKNKIIKNDRVEERLALLHGESLESYLQLWEKEKELQEGSGFEWENYYIKTRQLSLPLTICTLDQLFPFVFRYRGYEAKLATMAYSKVVIDEVQMYGPDLVGFLIVGLTMIQKMGGKFAILTATFPGFIKDLMREQGLEFKMSTPYVKEESRHSVQWIQKEINADFILEKYKNNRVLVICNTVKRCQEIYHDLYEKMEISQEKLLSHDIMDRELNLFHAKFIKKDRAIREKAILEFGSLLKQDNTPNDRQGIWISSSAVEASLDIDFDILITELSDMNSLFQRMGRCFRGRILETGDFNCYVFDGGDKKCSGIGYSIQEEIYEISKNDLRQHFSTNGNILTEKEKMDLVEQTYSKEKLEPTKYYKEVKDFIKNPSLYLPNEMSAKEGQFRFRNILSERIIPLPVYQQNIEEIRKIEEKLKLPLNSQMSENMEEKSISKEERILCREKLMQYTLSVESYLLKGANIEKKITINSYQEIKVVSCEYDSLIGLGKIIKEKKG

SEQ ID NO: 12458 - protein, 735 aa, Fusobacterium gonidiaformans 3-1-5R
MNMEYYAKPNKTIAQHNFDLQQARECLVRFGYLYSEEENRILREAIEYHDLGKMNEFFQKRVLSQRKIKFNTELEVEHNILSIYMIDPKKYPKEKYYSILYAVLFHHRYSDVVQTMVERKKDIERLLQNFTSYRLPMGLKISSLHTLTNQKTLGLLMKCDYAASGNYQIEYPNDFLEEKLELWSSKLGILWNDLQEFCYSHKNESIIAIADTGMGKTEAALRWIGNSKAFFTLPIRTAINAIYDRVSRDILERENLEERLSLLHSTSLEYYAKNIAEEELDIFEYHQRGKHLSLPLTICTADQIFNFILKYKGYEMKLATLSYSKVVLDEIQMYDPSLLAAIILGIKTILELGGKIGIVTATFPPIVEALMKKEIPDFSFQKQIFHSKNNVIRHNLISYDKRMGTEEMIDLFLRNKKIGKSNKILVVCNTIKDAQAMYDTLLEQEELSPYLHLLHSRFIKEDRARKEKEILAFGKTEIKENGIWISTQLVEASLDIDFDYLFTELQDLSSLFQRFGRCNRKGKKSTKEANCYVYLKTEEGYLKEAGSSYGFIDKVIYHLSREALLGHTGEISEELKTKWIEEFLSYEKLEQSSFLSEFRDAIEEYKNILNSNENTSEELTRLRDIQNVTVIPLPVYQKHEEEIRDLEENLKNPEMTKEEKLRFKEEIMKHTVTVPKYMLENYKKALQDGNVESMPIPPVKMSNYEKVIILECLYDSQRGFQAKKFVEKNINFTFL

SEQ ID NO: 12459 - protein, 861 aa, Fusobacterium ulcerans ATCC 49185
MFEEELFSIEKYVKDEDKILAHISDRKNSETLLEHSDLVVKYNKKIYEDKNLKIVFDKLAEKFFGQNETVKKFWNEMIINASCMHDIGKLNINFQIDKMRNDIFERVLLCQSKRHSNLSARIYIDYFANKLIKLCSENKLNNDDIFKCFVFIVLNSYVISRHHSSTKNLNEDFFCEITTNYERYKELFDEVNNYCPNLKLSIKASRKFFKIFEKLKINGEKWNKYVENKDWNSIDYYIYTKLLYSLLVSSDFYATSEYSSGKPIDNLNLLTNIDEYRSVFNSTEIYKGIKLHQETGKYFKKDNINCYRSEMFIEAEKNLEMVNKENIVFLEAPTGSGKTVTSVNLALRLLEKNRELNKIFYIFPFNTLVEQTNSSLREIFQNSPLEESISVINSITPIKEVESEEEYKKDNIDYERSLLNRQFIHSPIVLTTHVHFFETLFGIDRESSFALPHLANSVVIMDEIQSYKNKIWKEIIIFLKKYADILNIKIIIMSATLPNLSFLLDQEAKIPSLITNREKYYSNSIFRERVSLDFCLLEKEYGREELLKKIEKIIFEKHKNQKVVVEFIKKASAFEFYKKLLESNEVCKEDIFLITGDDNKAERKRIIKEAKNKERKSMILVATQVIEAGVDIDMDIGFKNISILDADEQFLGRINRSCKKKNCKAYFFKLDDGGDIYKGDVRIQDRFTLMNEEMREILKNKNFNEYYTIILEALEKFSKDENKEENIDDFRKDKVVQLNFEEIYKRLKLIADDRRTKMIFLSRNINIEGEEILGNKVWNDFKEILLNNEMGYAERRVKLSKVMEKVDLFSYNIPVEMTRKLSYQESIGDNIRYIGDGEKYFVNGKFDRKKLQSDEDTEMIL

SEQ ID NO: 12460 - protein, 735 aa, Fusobacterium gonidiaformans ATCC 25563
MNMEYYAKPNKTIAQHNFDLQQARECLVRFGYLYSEEENRILREAIEYHDLGKMNEFFQKRVLSQRKIKFNPELEVEHNILSIYMIDPKKYLKDEYHSILYAVLFHHRYSDVVQTMVERKKDIERLLQNFTSYRLPMGLKISSLHTLTNQKTLGLLMKCDYAASGNYQIEYPNDFLEEKLELWSSKLGILWNDLQEFCYSHKNESIIAIADTGMGKTEAALRWIGNSKAFFTLPIRTAINAIYDRVSRDILERENLEERLSLLHSTSLEYYAKNIAEEELDIFEYHQRGKHLSLPLTICTADQIFNFILKYKGYEMKLATLSYSKVVLDEIQMYDPSLLAAIILGIKTILELGGKIGIVTATFPPIVEALMKKEIPDFSFQKQIFHSKNNVIRHNLISYDKRMGTEEMIDLFLRNKKIGKSNKILVVCNTIKDAQAMYDTLLEQEELSPYLHLLHSRFIKEDRARKEKEILAFGKTEIKENGIWISTQLVEASLDIDFDYLFTELQDLSSLFQRFGRCNRKGKKSTKEANCYVYLKTEEGYLKEAGSSYGFIDKVIYHLSREALLGHTGEISEELKTKWIEEFLSYEKLEQSSFLSEFRDAIEEYKNILNSSENTSEELTRLRDIQNVTVIPLPVYQKHEEEIRDLEENLKNSEMTKEEKLRFKEEIMKHTVTVPKYMLENYKKALQDGNVDCMPVSSVKISNYEKVIILECLYDSQRGFQAKKFVEKNINFAFL

SEQ ID NO: 12461 - protein, 814 aa, Parascardovia denticolens DSM 10105 = JCM 12538; identical to SEQ ID NO: 12428

SEQ ID NO: 12462 - protein, 926 aa, Streptococcus oralis ATCC 49296
MSKKKSDTLWAKKKEENGRFFWLPLSQHLEDTKNIIGLLWEHWLSEGQKKLIEDSLDSVTHDGGLGKRLAQFLAAVHDIGKATPAFQTQRGFANSDDLDIQLLEKLEQSGFTKISSLQLSSPKKSHHSLAGQYLLSSYGVQEDISTIIGGHHGRPIDTIEDVKNQGSYLSNYFQNESKESAIHKNWDLVQKEIFNCALDELGFDSVRELPKIKQPAQVILSGLLIMADWIASNEHYFPLLSVNEKEEVDKLRRLQDGFERWKKTSLWQPKYISKPDSLYKERFGFEPNNVQSTLSHVITQISKPGIVVLEAPMGLGKTEASLITAEQLATKTGRSGLFFGLPTQATSNGIFNRIEKWVESLKDDSEDILSIQLVHGKAALNEDFLKLKANTFNFDDVENGSVIINGWFSGRKTSALDDFVVGTVDQFLMLALKQKHLALRHLGFSKKVVIIDEVHAYDAYMSQYLMEAIKWMGAYGVPVVILSATLPSQQRENILKSYMSGMGIKWRDIENTDQLKTDVYPLITYNDGSEIYQVTTFNKQNIKDIHIIRLQEEQLLGTVKDALEGGGVVGIIVNTVRRSQELARNFSEIFGDDMVELLHSSFIATERIQKEKELLQQIGKNVDRPHKKVIIGTQVIEQSLDIDFDVMISDLAPMDLLIQRIGRLHRHQIDRPQKHKIARFYVLGTSQELDFEEGSSFVYGDYLLARTQHFLPDIMRLPDDISPLVQKVYSPDFTIEFSSQEFQQKYLDAKTEHDVTIKNKETKARTYRINDPVLKISRHRNNSLIGWLKNLHPNDSEEKSNAQVRDVEDTIEVIALKKMSDGYSLFIENQDISQNIDNPLVAKKVAQNTLRLPMSLSKGYNIDQTIEELERYNNSYLSQWRNSSWLKGALGIIFDENNEFILNGFKLLYDKKYGITTERLNKNESI

SEQ ID NO: 12463 - protein, 724 aa, Pseudoramibacter alactolyticus ATCC 23263
MAMSSYLAHLDGKREQSILEHSQNTAALSADFAISALKPLAYILGMLHDIGKYQNSFQKRIRGKNIRVDHSTCGAIEAMTHYQTPVTRLMLALCIAGHHSGLPDTGSKQDDGSTLYGRINRQDQFEDYSVFRREMPELCLDENALAQFIADDCQKDMKCLTDKLAFLTRFCFSCLTDADYLDTEAFYTGTSRRTVRSDFRACLERIDRQLDGFVCKTALQKTRRSLQEQAFSKADRDAEIYLMNMPTGSGKTLCSMKFALMRAIRKGYRHIIYVIPYNSIIDQTVSTFETIFGEDARILRHQSTFSYDDIDAREEVRIELKHAVENWDASIIVTTAVQFFESMNGSKKRQLRKMHNVADSIVIFDEAHLMPTNFLQPCLQAVAFTVRYLNSEALFLTATMPDFKALLTRYTLPDMQILDLIDDRRNFVIFQKCRYHDVGLMSKEVLVAGASTASAVLIVVNKRRTAREIYAMLPEDCHKYHLSTYMIAADRLQTIREIKERLAHRDGKPILVVATSLIEAGVDLDFDTVYRELSGLDSILQAGGRCNREGKQATANVYVFELDEAEKSPDKDARSSLAKGIFNRFEQIDTPEAIEAYYQNWYTVNREDLTRHAMHQFSPDFSVLQFKSYGEQFQLIDSKTVSIVVPTDEVSRSWVSQLSFAKSSLGIARRLQPYALSVYSYEFNVLREQGVLDDYGTGIWCLTNLDYYDAETGIQFEGKDYFIV

SEQ ID NO: 12464 - protein, 752 aa, Lachnospiraceae bacterium 5_1_63FAA
MIKDLYDYLAKPDKTIGEHVEDLIFRANILRKLGYIKDIHIYNLLIQACKGHDLGKANKEFLKRILNPKLHFDETKEISHNILSVYYLDKNEFDENTDDYLIVACCILFHHDYCNEPLVIKTRTSQINSLLIPEYNQKPSRRMLKNICNNYLKKQETIIVKGLLHRCDYSASGNYEIEYPNDFLEAGLAQMMNEWQKKKKDSCWNELQEFCIENREENIIALAPTGMGKTEAGLLWIGNHKGFFILPIRTAINAIYDRIKNQILKDEKLEERLGLLHSESLSYYGSHVGQEMDILDYRNKGQALSLPLNISTLDQLFDFVFKYKGYELKLATLAYSKIVIDEIQMYDAEMLAYLIYGLRRIHELGGKIAIVTATLPPFIKKLLRDKNIGNIEFKERDFTNDLKRHSVKVIDESICEDDIIQCYNQNIKEGKGNKILVVCNTIKKAQKMYDQIKEKNETLNSHVLHSRFDREDRKNLENEIKEFGKTYNERNEIDIQNGIWIATSIVEVSLDIDFDYLFTELTDLNGLFQRMGRCNRKGVKQLDGYNCFVYCDGSDIKQGQKGFLDSVFYEQSKKALKTVDGILEESQKTKLINDYFTYDDIRSSDYMRQFKDTFDWISELDIGDFEKDEIKMRNIFTKSIVPKIVYDQNKDEIVLLEERQTLISKKLKDSNIEQKERENLFRERIEIQERLRDFIVQIPYYEYHKYYKKVYQTYGTVNISKYEHIDIMNCQYDIKGFYPLNYENIGEDAMMF

SEQ ID NO: 12465 - protein, 855 aa, Anaerostipes caccae; identical to SEQ ID NO: 12264

SEQ ID NO: 12466 - protein, 743 aa, Eggerthella sp. 1_3_56FAA
MYVSHVAEDGRIEEVADHLREVAEMAAEFARPFGAESWAYAAGMAHDIGKYSAEFQNRILRDGRKVDHSTAGAYELYERAGLPLLGFCIAGHHGGLPDSGSLAEPDGPSLIGRFRKAEHRQLPDYRAYAREVELPETESVTFDNMAHFDPFSIAFLTRMVFSCLVDADFLCTERFMKGSAREHLNADSLETLNERLECVIQSFYPPRTELSKTRCSILDACAESASDAPGVFSLTVPTGGGKTYASLRFALRHALSDGHNMRRVIYAVPYTSIIEQNAEVFRKVVGANNVLEHHGNFDFDNAGEDGGLLRLATENWDAPVVVTTNVQLFESLYASKTSRCRKLHNITNSVIVLDEAQMLPAKQLLPCVRALAELVHRYGCTVVLCTATQPSLDKMFGLYGCPVREIAPEPQALYERLRRTEYRFIGKIEDAVLADRLSSREQVLCVVNSRSQAKSLYDLVQASSDDGDGVFHLSTLMHSVHREKALAEIRLRLVRGETCRVIATSLIEAGVDVDFPIVYRALAGVDSMVQCAGRCNREGRHPVYESVVYLFEPGTGYGVPNDISQKCAIARSVMLEMGVDIRAAEAVEEGVACDIGSLGAIASYFEQLHDIRRDRLDAEGVLEDLTEIGRAEFHEGKSVPLIPFKHAADRFRMIEDGSCSIIVPDPAIAQQLHELRVGVASRGSMRRVARYSVSLYDNDVKALQSTGAIRLLDGDTYELVDTGLYSEETGLDASQAGGKGLFL

SEQ ID NO: 12467 - protein, 762 aa, Neisseria mucosa C102
MSPLIYYAHSAQDKLGNLLPYKHWQTLQSHLVNVGEIAAEFARVFGAQEIAYQTGQLHDLGKYSEAFDRRLHGGSSVDHATAGAKIAVERWGNVIGKLMAFCIAGHHAGLANGCGEGDNRSTLKQRLALQFDEDIPALDNLWQQEIKLPQNLSAPPLKADAHHPFFSYAFFTRMLYSCLVDADYLDTEAFYSNLENKIAERGGSPDLNALQRNFNQFINDFRRRIAQASEQTEAEKRNAALNRLRSEILDHAVEQAAQPQGLFTLTVPTGGGKTFTSMAFALEHAKRHGMRRVIYVIPFTSIIEQNAAEFRKAFGELGEQAVLEHHSTFDDGKLQNEATKDKLRLASENWDAPIVVTTAVQFFESLFADRSSRCRKLHNIAGSVIILDEAQMLPLNLLLPIMQAIKELAQNYHCSVVMCTATQPAVQAENGFYRGFENVREIAPKPTALFEKLRRTTVQHIGTQTDADLLAKLAEHPQMLVIVNNRRHARSLYDQAKHLDGTFHLTTLMCAKHRSQKLDEIRGRLKNGEPCRVIATSLIEAGVDVDFPLVMRAEAGLDSVAQAAGRCNREGKRPSESSFVWIFAPEEQWKAPPELATQAAVMRLTADSFSDDLLSTQAVAAYFAELYQLKGSELDNKKILKMHNDTGQSLDFPFQTVADKFRMIESHMQPLIIPFDGEAENLISSLHHADHIGGLLRKLQPYTVQIPEKALAALYKAGRIEPINEKNFGKQFYKLIGLDLYDEVAGLSWEDTEFLKGESLVF

SEQ ID NO: 12468 - protein, 911 aa, Lautropia mirabilis ATCC 51599
MAESYFFYWGKASSQDKGEDAYHLLPFHALDVAACARKLLDLPHFSLRLLAEELGWPQRQVEALFVFFMALHDQGKFARAFQGVLPEPIPGLVPPNSAKSYEPCHDTLGWWLWMELVDTEAVPEGIPSPDHGFWEIWMRATAGHHGRPPLDSEGGGIVGANVEKAFMAEDLEAARRFMSDVKDLILQDVLPLPKPGSSHTKILKKHSWRLAGLGVLADWLGSNQSFFPYRSQPLVLSEYWPKALEFADKAVASTGLAWSPVKNWDDPTKLFDYLKSPTPLQNYAATVELEDGPQLFLLEDVTGAGKTEAALILTQRLMQAGLAQGLYFALPSMATSNQMYRRVGEVYRRLYREGSNPSLVLSHGARQLVKEFKESVLQSEDQPGDRSYQPDESSASAQCNAWLADNRKKALLAEVGVGTLDQALLAVLPARHQSLRLIGLSGKVLLVDEVHAYDDYMMSLLRKLLMAHASQGGSVILLSATLPLETRERLIDAYRRGLGIDEDCELDDNRYPLATQIGKEIRVHACETRPQLKRRVQVSMVHDENAVLARISEVTQKGGCVAWIRNTVADARKAYSLLQDASPDQKLMLFHSRYAMGDRLEIEERVLDRFGKRSGSQDRAGWVLVGTQVLEQSLDFDVDLMISDLAPIDLIIQRAGRLHRHLRQANGDLSLDGREGRSEPELIILSPSLEGSPDASWYKTLFPTAAYVYPDAGKLWLGANALKEAGSITTPGEQGEPGAVRHLVEAVYGADLDRIPDELRALSLKQIGQYMAMQSQANFNALEIGKGYCMGSSARWYEDDQVPTRFGDETLNIYLAVWQDGVLRPLRAEDDNPWEQSAVRVRASVAQRLADSWQTRFASAIETLREKTSLLRDHSFILPLVSEREELVGRVVDERGKELIMKYSAESGMAW

SEQ ID NO: 12469 - protein, 1005 aa, Actinomyces sp. oral taxon 178 str. F0338
MARKVDGKVVEAPVVAAAPPPPEFPRAEPGLTAEGLSGLTRSFWAKSGKRNPADWLSVPQHLMDAADVAGRLFDSYLSEHHRALLASVWGADQAKARASLVFLAGVHDVGKASLPFCCQHGPLADFVRAHGVRVPQRRDVPDRADLPHGLASRFAFVNAIAEGGGDRRRASKWATIIGVHHGRYPDGAQIKAARDAYNGELGRPQKEPRWEQSRQELIEWMARRSGFPLRPQIPSALPRLPIAVASAYASVVVIADWIASNEDYFPLRPQAGRERELIADEQWERVERGWGLADMPRPMTVPPTAGGSPESYYRHRFGWGPAITPTDAQIAAVRLAEEADPDLMIVEAPPGSGKTELAFAVAERMVRSRGLQGVFIGLPTQATTNAMYERATKWLTNLLGDSPQRLGIHLAHGKNDLNDAFVELLDRDRGYPVQVHDEEEERSGEDHSSLRASAWMAGRWRATLSPVVIGTIDQVLLTALKSRHVLVRHLGLMGKAVILDEVHAADTYMGTYLKAALTWLGMYGIPVVLLSATLPAERRIELAEAYRRGRCRREVDDSARLDGNIGYPVLTTVPRGGQEVDVHVVGGGGPEARRTILPLVAQSPQDLVPALDEALAEGGCAVVIRNTVKDAQATYDALAPHFGADGVTLLHSRFIASDRAARDERMLRLFGKDSAARPRKHVVVATQVIEQSLDVDFDVMITDPAPMDLVLQRIGRLHRHPGRERPSGLREARCHVMVADTGSAPWAYSGGTDVVYERSHVLRALGILADRGRIGVERPGDYAELTQLAYSDEAVGPATWAGALQEAERKARNNANTAVDRARTWCLTGPRLPQWNADRLEESFVGNASTGDGAPKGRQAAAQAAVRDSEDQIPVLLVAVDPGMGCVPIKPPWQLDADGETIPIDVSTWPSSGLVREMRTWSLSLPPWPFRENGKAIDEVVDAVACAIWDDEATRDWECLEHPLLRGELVLAMHKTDEGSTRLERDLLGCHLVYTQERGLEVRGR

SEQ ID NO: 12470 - protein, 844 aa, Treponema phagedenis F0421
MIQFRQLPVYEQKDRILSALEVNQVIVVESPTGSGKTTQLPIILHEAGYTQGGIVGVTQPRRIAAVSVSEFIAKQFGCAVSELVGYKMRFEDKTSPETQIKIMTDGILLQEMKLDPWLSKYSVIMVDEAHERSLNIDFILGLLKRILQERKDFKVIISSATINTDMFSLYFDSCPVIKIDAITYPVTTIFDPPAIPASTETQNAEAAMLDKIASIVERILDDGRSGAILVFLPGERAIKNCIDRLTRESKFRKLYPLPLYGRLSKEEQESVFDPPPFGKKKIVVATNIAETSITINDITTVIDSGLAKLNFYNPLSYTSSLDETQVSKSSCNQRRGRAGRTQKGTCYRLYSRKDFENRQLYTLEEIYRTDLSEVVMRMAELGIFDFENFDFISPPGKRGIIGAVETLNMLGALEKDRSLSSIGEMMCKFPLAPRQSRMIVEAIIHYPESVDDVIVATAFLSARSPFIFPDGKELHARRAHASFDEPMGDFASFLKIYRLYVQAKDKKRFCEISYLDDRVMAEIANIKEQLELIVSDMGVPILSGGKIEDYLASIAQGMIQFVCVQHGKDSYRSLTAEKISIHPGSCMYKNRPRFIVAGEIVRTSRMYAMSVSPLSKKLVAQVAPALLEKRATKETRGTQKSAKDAKNKEEFAKRDDEERAVIAGSSYAIKKIKGKKHLVLPWELFSETVKKLNADVDSVDDGSLQQLKGLRCIIEMNNYQLFTGEKLELVLKAVSLFDIRQTDDSRVRNKNFTLPEDLPEIISALDLLFKTTVAKQKSKQLGFITLFSDGKGIFWLKTSRGFHTSLHENLVSVQNLIDLAGEAMNEQQQAVTQRLYKAMKSFFA

SEQ ID NO: 12471 - protein, 876 aa, Haladaptatus paucihalophilus DX253
MAPDVEVRNSHPAGDGHSAVHLLHHLHDVRDRVEWIVPEEAATPSGESLVDVVKKLALVHDFGKATTWFQQYIDDSQRNPPPQNRYHSPLGAFAAYFVLRESGYSTQTCLAGFVAVAKHHGRLPQIATFVHNKSNQFDGTNRLDSIAEKVDDIDRNAPKLARRVFEEATETDDSWGTFVQSCTGARTGKQLFQEVANHVTDALGGTRINPEFVTPDFYGLVLECWGSLVLADKTSAAGAPERESVYEPTAPELETLDTYIGDIESDANADRKGSRSERLDYYRSKARTDILESVPEFVESKTNVATITLPTGMGKTLSGLSAALAIRDETDSDRVVYALPFTSIIDQVAEETRNVFGTDGTDGLLAVHHHLAETQFNPKDDADEDGGYDAADLNDDVAGMLGESWRSGLTVTTFVQLFESLAGPRNTQSMKLPALRDSVIVLDEPQSLPLDWWKLVPRLVNVLTDQYDATVIAMTATQPKLFEESGNAMSLVSNMDEYFSVAERVRYRLHDSVEGFLAGDETPLDYEPAARELAVEIQEGTATLAICNTIDSARKLTEEVTERVETTDIAKQYFDVLQEGASNPLARTIAKICGSDKRPFVHLSTRLRPTDRLALVRIIKMLREEGVQVVAVTTQLVEAGVDFSFEAVYRDIAPIDSIVQAAGRCNRSFEQEYGDVTVWWLAEPDEQDCTPAVAVYDKGGETLLPVTAAALDEVRNDDGQLAEQDVSRQAVESYYERLHEDKDVGKAEYVEYVDTADAESLGRLSLIDSTRCIDVIICLTSDDVELVNDLEEAYDDYDYDAVKRLVDETKPLRVSIPIYDEDSEEFRQVTNLPPLGGQEEENDVRVLRPDSYEFEEYFDATTGFVVPDASVEDRFL

SEQ ID NO: 12472 - protein, 926 aa, Streptococcus sp. C150
MKQIHDNFWAKKTEENGRLLWLPLTQHLEDTKNIAGLLWEHWLSEGQKVLIENSINAKANIENQGKRLSQFLGAVHDIGKATPAFQTQKGYANSVDLDIQLLEKLERAGFSGISSLQLASPKKSHHSIAGQYLLSHYGVEEDIATIIGGHHGRPVDDLDGLNSQKSYPSNYYQDEKKDSLVYQKWKSTQEAFLNWALTETGFNSVSQLPKIKQPAQVILSGLLIMSDWIASNEHFFPLLSLDETDVKSKSQRIETGFKKWKKSNLWQPETFVDLVTLYQERFGFSPRNFQLILSQTIEKTTNPGIVILEAPMGLGKTEAALAVSEQLSSKKGCSGLFFGLPTQATSNGIFKRIEQWTENIKGNNSDHFSIQLVHGKAALNTDFIELPKGNTINMDDSENGSIFVNEWFSGRKTSALDDFVVGTVDQFLMVALKQKHLALRHLGFSKKVVVIDEVHAYDAYMSQYLLEAIRWMGAYGVPVVILSATLPAQQREKLIRSYMAGMGVKWRDIENTDQIKIDAYPLITYNDGPNIHQVKTFEKQEQKNIYIHRLPEERLFDIVKEAIDNGGVVGIIVNTVRKSQELARNFSDIFGDDMVNLLHSNFIATERIRKEKDLLQEIGKKAMRPPKKIIIGTQVIEQSLDIDFDVLISDFAPMDLLIQRIGRLHRHKIKRPQKHEVARFYVLGTFEEFDFDEGTRLVYGNYLLARTQYFLPDEIRLPDDISPLVQKVYNSDLTITFPKPELHQKYLDAKMEHDDKIKNKETKAKSYRIANPVLKKSRVRTNSLIGWLKNLHPNDSEEKAYAQVRDIEDTVEVIALKKISDGYGLFIENKDISQNITDPIIAKKVAQNTLRLPMSLSKAYNIDQTINELERYNNSHLSQWRNSSWLKGSLGIIFDKNNEFILNGFKLLYDEKYGVTIERLDKNESV

SEQ ID NO: 12473 - protein, 727 aa, Actinobacillus ureae ATCC 25976
MLPKLAKELPHIQQHRPFTKRTNLDRFKWQNCAFELARSVQSESEQAGFFGVNMASTGCGKTLANAKIMYGLSNQDGARFTIALGLRVLTLQTGLALRQKLMLSSEQLAVLVGGSATKQLFELQNESVQSGSESVQEWFEGNEFYGMNFLESGIADEEFSTLLADNKAKKLLYAPIVSCTLDHMIQATETIRGGKHIVPLLRLLTSVLVLDEPDDFSQSDLPALSRLVHLAGMFGSKVLLSSATLTPDLISGLFNAYQAGRKIYNRHQGINPDLPICCAWIDEYKQQQQKCPTVKEFEQYQAQFTSSRAEKLMQSPIRYKAEIIQLPPFSSVENQDINYTMLADSLIEQAITLHQKYAQQDPISKKYVSVGLIRFANIKPMIPLVETLFKTPLNTQFSDYKIHLCCYHSQQLLLLLRSKLEEKLDRILKRSEPEALFSQPEIISALTQDKAVHHIFIVLGSPVTEVGRDHDYDWAIVDPSSMRSIIQLAGRVWRHRPEKIATQANILLLPTNWRGLQTKDHGSEPIFCHPGSEDKLNKLASHKTVDLIKQEHLESITAIPRIIKPSVLQAETNLADLEHKVIGDLLNNKGINRVNAYWQDNLTNRLNANLPLITPFRKNEGKWQTEIVCLPSEESHWEFMFKSSEKAWENPYFENDYLAEISYQKLNCESPWIKPWLTIPLNQALSELCEQLDETDQTQVALCFATVSLQHYEKTLPIWKFNETLGF

SEQ ID NO: 12474 - protein, 741 aa, Succinatimonas hippei YIT 12066
MTENPIDLLDPRLLKWIRQRGWQDLHPVQKNAIIPILNSSDDIIISASTASGKTEAAFLPALTYIAKENKPGIRILCISPLKALINDQTRRLKDLTESLKITVTPWHGDSAANNKKKLFDNPQGILLITPESLESLLMNHNAFVKEAFKNTDFVIIDEFHAFMGTQRGYQLQSQLHRIENSVARVIRRIAISATFSNLSSVTEYLRPNNHTIKCDLIKDDSVGKSRLAVQVRGYIIDNDDVEKGINEVKRLTKDEEIIKTSDTRYREIAGDIFRLLRGTTNLVFTNSRAATEVIANDLHELCDKNHVPQEFFPHHGSLSKDMRESLEARLQEGRLPTTAICTATLELGIDISNVASIGQISPPLSVASLRQRLGRSGRRDGLAVLRLFIPEYYSSKHYLTEQLSEDTVLSAAMIKLLLNRWYEPPLEKEYSFSTLVQQTLSVIAANGSVSAKNLWELLCKTGPFNLCTAPLYANFLRSLAEHDLIVQLRDGTLTLGLEGERLCSQWKFYASFETLPDYIIEYNGKHIGTIPLCQPIAVQDTFLFAGNGWIVSDVNPQKRIISVKPYKFHASPLSVSGNTGFIHDEIRMTMFDIYMKGNYPPCLNSQAKENLAAGRDTFFNLGLDKKCMISGPQGLALFPWKGDRIMRTVSLMLAKEQIKNVQYNSHIELEYCSIDSLKVAVANILRQNDIKLNDLVMKVKNLETDKFDYCLSDELKRLNYAHRSLDLDGALTFFKRLAKEL

SEQ ID NO: 12475 - protein, 774 aa, Clostridium  symbiosum WAL-14163
MAILCFLTAEKLGLGKLAKLMGLLHDFGKGTADFQNYLRGAGSRHHNHAGLGALYVHRHWWQREAAKERRQTAQLISLCIYGHHAGLPDCLTASGRSPYLDGLREQPENYYIEAMENFYTEVASAEKLDKLFDDACKELKEFGLDSHSFNWGMLARLLLSILVDADRWDSVCFEYDEDPFEMALEAQPDWEKLLIKLEAYVEKFPREGELATIRRNISAWCRAAGEYGPGIYTLSVPTGGGKTFSSLRFALSQAEKYRQRRIFYLIPMNTILDQNSRDIRDALSDYPSILEFHSNVIPENEAEEENYRRLTERFDSDIILTSLVQFLDTFFQKGNGKARRMYRFANSVLIFDEVQALPKKCRELFKLALQFLVRFCNCTVLLCTATQPNLGLEAKELVPDVYALYQKLKRVTYISEMGPRKYQEAADDIAGFIGKKTSVLMIVNTKDAAWNIFQGISEQLETLNYRQVQIRQDLTDEELEKCAGGCAEDEILCVHLSTLMCPMHRKEILRWIKVWLSKKKLVCCVSTALIEAGINVSFPTVIRSLAGIPSLIQAAGRCNRNCEADMGNVYLWNLAEERLSRLPDIQKGKEISMSLLSNVENPDELGNPEMIKRYFAKEEIYTQEVEKYQYKEWNSDLVTMLSTNRECRCTAGNLRDENNPLPDLSKRFYQSFRTAGTVFQVIDQKTKSVIVPYGKGKELIERLGDRHTLSEEIRLLKEAQQYSVNLFEHIFNRLAGEDALVSLGETGAVILKDEYYDPWAGVTITPQEMKELII

SEQ ID NO: 12476 - protein, 721 aa, Desulfovibrio desulfuricans ND132
MAIYAHSRENSDPEEWQLLEEHLRNVADRGADFAAAFGAADWARVLGAFHDIGKRNPRFQQRLTGENTGHADHKGAGARLFENLGTGFGRMAAYCIAGHHGGLPDFHDSGHGTSLGRILERAFVLPGRDVPDGIRPPDWPFTPESGFQCSFFTRMLFSSLVDADFLDTEAFMDAAESGRREPGPALGELRELLDRHLAAFAGEGRINSLRAEILSHCREKAALDPGLFTLTVPTGGGKTLTSMAFALDHALRHGLRRVVYVIPYTSIIEQNARVFRDIFPAGAVIEHHSNFDPRNAFGDEDNARESAGARRHRLACENWDAPVVVTTNVQFFESLFAAKTSRCRKLHNLAGSVIVLDEAQMLPVDFLAPCLRALEELAAHYGCSVVLCTATQPALRREDFAPGLAGLDGRELAPDPARLHEAFRRTELRDLGELELSEVADMVREREQVLCIVNTRARASELFKLVRDEPGARHLSALMCPAHRSERLAEIRGMLRAGEPCRVVSTQLVEAGVDVSFPEVVREMAGLDSITQAAGRCNREGERDEAAPVSVFYPAEGLPRAFSAQAEHAAAVLRGPHGGDPFSPEAIRQYFGLHYWLKRERLDRKRILDALSNERGEWYFRRAADEFRLIDNPMVPLVVPWDGRARELVEALRYAEHPGGILRKLQQYTVQVYERQFRALDEAGAVETVADGCEALCRMEFYDDLFGLRVPGPTDPEYFLA

SEQ ID NO: 12477 - protein, 774 aa, Clostridium  symbiosum WAL-14673
MAILCFLTAEKLGLGKLAKLMGLLHDFGKGTADFQNYLRGAGSRHHNHAGLGALYVHRHWWQREAAKERRQTAQLISLCIYGHHAGLPDCLTASGRSPYLDGLREQPENYYIEAMENFYTEVASAEKLDKLFDDACKELKEFGLDSHSFNWGMLARLLLSILVDADRWDSACFEYDEDPFEMAQEAQPDWEKLLIKLEAYVEKFPREGELATIRRNISAWCRAAGEYGPGIYTLSVPTGGGKTFSSLRFALSQAEKYRQRRIFYLIPMNTILDQNSRDIRDALSDYPSILEFHSNVIPENEAEEENYRRLTERFDSDIILTSLVQFLDTFFQKGNGKARRMYRFANSVLIFDEVQALPKKCRELFKLALQFLVRFCNCTVLLCTATQPNLGLEAKELVPDVYALYQKLKRVTYISEMGPRKYQEAADDIAGFIGKKTSVLMIVNTKDAAWNIFQGISEQLETLNYRQVQIRQDLTDEELEKCAGGCAEDEILCVHLSTLMCPMHRKEILRWIKVWLSKKKLVCCVSTALIEAGINVSFPTVIRSLAGIPSLIQAAGRCNRNCEADMGNVYLWNLAEERLSRLPDIQKGKEISMSLLSNVENPDELGNPEMIKRYFAKEEIYTQEVEKYPYKEWNSDLVTMLSTNRECRCTAGNLRDENNPLPDLSKRFYQSFRTAGTVFQVIDQKTKSVIVPYGKGKELIERLGDRHTLSEEIRLLKEAQQYSVNLFEHIFNRLAGEDALVSLGETGAVILKDEYYDPWAGVTITPQEMKELII

SEQ ID NO: 12478 - protein, 713 aa, Escherichia coli M863
MPASLASYAAQDKQAREEWISVLEALFLTPAGLSINDIPPDCSSLLAGFCSLADWLGSWTTTDTFLFKEDAPSGIQALRKYFQDRQQDACRVLELSGLVSNKRSYDGVHALLDNGYQPRQLQVLVDALPTAPGLTVIEAPTGSGKTETALAYAWKLIDQQLADSVIFALPTQATANAMLSRMEANASRLFTSPNLILAHGNSRFNHLFQSIKSRAFTEQGQEEAWVQCCQWLSQSNKKVFLGQIGVCTIDQVLISVLPVKHRFIRGLGIGRSVLIVDEVHAYDTYMNGLLEAVLKAQADVGGSVILLSATLPMKQKQKLLDTYGLHTDPEENNSAYPLINWRGVNGAQRFDLLAHPEQLPPRFSIQLEPIYLADMLPDLTMLERMIAAANAGAQVCLICNLVDVAQVCYQRLKELNNTQVDIDLFHARFTLNDRREKENRVISDFGKNGDRNVGRILVATQVVEQSLDVDFDWLITQHCPADLLFQRLGRLHRHHRKYRPAGFEIPVATILLPDGEGYGRHEHIYSNVRVMWRTQQHIEELNGASLFFPDAYRQWLDSIYDDAEMDEPEWVGNGMDKFESAECEKRFKARKVLQWAEEYSLQDNDETILAVTRDGEMSLPLLPYVQTSSGKQLLDGQVYEDLSHEQQYEVLALNRVNVPFTWKRSFSEVVDEDGLLWLEGKQNQDGWIWQGNNIVITYTRDEGMTRVIPANPK

SEQ ID NO: 12479 - protein, 713 aa, Clostridium sp. D5
MRYLAHIEAEAGEQELKDHLINVANVSAEFAKVFGCYDWGYCCGMLHDIGKYSIEFQQRLAGSDIRVDHSTAGAKLCYERGGMYGFLSYCIAGHHAGLPDTGEDSDTSRSPTFKGRLKKSVKDYQAYKSEICVPPLSEPPFDLSKAKDIDFTLSTFIRMLYSCLVDADFLDTENFMKAGKTDRDSGDSIEILLGRLQKHISGWLSNTDKDTVNGRRTEILKNCLEMGDLKRGLFRLTVPTGGGKTVASLAFALQHAVKNKLDRIIYVIPYTSIIEQNAKVFSEILGKNNVLENHCNVDYDSEEELKPMQLAAENWDKPVVVTTNVQFFESLFANKSSKCRKLHNIANSVIIFDEAQMLPNDYLKPCIAMMEELLKRYRSSIVLCTATQPALSQFFQKDIASTELCPRLEEQFRFFRRVSFHNLKTISEEELVVGLGKENQALCIVNTKKRAQNIYKKLDGVGIYHLSTCMYPCHRKRVLKEIRGRLQEGERCIVISTSLVEAGVDLDFQSVYRQLAGVDSIIQAAGRCNREGRRDVEESRTYIFRFDEREYVPGQKQQIAVTKDLLDDEADISSLESVSKYFKMLYHFRGESLDKKDILSEFRKGRYPFAKVSKEFKIIEENTKTIFINREQEADEILIKLKYEGFTKKLMRQAGQYCINVYENEFQKLYAAGMLGGISEDMNEDFFLLRTEDQYTEEMGLVLDVEFGCAVML

SEQ ID NO: 12480 - protein, 703 aa, Pseudomonas sp. TJI-51
MGADRDVIIAASTAAGKTEAAFLPILTNLLNDREPAGAVLYISPLKALINDQWDRLSRLCERLELPVVAWHGDVAASKKQRFLKSPEGILLITPESLEALFVNRGSSLPGAFQNLRYIVIDELHAFIGSERGKQLQSLMERVEIVVGRALPRVGLSATLGEMSLARKFLRPVRPDDITIIESKSSNQELQVQVRGYLEQPMQQVVAEYPGKSSTDEGDEQEETSGTKVAIAGHLYKVLRGHNNLIFPNRRQEVEWFADRLRSLCDNDGVPNEFWPHHGSLSKELRQDAERALKAGDPPASAVCTTTLELGIDIGNIRTVAQIGSPPSVASLRQRLGRSGRRPGEPAMLRAYCRERPLTDQSDLSDQLREGLVQTVAMIRLLIGGWFEPPRSGGLHASTLVQQCLSSIAQLGGASAAQLWGNLIASGSFASVTKPDFLSLLKGMGEKELIVQDSSGLLLPGELGERLINHYEFYTAFTSDEEFRLLRDGKPLGSLPVSKPLTKGQRIIFGGRRWQVQSVDLEAKMIVVTPARGGEPPQFDGLGAQVDDRVRLEMRNVLMETTPCPFLDKHAQVLLEEARSNFRALGLGSTAIVGSASVSYVATWRGDYTNDALALLLRHVGIHCENTGLFLEVAFSEEDTLRALRVVGQMDISNVEPILESVENMIREKWDWALPRSLLMKSFASSHLDLQAAVLTARLLGEEA

SEQ ID NO: 12481 - protein, 773 aa, Ruminococcus albus 8
MPFTAHIRESDKAVQTVGEHCSAVAELAEKYLDKNDLGAVGRLTGLLHDAGKLNKEFDDYINGRSGASRGSIDHSFAGAKYLASLGGGDNRKRVAAVSMAHTIVSHHGLHDWLDGDCNDYFKARISKEDNYEEVLENMGEIVGDTDISALFEKAVRQWYAATNIIKPKNSTEFSFYIGMLERLIQSALIDADHTDTAAFCSGEAVSDEKDTASLWADMDSRMDEKLKAFEKKTDPISRQRRSISDRCAAFAENRVGACRLIVPTGGGKTLSSMRFAIKQCRKFGLERIFYIAPFMSILEQNSDVIKEIAGDDNILEHYSDFAADIEDENEYSEYQLRTQHWDEPVITTTMVQFLNTLFSEKSSSVKRMHRLSNAVIIIDEVQSVPLRCTNLFSLAVNFLTKVCGSTVVLCSATQPPFDKNERGLLPDDKFDMTGDYSEDFKVFRRTELKPALEKYGHDFDSAADFCEERFEENGDMLLVVNTKKQALEMYGRLKERLGERAYVIHLSTNMCPAHRKKRIGTLRRFLRRGLPVVCVTTQLIEAGVDISFSCVIRALAGLDNAAQAAGRCNRGGEKGRLCPVYIINFKDEKLGSLNEIKSAEEISDNIITYNKDADLLSVEVQRNYFRQLFAKHSQELDYPANGTTLLDLLSLNKVNWEAHSSADNRFISQAFKTAGELFAVIDSHTEDLLIPYNAKAQKLIDQLDREHTPKETAAYLRQAQRYSVSVYVGTKLSLIEAGALRTNINGLLVLNERFYSSEFGVTVEGAEMECLIF

SEQ ID NO: 12482 - protein, 760 aa, Kingella denitrificans ATCC 33394
MTTYYAHSAQDELGNLLPYEHWQTLQSHSVNVGEMAAEFARVFGAQESACQTGRLHDLGKYSEPFDRRLHGGPSVDHATAGAKIAVERWGNVIGKLMAFCIAGHHAGLANGNGEGDNRRTLKQRLALQFGADIPALDNLWQQEIKLPQTLSAPPLKADAHHPFFSYAFFTRMLYSCLVDADYLDTEAFYSNLENKAVKRGGYPDLNALQHNFNQFINAFRRRIAQASEQTEAEKRNAALNRLRSEILDYAVEQAAQPQGLFTLTVPTGGGKTFTSMAFALEHAKRHSMRRVIYVIPFTSIIEQNAAEFRKAFGELGEQAVLEHHSTFDDGKLQNEATKDKLRLASENWDTPIVVTTAVQFFESLFADRSSRCRKLHNIAGSVIILDEAQMLPLNLLLPIMQAIKELAQNYHCSVVMCTATQPAVQAENGFYRGFENVHEIAPKPTALFDKLRRTTVQHIGTQTDADLLAKLGEHPQMLVIVNNRRHARSLYDQAKHLDGTFHLTTLMCAKHRSQKLDEIRGRLKNGELCRVIATSLIEAGVDVDFPLVMRAEAGLDSVAQAAGRCNREGKRPSENSFVWIFAPEEQWKAPPELAAQAAVMRLTADSFSDDLLSTQAVAAYFAELYQLKGSELDNKKILKMHNDTGQSLDFPFQTVADKFRMIESHMQPLIIPFDVEAESLISSLHHADHIGGLLRKLQPYTVQIPEKALAALYKAGRIEPINEKNFGKQFYTLIGLDLYDEVAGLSWEDNAFIKTENLVF

SEQ ID NO: 12483 - protein, 437 aa, Prevotella multiformis DSM 16608
MNSKILTKLGITLNAMQEETADAVLHTGKDVVVISPTGSGKTYAYLLPLIQRLKASSDELQAVVLVPGRELALQSASVLKDMGSGLRAMALYGGRPAMEEHRALREVKPQIVFATPGRLNDHLDKANIDAGTVKWLVIDEFDKCLELGFQEEMMHILSRLPGIERRILLSATESESIPDFVSMGRTVRLDYRTDNSGVSDRIRLYTVASPEKDKLETLSRLLLSLGDKSSIVFLNYRDSVERTALFLKEKGFTVSWFHGGLEQHEREAALYRFSNGSAPILVSTDLASRGLDIPDVDNIIHYHLPETEENYVHRVGRTARWDKEGKTFFVLGPGEHLPEYAGKCQDEYQIPERLPSPSQPRMGTIYIGKGKKDKISKMDIVGFLCKKGGLNASEIGKIDVKDRFSYVAVSRRKIKELLRLTKGEKIKGIHTVVEEVR

SEQ ID NO: 12484 - protein, 851 aa, Lachnospiraceae bacterium 6_1_37FAA
MEKMMLSIKELMKCSEQCYAHISENGEEKETLSSHTELCQKYWIRIFRKKHVDLLIKEFEKEYFDEISSDAKRIFEKMVVNIVTFHDFGKVNPKFQKDKMHHTFCLNLVPDSNIGSKHSILSAIFYLEYFLSEINKLDDKTERELLKDFAYIYSYIISRHHGKLVNLEAYLNSLTGRNGEGDDLGIRAKEWIECWKREWGEEKNSKLRKSWKNMLGRNGQEKTEKLVYLYGFTRLLYSMLVASDYYATSEYMKGVEIKNFGELEKCEKIIDIYENSFVQKSIRNYQQEHYPKEQLELKQEQDINILRTEMFLDAENELKRNINDSIFYLEAPTGSGKSNTAMNLSFAFMKQDKNIQKIFYIYPFNTLVEQNMETISRVFGENKEVMSQVAVVNSLVPLKERADEDDWGGKDKGKKYQTILLDRQFLNYPIVLSTHVMLFRTLFGHYKEDVFGFYQLCNSIIVLDEIQSYKNSRWEEIVTFLKAFAKLLHVKIIIMSATLPNLEILTDNQMKAVHLIKDREKYFHHPKFAKRVVADYGLLDQKMTLEKLEEHICTNITNNQKVLVEFIKKKSAEEFYERMKEQTDYPVLVMTGDSSIQERKRIIEKIQELESVILIATQVIEAGVDIDMDIGYKDTSRLDSEEQFMGRINRSAKRRGIVYFFDMDDAGKIYEGDVRGEDRFSLKITAMREILTTKNFPKFYEENILPAVKESGSSINEENVKYFFRESVQKLKFPEIDNRMKLIEDDRHMISVYLGREVMGEDKEIIDGRKIWEEYKDLLENETIEYSEKIVKLRNLRSKMNEFIYQFSEKTKFQEDEQIGDIYYIENGEKYFDENGVLNRKILENETDLFL

SEQ ID NO: 12485 - protein, 743 aa, Eggerthella sp. HGA1; identical to SEQ ID NO: 12466

SEQ ID NO: 12486 - protein, 732 aa, Xanthomonas vesicatoria ATCC 35937
MSQSSAFSLLSPGIQRYLWAEQWEALRDVQEMAIPLILPADQDVIVAASTASGKTEAAFLPALTYLEQQTPAGLIVYISPLKALINDQFGRLERLCEDLEIPVWPWHGDISSTSKQRFFRKPHGVVLITPESLEAMLCNRGTSIAGIFKHLAYFVIDELHAFIGSERGKQLQSLLHRIDTVVGRKVPRIGLSATLGDMQAAARFLRPAGTAAIVDAPSDASELLLIIKGFEEPVPQKGEADDKKEKQELAPLAVAEHLFKTLRGSNNLVFPNSRREVERYTHLLNELCEKGGVAREFWPHHGSLSKEIRYDTEAALKQKDQPATAVCTNTLELGIDIGAVKSVAQIGTPPTVASLRQRMGRSGRRKGEAAILRGYVIEDAIDSQADLRTRLRLDTFQTLAVVMLLTEKWYEPPVVKGAHLSTFIQQLLSVIAQYGGLTAPQAFQLLCAPSAPFNQVSRDAFVELLRHLGQQDILIQDGSGLLLHGPVGDRIVNHYSFYAAFTVDEEFRIVAAGKPLGTLPISQMLTTGQRILFGGRTWLVEQIDEAQKTIYVSATKSGAPPLFSGGGGRVHTKVRQTMRAIYQGTLTPTFVDARAQRFIDEGRTSYHQHGLDDQFFLDRGSDILLLTWLGDAANDAIACLLNARNFKAQGSRLGVEITRGPNALENIQTALRAIAATPTPSIEVLLAGAKNLASQKWDNLLSPHLLQVSYASSNLDLDEAMGWLRSSFPSRS

SEQ ID NO: 12487 - protein, 803 aa, Ruminiclostridium papyrosolvens DSM 2782
MFIAHIREDGTEQSVREHLENVSLLCAEACKKISLENMGRLIGLLHDMGKETEEFKSYIIYSFLHPEDKSQRGTVDHSTAGAKFIYKTYYCSKNPYEKLTAQIICLVICSHHGGLIDCIDLELRDKFTLRMNTDDLQKNYDEAINNFFEDCCEMNEIHRLFLESVREIKNILSRIRLVYDKKHFVKFAMAILVKFLLSCLIDADRYDTYSFMESKDILDRENDIFKNCLWTGLSEHLNKKLDDLPKISKIYLLRNEISQSCKSFAKNKTGIYKLLVPTGGGKTLSSLRYALEHAREFKKDRIAYIIPFTTIIDQNSKEIKDFLDREDIILEHHSNLIMDNDSEDYKLLTERWDSPIILSTMVQFLNTLFIGGTQSVRRLHNLVNSIIIFDEIQAIPIKCINMFNYAINFLSKICNTTVILCTATQPLLSKTEMPVFIEENANIISNADEKFRYFKRTKVIPKIQAGGYSIQDLKELISGLMDQVNSTLIILNTKKAAKELFKAIDKENLLLPEDKKAIVFHLSTNMCPTHRIELLNKIREVLGKQKVICVSTQLIEAGVNISFECVVRSLAGLDSIAQAAGRCNRHAESSCGNVYVINMDANSENVSRLLEIKTGQDKTLRIFEEYNQNPEAFDCDLLSPKAIDKYFEYYFNDLKLLMNYTLPKPYADKTMFDLLSENKQVVQDYIDRNQEKPDLMLYNSFKTAGDYFSVIDQNTVGVIVPYQKGEELIININGKCSIKNLKKYLKEAQQYSVNLYDQEYRNLNDLGAFMQLNNGGLIALKKEFYDESTGITTDNQQHEFLNY

SEQ ID NO: 12488 - protein, 784 aa, Thermoanaerobacter ethanolicus JW 200
MSSFSELYSHPDKFLEDHLINTSKIIRSYFNEKKVAIIDKETFLKTATIISLCHDFGKATNYFQKYLFTENEKERNKLKTMEETHHSLLSAVVAFYLVKNEINAQDRKGILFPFIAFLIVKNHHGDLKNVFNEVILDDKELEVLKKQLNSIDDEKLQVLNGKLRNAGLNENLTKSAINDYIDSINSELRKIKRELRRLKEEQDVSIYLLLNFLFSLLVDADKTEVVVGIDNIKRPEIKFEEQLVKEYKASFPDKESKINLLREEAYKEVLEKDIDIKQKIMSINLPTGLGKTLTTIAFAMKLWAKLYKETGVKYRIIYSLPFLSIIEQNSNVLEDLLRYNGIQPDTEIILKHHHLSDIRYTKNNTEFEDEQAKILIEGWNSEIIITTFVQFFHTLVSEKNKTLRKFHRLANSIIILDEVQSIPFKYWLLTKELLKAVANELNSYIIFVTATQPLIFREEEIYPLVAKTKYFTQMDRVEIIPKLSRDITLEELSEMFDLNDGKSYLFILNTIKSAQQFYNILRAKIPNDEIIYMSTHVVPMERLERIEKIKEGKIRFAVTTQLVEAGVDIDFDVVVRDIAPLDSINQSAGRCNRNWRGKGEVYVVSLIDEKGQKYSKYVYDKILLGITREILSKYDTIKEQELLKIIEKYYQEVSERMSSNEGRELLDAIYTLRYDSEDGNMCISKFELIEDDYYKVDAFIELNDEAKELWHKYVELKDIKNLFERRNIFNRFKADFYKYVISIPATVENMPPDIWGFKYVNYDSLNDYYDKETGFITKGVTSIW

SEQ ID NO: 12489 - protein, 820 aa, Acetobacter pomorum DM001
MCAMPANKTTPYVEYAQDRKEYRMLYAHSLPETPDKKGWEPLLEHLECVARCAARFASPFGCAVLAEAAGLLHDLGKASEEYQDYISKQAAKGPDHSTAGAREAVARYGKIWGRLIAFVVAGHHAGLTNAFQSERWSPTPLNERLDPTSRIIPDYSRWSSLGLKLPEQADLKPTRIFQPAPDYPGFREFFLTHMLFSALADADCLETERFYAEAAGLPLPARGGQITRKHLENLRAEMAARCNQATPLNRLRAEILEHAVGKASLAPGLFTLTVPTGGGKTLTSLSFALEHALKHGLRRVIYVIPYTSILEQTAEIFRDVLKSPDDILEHHSGFEWEKRAPDAERDSEHEGREGLDKLRRDAENWDAPIIVTTSVQFFESLFAAKKSRLRKLHNIAQSVVVLDEVQTLPVSLLRPCMAALDELARNYGTSLVLCTATQPALRKCDAALPALENGPAQGFDIDQQRELAPDPERLYATLKRVTVEWLDQPVTDEEIAARFSDCPQMLCIVNTRAHAQELFETINNLPGARHLTTLMCPMHRRQVLAEIRQDLQQKKPVRLVSTSLIEAGVDVDFPEVWRAAAGLSSVAQAAGRCNREGRLDGLGRTVVFESLDARKTVDQDEGNSSSQKKNLRILRSMLPFWQATRTIRRKGVDPLSLKGMHLYYQELYFNQGYEALDAATLPSGKSGKAGEKYPILPAVQRTASGMNLPFATIASAFRMIDTALAPVIIQWDEDAAQVVKQLQFMPYPTPRILRILQHYSVPVPPDVRMKLVMAGVCTLLHPEVFGDRFVVLEQNNDLYSAQTGLRLDDPTWRSEESNIF

SEQ ID NO: 12490 - protein, 930 aa, Atopobium vaginae DSM 15829
MTEINAALWGKKAEYDGAMLWLPLAQHLVDTSNVIGLLWEHWLSSSQRAMLTASLTKPACVKNLLQFVASVHDIGKATPVFQFREAIAGSKELDIQLKNKLITAGFKGADNFISSTKDWSTSHHNITGQAILEKYGVPHGICAIVGAHHGKPLDSSRVYLDDLAAYPDHFYQTEGISEVAQLWKNTQEQILAWALERNDFQCVADLPEISEPAQMVLCGLVIMADWIASNEHFFPLISIEESGITNQKERLERGWSAWIDHGTKDLWEPSLCAANANQQYNKRFGFTPNGIQQTIYEVIRTCNSPGIVILEAPMGSGKTEAALIAAEQLAQQTGKSGLFFGLPTQATSNGMFSRVHQWLKGVIGDFNSALGLRLVHGKAALNEDFAHIAKTCNSLNNGDVNSAVILNDWFSGRKTALLDDFVVGTVDQFLLAGLKQKHLMLRHLGLSKKVVIIDEVHAYDTYMNQYLEEAIMWMAAYGVPVLLLSATLPYERRDTLLRAYVKGLGLKWKTQCDKTEYDSHSETYPLLTYNDGAHIKQRAICERNGLHSLQIEVHKLIDDSKHTILLATLKELLQSGGVAGIIVNTVRRAQEIYNACQEEFGHDELTLIHSQFIATDRIRKEKRISEAIGKGATRPYKAIIIGTQVLEQSLDIDFDVLITDLAPMDLILQRAGRLHRHVIARPARVTTPHLYILATSEEFKFDKGAIAVYGAYLLMRTQYFLPQVIHIPEDICHLVQEVYGDSDIALPDDLKDLYVQAKDQYMNESNANKLNACNYRIDKPHTGIGKKSIMGLLSNSVTENSEEAGIAQVRNSRESIEIIALKKVGSGYGIFSDGNDIKEQIDIPYIAMKIARETISLPAQFTRTTKATEHCIRELEAYRQTHMAEWKNQPWLHDSLALIFDDNASCTFCGYTLKYNQELGILCQKEPHDA

SEQ ID NO: 12491 - protein, 719 aa, Oxalobacteraceae bacterium IMCC9480
MAAPFASAQWARLAGRWHDLGKYRPGFQRYIREISDAHCESSTTPRDKTHSAAGALWALNYFSHQHTGRVFAYLIASHHAGLYDWDDLAARMAGDDARRELAEALEKAPPALFSLDGFKPDLKMVPGGSAGFHLWLRLLFSTLVDADFLDTEAFMNTEVANRRAAFPTLLALSTRFDAHMDQLAAGASDTPINRARSEVLAQCREASTLAPGIFSLTVPTGGGKTLSSLAFAFDHAKVHGKRRIIYAIPYTSIIEQTADVFGRIFSADSFIEHHSNAESEPGHEDHQTRLACENWDAPLIVTTNVQLFESLFAAKTSRCRKLHSLVNSIIVLDEAQLLPAQFLQPIVDVLKLLTMHYGVTVVLCTATQPALGSRNSFDATRGFAGFDHVTEIIADPAALYARLKRAQVTLPADLNTPRDWDSIAGEIAGHDSVLAIVSTKKSAYELWSRLPAGAVHLSSLMCGQHRSNVIKTLRQQLASKRDGGSDMPLRVVSTQLIEAGVDIDFPVVYRALAGLDSIAQAAGRCNREGRQAMGQVHVFVPPIQPPPGLLRKGTDCSKLVWHGHAGDPLDLTLFQPYFHQLYGSCDLDEKGIKADLSTQGHGDHALALKLRTVSKKFKLIDDEDTASIIVLYRGDTGDQQAIDGLLGMLRNEGPQRWLMRKLQRYTVTLYQRDVMRMLADGDVAELFPGIFVQVSDVLYHPILGVNVDGLPGDPAQLIF

SEQ ID NO: 12492 - protein, 787 aa, Lachnospiraceae oral taxon 107 str. F0167
MEIKDELAEIYKKYKAKENETIYEHTKNLLSKLEELKDIVAIDDIDLIAEACIFHDFAKVNPLFQRRLESGKKLDENEEIGHNILSFYMAKNYLEEYSKEDRNIILYAILNHHNYVDNFETIDKKQDLISANLKSISTEVFKDDEIDFFKNIGLRELAVIRKLRTNPSKKSILVKGFLHKCDYAASAHSKIDMPNIHLESRLEKLKDDFVSKGSSDGWNEMQRFARDNTDSNLILIGSTGLGKTEASLLWIGNNKGFYVLPLKTAINAMYRRIKNTLYKDDYTKNLGLLHGELENIYLEEDDESSMALDSETEESMKFWEYYGLTRAMSLPLTICTPDQVFRFAFKYCSYELQLATYSYSKMVIDEIQAYSPDILATLIYALQLIDMVGGKFAITTATLPPFIKDLLQEGIDKKIEYKEKPFLNNKIRHRVSLRHSAINIDDIKDFIDDKYHQESMKLLVVVNTVTKAQGIYRELKSWLDENDIEIEMNLLHSKFTVQHRSEKEEAILKDGESKCKKRVIWISTQVVEASLDIDFDYLFTELSDLSSLLQRLGRCNRKGLKSVDEFNSYVYLDIDENLLIKYSDNNAYSSGGIIYKSLYELSKAALLEWETENNTGLFSEADKNSLIENYFTKKKIEEYDKMYSSIYREYLAEYKRMHDHLVYIIPDSKNAKEVTKEFRNIISRRVIPQSIYEDKQENIIGIIDEIEEKRKLIGKTKSTVEKQKLRVDILRLKNEFRKFTLNISLRELDKDKDYCVVDNEKIIISTRVYNKEYGIIKEKEGSGSIFL

SEQ ID NO: 12493 - protein, 756 aa, Lachnospiraceae oral taxon 107 str. F0167
MNVYERYAPFIREYIYNSGWQVLRGVQNAAADVIFNTDENLLLTASTASGKTEAAFFPILTLLDENPSSSVGVLYIAPLKALINDQFLRLNYICEEADIKVTRWHGDATQTGKRKLLKKPSGILQITPESLESLMINKHMEIMSLFYDLRFIVVDEIHSLLRGDRGLQTFCLIERLCKMAGCDPRRIGLSATIGNPKLAGDFLGCGSKRKTLIPEFDRGKETWRLSMEHFFNTDPQAGELAEDKIPHREDDMPYFSHMDKMSKNEDTKTGCSAPRGANPGLAYIFEHTKGKKCLVFTNSREECEAVCQHMRQYCEAMHEPDRFLIHHGNLSASYRESAEEEMKDDDSLISICATATLELGIDIGRLERAFQIDAPFTVSGFLQRLGRTGRRDAPSEMWFVMREDHPEPRAMMPEMIPWYLIQGIALVQIYIEERFVEPPRLDRLPYSLLYHQTMSTLASIGEMTAAELASRVLSLSAFKRISQDDFRALLLHLIDIDHINRTENAGLIVGISGERVVNNYKFYAVFVENIEYSVRTESQELGTIVRPPDNGGKIAIAGRVWVVEEVDHKRRVVYVSPVKGNIPAYFGDVAGDIHTRILERMKTVLSESKEYIYLMSNAKKRLLEARECFKKANLYDKPLIHLGGNMWALFPWLGSFAFLTLERFLRLHCAKELGLRGVNPCRPYFIQFTMNVSEKEFYKTVKEKALEDIDPMSLVYEKEVPVFEKYDEFIPEELVKKGFAYGVLDIEGMKNRVKEW

SEQ ID NO: 12494 - protein, 733 aa, Pseudomonas amygdali pv. morsprunorum str. M302280
MWSQGWTSLRDAQEWAIPALIEADRDVIIAASTAAGKTEAAFLPILTNLLNSADPSGAVLYISPLKALINDQWDRLTRLCERLEIPVVGWHGDVSASKKHKFLKSPSGILLITPESLEALFVNRGSALAGLFQNLRYIVIDELHAFIGSERGKQLQSLMHRVESVANRKLPRVGLSATLGEMALAREFLRPGQTRRMDEIISRASGQDLQVQVRGYTMLPLKKLVASEQAAIAKDDDDEEDASGTRHAIAAHLYKVLRGSNNLIFPNSRDKVEWYADRLRRLCENDGLPNEFLPHHGSLSRDLREDTERALKAGTPPASAVCTTTLELGIDIGNIRAVAQIGPPPSVASLRQRLGRSGRREGEPATLRAYCQESTLTPESGLSDQLRQDLVQTIAMIRLLIEKWFEPPRANGLHASTLVQQCLSMIAQQGGASAAELWTSLVASGTFAAINKADFMTLLKALGEKKLIVQDSSGLLLPGEIGEKLVNHYEFYSAFTTDEEFRLVRDGKPLGSVPVSRPLTLGQRIIFGGRRWQVLDVDLEKKVIVVMPARGGEPPVFDGLGAKIHDRVRQEMRAVLTESSPCPFIDANAQALLEEARQTFHRLGLADQYLTGSASSSYLLSWAGDYTNDALCLLLNQSGVMCSGSGLVLEIGASRESALAALGRIAELDANDVEPLLKDVKNLIREKWDWALPKSLLIKSFASSQLDIPGAIALAKALVLHERDAVLTDPPST

SEQ ID NO: 12495 - protein, 416 aa, Pseudomonas savastanoi pv. glycinea str. race 4
TTKPMDRLVCGDVGFGKTEVAMRAAFIAVHGGRQVAILVPTTLLAQQHYNSFRDRFADWPVTVEVMSRFKSAKEVSAAVADLAEGKIDIVIGTHKLLQDDVKIKNLGLVIIDEEHRFGVRQKEQLKALRSEVDILTLTATPIPRTLNMAVSGMRDLSIIATPPARRLSVRTFVMEQNKPTIKEALLRELLRGGQVYYLHNDVKTIEKCAADLAELVPEARIGIGHGQMRERELEQVMSDFYHKRFNVLIASTIIETGIDVPSANTIIIERADKFGLAQLHQLRGRVGRSHHQAYAYLLTPPRKQITPDAEKRLEAIANTQDLGAGFVLATNDLEIRGAGELLGDGQSGQIQAVGFTLYMEMLERAVKSIRKGEQPNLDQPLGGGPEINLRVPALIPEAYLPDVHTRLILYKRIANA

SEQ ID NO: 12496 - protein, 726 aa, Pseudomonas syringae pv. pisi str. 1704B
MTPRACGTRIGGRRSGRHHRGSTAAGKTEAAFLPILTNLLNRNDPPGAVLYISPLKALINDQWGRLDRLCEQLEIPVVAWHGDISSSRKHRFLKSPEGVLLITPESLEALFVNRGSSLPGIFQNLRYIVVDELHAFIGSERGKQLQSLMHRVELIADRKLPRVGLSATLGDMRLGSEFLRPGATNHVTVIESKNSNQEIQVQVRGYIQPPMSHLVKAVPPAPDSQNEEQAKGDGEADEEGDKASPDFAIADHLYKVLRGSNNLIFPNSRAQVEWYADQLRRRCEQNGVPNEFWPHHGSLSKDLREQAEQALKAGTHAASAICTTTLELGIDIGNIKTVAQIGSPPSVASLRQRLGRSGRRAGEKATLRVYCKESPLKDGSSLSDQLRQSLVQTIAMIRLLSRGWFEPPRAQGIHASTLVQQTLSIIAQSGGASAGDLWKSLVAEGAFKTIDKTDFIALLKALGEHELIVQDSSGLLLPGVIGERMINHYEFYSAFTSDEEFRLVCEGKTLGSVPVSRPLTKDQRIIFGGRRWQVRDVDLQAKVIMVSAARAGAPPSFDGLGAMVHDTVREEMRAVLAESAPCPFLDSGGQQLLNEARTLFGGLGLADRYLVEAGGKCYLVSWLGDYANDALRLLLNHVGTPCENAGLFLEIGADLDQAKAALGTVAKLDICDLPTILADVENMNREKWDWALPEALLMKSFASISLDIEAAVAFARSVGAAEVIKR

SEQ ID NO: 12497 - protein, 369 aa, Pseudomonas syringae pv. pisi str. 1704B
MDRLVCGDVGFGKTEVAMRAAFIAVHGGRQVAILVPTTLLAQQHYNSFRDRFADWPVTVEVMSRFKSAKEVNAAVADLAEGKIDIVIGTHKLLQDDVKIKNLGLVIIDEEHRFGVRQKEQLKALRSEVDILTLTATPIPRTLNMAVSGMRDLSIIATPPARRLSVRTFVMEQNKPTIKEALLRELLRGGQVYYLHNDVKTIEKCAADLAELVPEARIGIGHGQMRERELEQVMSDFYHKRFNVLIASTIIETGIDVPSANTIIIERADKFGLAQLHQLRGRVGRSHHQAYAYLLTPPRKQITHDAEKRLEAIANTQDLGAGFVLATNDLEIRGAGELLGDGQSGQIQAVGFTLYMEMLERAVKSIRKGE

SEQ ID NO: 12498 - protein, 711 aa, Pseudomonas syringae pv. maculicola str. ES4326
MIKADRDVIIAASTAAGKTEAAFLPILTNLLNSADPPGAVLYISPLKALINDQWDRLTRLCERLEIPVVGWHGDVSASKKHKFLKSPSGILLITPESLEALFVNRGSALAGLFHNLRYIVIDELHAFIGSERGKQLQSLMHRVESVTNRKLPRVGLSATLGEMALAREFLRPGQTRRMDEIISRATGQDLQVQVRGYTMLPLKKLVADKQTSITKDGDDEEEDASGTRHAIAAHLYKVLRGSNNLIFPNSRDKVEWYADRLRRLCENDGLPNEFLPHHGSLSRDLREDTERALKAGTPTASAVCTTTLELGIDIGNIKAVAQIGPPPSVASLRQRLGRSGRRDGEPATLRAYCQENTLTPESDLSDQLRQNLVQTIAMIRLLIEKWFEPPRANGLHASTLVQQCLSMIAQQGGASATELWSSLVASGTFAAISKTDFMTLLKTLGEKKLIVQDSSGLLLPGEIGEKLVNHYEFYSAFTTDEEFRLVRDGKPLGSVPVSRPLTIGQRIIFGGRRWQVLDVNLEKKVIVVMPARGGEPPVFDGLGAKIHDRVRQEMRAVLAESDPCPFIDANAQALLGEARQAFHRLGLADRYLTGSASSSYLLTWAGDYTNDALCLLLNQSGVMCTGSGLVLEIGASRESALAALGRIAELDANDVEPLLKDVKNLIREKWDWALPKSLLIKSFASSQLDIPKAIALAKALIIVEPSQGGPG

SEQ ID NO: 12499 - protein, 727 aa, Pseudomonas syringae pv. aceris str. M302273
MWSQGWTSLRDAQECAIPALIDADRDVIIAASTAAGKTEAAFLPILTHLLNNTDTPGAVLYISPLKALINDQWDRLTRLCERLEIPVVGWHGDVSASRKHRFLKSPRGILLITPESLEALFVNRGSALAGLFLPLRYIVIDELHAFIGSERGKQLQSLMHRVETVVGKKLPRVGLSATLGEMALAREFLRPGQGRRMDEIISRASGQDLQVQVRGYTMLPMNKLAANLQMVVTKDDDNADQDEEQEEDVSGTRHAIAAHMYKVLRGSNNLIFPNSRDKVEWYADRLRHLCENDGLPNEFLPHHGSLSRDLREDTERALKAGSPPASAVCTTTLELGIDIGNIKAVAQIGPPPSVASLRQRLGRSGRRAGEPATLRAYCQEDTLTPDSDLSDQLRQNLVQTIAMIRLLIEKWFEPPRANGLHASTLVQQCLSTIAQQGGAHASQLWNELIASGTFAAIDKTDFMALLKALGEKKLIVQDSSGLLLPGEIGEKLVNHYEFYSAFSSDEEFRLLRDGKPLGSIPVSRPLTLGQRIIFAGKRWQVMDVDLEKKVIAVIRARGGEPPVFDGLGAKIHDRVREEMRAVLTEVTPCPFLDANAQALLAEARQTFHRLGLADQRLTGSTSSSYLLTWAGDYTNDALCLLLNQAGVMCTASGLVLEISASQESVRTALARIAELDATDVEPLLKDVKNLIREKWDWALPKSLLIKSFASSQLDIPNAIALAKTLTT

SEQ ID NO: 12500 - protein, 514 aa, Pseudomonas syringae pv. aptata str. DSM 50252
MWSQGWTSLRDAQEWAIPALIDADRDVIIAASTAAGKTEAAFLPILTHLLNNTDAPGAVLYISPLKALINDQWDRLTRLCERLEIPVVGWHGDVSASRKHRFLKSPRGILLITPESLEALFVNRGSALAGLFQPLRYIVIDELHAFIGSERGKQLQSLMHRVETVVGKKLPRVGLSATLGEMALAREFLRPGQGRRMDEIISRASGQDLQVQVRGYTMLPMKKLTENLQMVVTKDDGNDDQDEEQEEDVSGTRHAIAAHMYKVLRGSNNLIFPNSRDKVEWYADRLRHLCENDGLPNEFLPHHGSLSRDLREDTERALKAGSPPASAVCTTTLELGIDIGNIKAVAQIGPPPSVASLRQRLGRSGRRAGKPATLRAYCQEDTLTPDSDLSDQLRQNLVQTIAMIRLLIEKWFEPPRANGLHASTLVQQCLSTIAQQGGAHASHLWNELIASGTFAAVDKTDFMALLKELGEKKLIVQDSSGLLLPGEIGEKLVNHYEFYSAFSSDEEFRLLRDG

SEQ ID NO: 12501 - protein, 787 aa, Rubrivivax benzoatilyticus JA2 = ATCC BAA-35
MAQLAAELLALGGDDDALPACGRLAGLWHDLGKYRDGFQRYILMVSEAHIEGKLPQGSDKSHSAAGALYAESWLQQQYGAPGLLIARLLQYVIAGHHAGLDDWRIDIGSLHGRLASADASRELDEALQAQPPAAVLAPSVALPSLKSLPLPLGTGVEEIPGRLALWTRMLFSALVDADFLDTEAFMNPGVATMRKCALPSMAELLRTFDAFMERKADSVKAAGLVDTEVNRRRAEVLACCRAKALGRPGTYTLTVPTGGGKTLSGLAFALTHAVQNKLRRVVMVIPYTSIIEQTAEVFRDVFAALGPEVVERVVLEHHSNVAEPDAANETTSSRLACENWDAPLVVTTSVQLFESLFARKTSRCRKLHRLRGSVIVIDEAQLLPVRFLQPVVDVLRLLVRDHGATVVLCTATQPVLAEARAFGGRGLRGYPPGEVTAIIDHEAALYDALRRVRVNLPSDLHSPQPWEVTAQAMARHDAVLAIVGRRADARTLYEALSRDLKDGAGAMAGRSLWHLSALMCPQHRSEVIADIKHALAERRDALARGAPAVPVRVVATNLVEAGVDLDFPVVFRAIAGLDSIAQAAGRCNREGRLAQGEVHVFVPPKAPPPGLLRQAAQACKLVWESPDDDGDTDPLSLERVSRYFRRLYGDAQSLDEADICKLLQVEVDRQDKALSMCFRSAAERFRMIDNEDAATVIVRYRSARCRDDIDALIGLLARDGPSRWLMRKLQRYAVTVYRYDLQRLLDCGDVREQLPGLYVQTESDVFYDPTLGVLLGGAPGDPAAFVI

SEQ ID NO: 12502 - protein, 743 aa, Caldalkalibacillus thermarum TA2.A1
MFYAKSHPPESLKEHTERLLENYELLQAIYKPKLLWMDGRTWDLLYWAAVYHDVGKADPVFQNKIRTALNKKSLPTQSNHDVPHNYLSALLIPYKDLNLSKEETKLLAQAVGYHHERERDPDKMQIKENYESNIVPILDQIEAHIGVKLAAKPRLKAVDWLDVRQRLRPREGEWFYRYVMVKGLLHRLDHAASAGVAIELAHDYDVGDYVNRFIANYFGGKKRPLQQFAEQHQHDHVIAIAQTGMGKTEAGLLWIGKEKGFFTLPLRVSINAMYRRIQDSKKIGFTSKQSQNDEERAIGLLHSTSMDFLYDNNEKEVEVLYQYARQFAPKLIVTTIDQILKFPFYYRGFEKELATLAGAKVVIDEMQAYEPRIAALIIRALKMIDEFGGKFMIMTATMPKIYLDTLQKELAHSTTPLFVDTFVDDSVKRHHIRLRDKSILEDADLICCVGEQKKVLVICNTVKRAKEMYDVLKKQKGSIPVKLLHSKFTQADRARLEAEILAFANDKTAKGIWVTTQLVEASLDIDFDLLFTEMSVLDSQFQRYGRCNRKGLKDIAAANVYVYTRDISGKGSVYDKKLLQRSLSLLETVDGTILLESKKLEMIEALYDPEELKKDEDERSFYNIFTRTLRELKERPLYEITGQEAQDLLRDIQQILVIPEELFLAHETQQVVEQFRLSKDRKERRLLRRELERLTVSANRFKAKQVGIHRAGLPEELKDMWIISCQYDPHKGLELDQEIDPFS

SEQ ID NO: 12503 - protein, 791 aa, Caldalkalibacillus thermarum TA2.A1
MNVLYSHPDQSLQNHLAGVLKAVQQLWEQRQFTGWETTEEKRRLRDLLCVAAVFHDFAKATSYFQDYILSEDKKKTPLNRHSLLSAIVSYFIGKKILEPQQHASYEPLFLFLAVKRHHGNMNNLFSEVNIPQEERHPLLEQAKAIDYAGWNDIVFHLAPFLPETIKSLHPLTEEQVTQWVETFFEKDIRHWRRKIRRELKPQTVQTTQFYYKYCSLYSLLLDADKNQAAFQEKLRIERKDINSFCVDEYRAKQNWNLEGINRLREQAYREVKENLEQAPGRLFSINLPTGLGKTIISLKAALQLRERRKCERGIAPRIIYALPFLSVIDQNAKVFEDVLRYQPFPVDPFMLMKHHSMVDPYEEMFGDAEYDFNENQARILMEGWQSELICTTFVQLFQTLISNRNRALRKFHRLSNAILVIDEIQAIPVKFWPLMREMLLELTCGMNTDVILLTATQPKLFEPADGLIELCDRQKYFNQMDRVRLFPNVSTKQTIEEFVEGLNLYPERSYLFILNTISSAKELFAELKTKFDEPIAFLSTHIPPKERLKRIREIKAGKYRIVVSTQLVEAGVDIDFDVIYRDLSPMESIVQSSGRCNRNGLRTGTVHIMHLWNGKKGSYAGLVYPKVAIEETKALLQQFEEIKEQELFPLIEKYYEIIKTKLSKSESIKYLNAVSTLYFSGEEDPERIPVSDFQLIEEEYPKIDVFIELDEEARRIWSSFEEIIDMENSLQRYQQLARLKIKFQEYVVSVPAKVENRPPVVNDYFYVGYTSLADYYDPDTGFITEGVTAIW

SEQ ID NO: 12504 - protein, 770 aa, Lactobacillus ruminis SPM0211
MEYLAKSSGETIVDHTKELLKRLAILKKLYPNALKNDGWRLLEIACKYHDLGKMNRKFQSKLLEGKSKIEGEIPHALLSISMLPFDELEEEFDDEQIRALTYSIALHHARDFSEITESNYDNEIELVRKEEDKFPFYLLGLKRDSEFEKKAVGRFYERIIVQNEYFDLDARLSSSDPEYDYFVILKGFLNRIDYAASGGYDIESPGRINFADRIKKYHKDKNDDFEWNELQKWTVEHNDDSIVFVAQTGMGKTEAALRWAGNNKTFFVLPLRSAINAIFDRVRTQAFGSKDESNEYLSILYSDMSNKVIDNFREKNNVNITNYKEYVERSRQLSQQLTISTIDQIFSFVYHYQGFESKVATLSYSKVIVDEIQMYSPNLLAYIIYGLKIIQKYGGKFCIMTATLAPFIVDLMKEKGLKYKLPEKEKPFLDKKLNRRHKVKIFHYELDIDKVMEIYRKFDGNILIVCNTVNKAMQVYDALFEHIGNDVHMIHSRFIARDRKKKEIEIQKFSNDHLKGIWIGTQVIEASLDIDFDVLFTELSELNGLFQRMGRCYRRRNYVGDEYNVYVYDGGEKNPSGIHGGGRTVVHYGMYKLSKNAINNIDGYLSEEEKIDLINNVYTTKKIKESDVANDYIEEVKNTISYLESGADDAIDRRSVMKKFRDIDSIQCMPYSVYESNRMSIKDKISFLNDYYKGKNKSKDYLDKKIEYSNYLDQLTVAVPTYIVYEVENIYKVIEVGKRNIIILSKGFNYSFDKGLSLSKNIDDEDSNVW

SEQ ID NO: 12505 - protein, 712 aa, Lachnospiraceae bacterium 3_1_57FAA_CT1
MFLAHISEDKLREQSILEHLEGTAELAGEFASAFGSEAWGYGCGMMHDIGKYSDSFQKRIHGGKLTDHATAGARELYQRHNYVCAYCISGHHTGLLDGGSAADVGGEATLMGRMRKQTDDYQEFRKEVKIPVFPPPPLKQLGKGGFSLSFFIRILFSCLVDADYLDTEKFMTDGTIKRGAFDSIETLFDRLFHHVEPWLDSGDISTVNGRRTQILKACLEKGKEKQGIFRLTVPTGGGKTISSLAFALQHAAEHHLDRIIYVIPYTSIIEQNAQVFKDILGENNVLEDHCNVVYEDPDKLNKIQLASENWDCPVVVTTNVQFFESLFSNKTSKCRKLHNITNSVIIFDEAQMLPVNYLKPCIQAISELVYNYHSTAVLCTATQPSLQSFFPPQLEAMEICPEIQEQYAFFRRTVFRNAGEITEEFLVNQLKEQVQVLCILNSRKKVQQIFNEIKELEGTYHLSTFMYPRHRKKVLAEIRNRLKMGLPCRLIATSLVEAGVDFDFPTVFREMAGVDSMIQAAGRCNREGKRAKEDCVTTIFTLENAEELHIPQSLRLPVSVAQQVAEKQEDIASLEAIADYFNRLYHFRGESLDSKKIIEQMEAGGKSFLFPFAAVAEQFRLIENNTRTILIDRDPEAEILVERLRRGECSRQLIRDIGQYCVNVYEEDFEKLNGAGRLEALELGFFILRNKEQYTEEMGLQIEVERGDAVIF

SEQ ID NO: 12506 - protein, 807 aa, Lachnospiraceae bacterium 5_1_57FAA
MNDPYIAHFYKDSNNAIHIQSVSEHNLNVAYLAMSNSPLKCLSSVAWVSGALHDAGKYREGVQNYLRRAMNEEQVRRGEEDHSTGGGFLIDKMFPATNLSVLIQMAVFCHHGLHDCFSFEKSTIYIKERLSKKENFQNVEERYYQYLKKEDLEKRGLIAKQEVAGIIQEILGFIRIKNLSKNMYGNRDFFLGMYERTIMSLLVDADRTDTACFMEQRELPAPKSDEMMQDIWGKCITYLERYLKSMKSESRLDEYRRDISRKCMEAGEREERLYRLTVPTGAGKTLSSLRFGLYHARKYHKRHIIYVAPYQSIIDQNAEEIRRAIHNDEIVLEHHCNVIHDDEREKIRYEILTENWDSPIIVTTAVQFLNTLFASGIGNIRRMYSILNSVIIFDEVQALPVKITKLFNLSVNFLTAFGKSTVVLCSATQPLFDELDENRLLPPLSMAGNPKEYAEVFKRTKIIDATKGAGSGFAAEELQEFIWDKAETLKQVLVVVNTKKCAESLYKEIKKKCKGSDYILFHLSTNMCAEHRRDVLKRLEENLENEKKVICISTQLIEAGVNLSFKCVIRSLAGLDNIIQAAGRCNRHGEAGMGYVYVVGISSELENVERLAEIRKMQESMTEVLNQFRKNPAIFDHSLSSEESIRYYYQIYLRKRMPEMEYLVSVNGVDVTLLDLLSTSKTMWESMSESTKKDSKNLLLKQAFKTAGDVFEVIPEDGKVDVVVRYDEKAEKQIAILEDEYATLAEHKKALRRLQPYTVGISEQFRQKLGNAITSVCGGTVYVLSQNYYSRETGVSEEPLGMEFINF

SEQ ID NO: 12507 - protein, 613 aa, Lachnospiraceae bacterium 2_1_58FAA
MEYIAHIDEKDKKRIQTVKNHLEGTAKLSGEFAGKFGKEDWGYCNGMLHDIGKYSVDFLKRITGESNQRVDHSTAGARVCVEKGGKYRFLEYCIGGHHTELPDYGSNYDNAGDPTLMGRRKKKISDYQVYQTEIDIPEIVTDPFDFKKTVNLDFSMSVFIRMLYSCLVDADFLDTEAFMSRGKKVRNSGEPVGVLLEKLEKHVSEWLKNQDMDTVNGRRTEILKHCLEEGRSERGLFRLTVPTGGGKTIASLAFALRHAVENQMDRVIYVIPYTSIIEQNAKVFREILGDENVLENHCNIAYEVDSQRAEELQPMQLAAENWDKPVVVTTNVQFFESLFANKPSKCRKLHNIANSVIIFDEAQMLPNDYLKPCIAMIEELLNNYKTSVVLCTATQPALKSFFQSEVLATELCPRMDEQFHFFKRTLFENIGTVTEDCLMNKLTEEYQALCIVNTKKRAQNIYKELKEDGVYHLSTSMYPKHRKRVLNEIRERLGENKKCILISTSLVEAGVDLDFQSVYRELAGVDSMIQAAGRCNREGQRKVEESKVLIFRFEEKENILGQRQQIDVTKSLIADGRNLSDRETITRYFEMLYHIKGESLDKKKSWTSLQIRK

SEQ ID NO: 12508 - protein, 713 aa, Prevotella multisaccharivorax DSM 17128
MNRHDEILGKSAKNGSVTLYRHLSDVADVAVAIARNEGMDESIAREGAWLHDIGKCSPLFQCSLSPSYIRKPDEVFRHEIASLFFISLVPEDHRKVVIEMVAAHHKSAYKDARELGIIDLDEDEDSFQIHAKRFSEWVNTALDILQSLGMQIRPLSLEEAEANYEEAVDYCRAMKFCCSPWRGLLMAADHMASALDKRMEMPVSRLFIKPDLSFYNRKSPLYPLSLVSADDHRKSTIVTAPTGAGKTDFLFRRCQGRVFYTLPFQASINAMYDRVKKDLADTNAQVYLLHSASGIKVKGGKVEEQIMQRHVGASVKIMTPQQMASVVFGIKGYEAMALDLRGCDVILDEIHTYSDVMQAIVLRIIEILVSLGCRIHVGTATMPSFLYKKILDLLGGEGSVYQVSLPEDTLVTFNRHRIFKLMSAEDSFAVIKTTVEEKRKILLVCNQVKRAQQLFEDVSTLYPNTPVMLIHSRYKRADRSCLEEELKSRFNRMDSEACIVVSTQVVEVSLDISFDMMITECAPIDSLIQRFGRINRKRTEATIGHYKPIYVIAPPNDDKEALPYKTEILKKSFEVLPDRGNVLEETNVQAMIDAVYPIENFKNIDYSGVVFSNGKWQLKGLCHYPKSALLDMLDINSAVCITEADKEKYLSSDAMVRTEMEIPISYHSIAHRNFDQIDQGLRPFIIPNKAYDKQKGLLMEMAEREYYQSYEFL

SEQ ID NO: 12509 - protein, 845 aa, Fusobacterium nucleatum subsp. animalis 11_3_2
MTKFEDIFDFQDKYKYLAHIKNNREETLQEHTELANKYLKKIIEYKNLKPFFERIKNILNLKNQEEELYYKMIDDVVNFHDFGKINSQFQIDKMLNEEILKMEDKYNISGVLGSDHSLLSASMFIAYYFGKITDLIEIVETKKIVILFEILFALSYVISKHHGNLDSFEEYIEKLSRNNDENILKELKNISVSNGGILLQAFLEKETITIFFNFIETYISERKKKENISSHEAMSIFVFTKMMFSLLVASDYYSTNEFMQKIKYENFGNMGNIDIIKKEYENSEIIKSIRDKEKNGIPNDEDINNFRTKIFLEAEKNLEKNKENNIFFLEAPTGSGKSNTALNLSLKLLDKDRRKIFYVYPFNTLVEQNMNTLKNIFGNNKEAIKNITVVNSITALTNKDSRDIPIEEYSDILMDRQFLNYPFIVTTHVGIFNTLIGNTKEDCMPFYQLTNSVIVFDEIQAYKNTIWTEIIKILNSYAKLLNIKIIIMSATLPNLSYLLDEEEKNNISKLIENRDEYFNNTIFKNRVEVNYDLLSEQKIEYEELLQHIIKNSLNSQKILIEFISKNDAKKFYELCENNEDLNVDHKILILTGEDNKARRNSIIKKINSKDKKIILISTQLIEAGVDIDVDVGYKNISGLDNEEQFLGRINRSCKKSGKAYFFYLTDAKKVYKNSVIIENKLNLFSDEMKDVLENKNFDIFYSKVLEILKRKAKEKINNDNFETIIFNKKFRLLKERMQLIEEQDDKKTYFFNRALTDEEIEEIGENIDGSEVWERYVEILKEENYAKKIVELSKIREKMMYFLYEVKKNTELNYSDIKGSIIYIDDGDKYFTDGVYNGGEGDMFI

SEQ ID NO: 12510 - protein, 731 aa, Prevotella dentalis DSM 3688; identical to SEQ ID NO: 11956

SEQ ID NO: 12511 - protein, 760 aa, Neisseria macacae ATCC 33926
MTTYYAHSAQDEFGNLLPYEHWQTLQSHSVNVGEMAAEFARVFGAQEIACQTGQLHDLGKYSEAFNRRLHGGPSVDHATAGAKISVERWGSVIGKLMAFCIAGHHAGLANGGGEGDNRRTLKQRLALQFGADIPALDNLWQQEIKLPETLSAPPLKADAHHPFFSYAFFTRMLYSCLVDADYLDTEAFYSNLENKAVERGGYPKLNALQHNFNQFINAFRRRIAQAPEQTEAEKRNAALNRLRGEILDHAVEQAAQPQGLFTLTVPTGGGKTFTSMAFALEHAKRHGMRRVIYVIPFTSIIEQNAAEFRKAFGELGEQAVLEHHSTFDDGKLQNEATKDKLRLASENWDAPIVVTTAVQFFESLFADRSSRCRKLHNIAGSVIILDEAQMLPLNLLLPIMQAIKELAQNYRCSVVMCTATQPAVQAENGFYRGFENVREIAPKPTALFDKLRRTTVQHIGTQTDADLLAKLAEHPQMLVIVNNRRHARSLYDQAKHLEGTFHLTTLMCAKHRSQKLDEIRGRLKKSEPCRVIATSLIEAGVDVDFPLVMRAEAGLDSVAQAAGRCNREGKRLPENSFVWIFAPEEQWKAPPELAAQAAVMRLTADSFSDDLLSTQAVAAYFKDLYDLKGKELDYKQILQMHRNAGQSLDFPFQTIANKFRMIESHMQPLIIPFDVDAENLISSLHHADHIGGLLRKLQPYTVQIPEKALAALYKAGRIESINEKNFGKQFYTLIGLDLYDEVAGLSWEDLNFFRAEGLTF

SEQ ID NO: 12512 - protein, 448 aa, Ichthyophthirius multifiliis
MKNNQIQSLSVLLKATPFKNPHQQEEYQQELQQTSNNDLVIISDPPLRKHSKLNPEQQSQQQINPQYQINSSPLEIIEQPSPNLKQENPYQFNELLLPGQEPLPVHDNQQLIVKTIRRNQVTVISGNTGCGKSTQIPKFIAIQNVQSKIIVTQPRRVAAIALAQRVSEELKSPLGVRVGYQIGQESRQNKSTQILYVTIGIFLQKLVNDPEGFLSEYTHIILDEVHERGIESDFALIALKTFLSLQKESSEVKLVIMSATLNKEIFLNYFSENQLNSLKEEIEMDQFQTENYFLQQKFSTLNQLYNVNGSILIFLPGYNEIIKMRQTLEDYIMKSPVQQIKQFPYKILELHSSLGDVNTRELLGQQKYQKIILATNIAESSITIPFCFVVFDFCLTKEINYNHSNGIERLQLAWSSKASIIQRAGRVYIYIIYIVCLFDYYFQDWQKL

SEQ ID NO: 12513 - protein, 1122 aa, Vibrio cholerae HC-02A1
MMVTFVSQCEKNALKKTRRVLDAFANRIGDNTWQTLITEEGLLTVKKMLRQTASRSTAVSCHWIRSRSRSQFLWVVGNKKKFNAEGYVPVNSTEKNLLNSEFENDWKYLPLIKAITGMAALLHDWGKASLLFQEKLNPEIKNKHKGDPLRHEWISCLLFQQWISNQTHERLDEVWLNSLIDKGIDETCFNTNVLQKEKALAELPTAAALIAWLIVSHHRLPLPKEKDLCDRQREADNSSLADLLARITPAWGYENRFDEYNALLPKCFEFPLGLLSNSSIWLAELKRRAKDLLHHLPLLVQAINDGSWRGILHHARLCLMLGDHYYSSQPNDHQWKTSIELYANTDPSTKARKQKLDEHLVNVAKVAVNTVKLLPFFETEPLKATELYELAPKANTPKAFRWQDKAVRKINEWREHTEDKSQGYFVVNMASTGCGKTIANAKIMQALSEEGESLRFILALGLRTLTLQTGDEYKERLKLQESDLAVLIGSKAISELHKSGKAVEKDDIEPEQADAGSESLESLQDENDVLDWQGVLPEEELTTVLTKEKDRKLLYAPVLVCTIDHIMAATETKRGGRYILPCLRLMSSDLVIDEIDDFTGDDLIAIGRLVHLAAMLGRKVMISSATIPPDLALGLYNAYRQGWAVFAASRDRVSTVNCVYVDEFSADVQMVGCNDSDLAAYQEFQQSFVSKRVDKLKQQVAKRKADIIPCIKQNDQPLEQQYFEIVKQAVLAKHQHHNTLEPESQTRVSFGVVRVANIQPCVELTQYLLSCDWPADTEVRCMAYHSQQVLLLRHTQEKHLDEVLKRKEKTGELPEAFAHPVIRDHLTTCQAKNLIFILVATPVEEVGRDHDFDWAVIEPSSFRSIIQMAGRVRRHRDGEIKEPNIGLLQYNVKGFRGGAERVFNHPGYETDSTTQLATHDLCELVDEKSLLQAVNAIVRIQKRVVLESHNNLADLEHFATAKTLGIDQIGKPQQVNISRQERYSRNRRNSAPQSCWHEHLHGHIHGYWWLTALPQYFKRFRKSEPTVQIYLVKKARSIEFCLREEGMPSIDEVLNIKHLPLPPMQQQKLWLQRDYSELVSIYSPSAEQEFDTSVRYGEISFIYREGNQQYSYNDQLGLVKVK

SEQ ID NO: 12514 - protein, 823 aa, Haemophilus haemolyticus M21127
MNFDYIAHVRKADGQPQFLQTHLTETAEIAKLLAAKLDLDQAGELLGLMHDFGKYSRKFQKYIHDETSLFNPDLDDEESTPNGSKVDHSTAGAQWAYRELRKFGAAQGIGELFGQMLGLCIASHHGEGLIDCLDGEGNPKWIERFNKTDELTHLVECERNADEVVQQKAYELAGENLIRSLLNAVKPILSNQTINNKIKEFYLGCLTRFLFSCLIDADRINSSDFEREAQKEVRHLAEKPDWQSAIDKLEAKLAGFENRYPIDEIRRRISDDCLKRAVDFQGIYTLTVPTGGGKTLASLRYALHHAQKHNLDRIIYIIPYTSIIDQNAQAVREILGEYWILEHHSNLEPEKQSWQDKLLSENWDKPIVFTTMVQFLDAWFGGGTRGARHIHPMTNSVLIFDEIQTLPVKCVHLFCNVLNWLTTFGKSTAVLCTATQPLLGESGLRNFPEGKRERIAARGLLRLPENAEIMGKHQDLDKLFADLSRVEIRFNEKAGGWNVEEAVAFLLEQFQTTQSCLFIVNTKKWAQELYQYCKAQNVPPEALFHLSTHQCAAHRKAIFDTIKGRLKNGKPVICISTQLIEAGVDISMACVIRALGGLDSIAQAAGRCNRHGEKKGKGQVWVLNLQEQDFTRILPDIQAGKTHAERVFRDFAGQDILQPAAMERYFEYYFYQRSDEMAYYVKNSATGSLLDWLSDNALNPYGEKNNKISKPLPLLMQSFKSAGRAFQAIDAPTRAVIVPYGEGTELIAKLCGEWDPKEMHRTLQKAQRYSVNVFPNVWDKLQKENALHETIEGSGIYYLKERHYNDEFGLSLDETSDMTFLNY

SEQ ID NO: 12515 - protein, 731 aa, Haemophilus haemolyticus M19107
MLAYLIAGHHAGLADWYDKGSLKLRLQQADNELEASLSDLAESGLPKDFFPLSDDDLMRDFFAFWEDGAKLEELHIWLRFLFSCLVDADFLDTEAFMNGYADADTAQAARLRPKFPGLDELHRRYEQYMAQLHEKSDKDSFLNQERHAIFQQCFSAAETDRTLFSLTVPTGGGKTLASLGFALKHALKFGKKRIIYAIPFTSIIEQNANVFRKALGDDVVLEHHSNLEVKEDKETAKTRLATENWDAPLIVTTNVQLFESLFAAKTSRCRKIHNIADSVVILDEAQQLPRDFQKPITDMMRVLARDYVVTFVLCTATQPELGKNIDAFGRTILEGLPDVREIVADTIALSEKLRRVRIKMPPPNGETQSWQEIADEIAMRPCVLAVVNTRKHAQKLFAAMPSNGIKLHLSANMCATHRSEVIALVRRYLALYRAGSLHKPLWLVSTQLIEASVDLDFPCVYRAMAGLDSIAQAAGRCNREGKLPQLGEVVVFRAEEGAPSGSLKQGQDITEEMLKAGLLGDPLSPSAFAKYFCRFNGKGDVDKHGITTLLKAELSLTAESSNENPLAIKFRTAAERFRLIDNQGVALVVPFIPLAHWEEDGSPQIVKANELDDFFRRHLDGVEVSEWQDVLDKQRFPQPTDNSFGQTDQPPLPEPFESWFGLLESDPLKHKWVYRKLQRYTIIVYEHELKKLPEHAVFSRAGLLVLDKGYYKAVLGADFDDTAWLPENSVL

SEQ ID NO: 12516 - protein, 548 aa, Parvimonas sp. oral taxon 393 str. F0440
MGKTEAGLHWIGDTKGFFVLPLKTAINSIYYRIRNNICNGEEIEEKLALLHSDTLSMYLENFEGEDNDKILSYYENSKKFSIPLNITTPDQIFDFVFRSKGFEFKNAMMSYSKVVIDEIQAYSPELLATLIRGIQDIIEIGGKVCIITATFPPFIKDLLFTENFDYLNKEEQKYKFITKEFTNDMKRHNVKVVEEELNSEYIYNHYVKNNSNNKKYLVVCNTIKKSQEIFADLKEKGLVNINILHSKFIKKERNEKENKIIEIGKTENIGNEIWISTQIVEASLDIDFDFLFTELSDLNGLFQRLGRVNRKGKKEVNDYNCYVFTEINKNLLKENKDSKKGFIYKEIYDLSKEAIKQKGDGILTEKDKQNLIKEFFTFEKIKESAFLKEYKDRYNYINISLRDLGIETETKQTFRDIISFNVFPVDVERGLLNENEINSILNELKDIKSKLICSESEDEKIELKLKYTKKLDELMKYTVSVGLYDTKYLKEKIEISKNINLYKVYCKYDEKGFIRLTSEEGKLLDGVGFEKIIDVNKTDYEYEYDSFI

SEQ ID NO: 12517 - protein, 821 aa, Thiorhodococcus drewsii AZ1
MPSAPTSLPFSETFAHPGDPLPAHLERVAQRAEASIAPTARAEARAIAFVAGLFHDLGKATPWFQAYLLHAGRRSALTHHAELGALLLWWYTAALDWPLWQRLAAFIAVRRHHGALTFQDWPALFEQTRAEWQDPESPLHRQLAVLDVAGIHAWLTDLGVRYPGLSQAPEPLTLEHVEARLRDRQAGGSKLRRAFGSLDEALAMLAGFGALLAVDKTDAALQGGRIARQVLPAEAVMRYKERYLVPAAVSHPHPNPSPSRERGSLTPLAPAGRGAGGEGRAIPLNHRREHIASNVTQTWLANLDHPLLTLTAPTGAGKTLTVLHAALQARAALEARDAEAPRIIYCLPFTSVIDQNHAVFRAVLRANQIADREDLLLKHHHLAETRFRTEDAEYQPDGADQLLTETWQSELVVTTFHQLLHSLLSPRNANLKRAGQLTGAIVLLDEVQALPLRYWEALRQLLMASARTLGTRFVLLTATRPLIFQPGDAVELLPDHDSHFRAMTRTRLHAHQRDPLTLDDFAERLTADLRQDARPTLIILNRRRAVRRLFEALRDTLPERPLVALSTDLTPLDRRARIRLIQRLLRQGEPVIAVTTQLVEAGVDFSFPVVHRDLAPLDAVIQAAGRCNRHGENGAQPGEVHLWQLQDAKSDGQTGESLWRRVYDAALIEVTSHTLATAQSWDECDFLELTQRYFLGCRARQDQQRVDEQLAQGDLIGVEGAFQLIEEQLRVSLFVARKPADHRIWEQYRRLRDDPRLSPAEQEAGFRPFKCAFYERVIQVHARAALGLERDLLHRLDASEETYDREAGFIGLPGDEPTCIL

SEQ ID NO: 12518 - protein, 764 aa, Neisseria weaveri ATCC 51223
MSVDTRLIRTYYAHSAENQPYEYWQTMRSHAHNVGEAAARFAAFFGAEEMARYTGQLHDLGKYTPEFNRRLHGGPSVDHATAGAKIAFERWGLQGKLMAFCIAGHHAGLANGNSEGDNRRTLTQRLAVPFGKGIHDIPEPDEVWQQDISLPQTLPASPLQADKHHPFFSYAFFTRMLYSCLVDADYLDTEAFYAGLEDKTVQRGGHPDLLQLQQRFNRFIGDFRRHIAEKPQHTEEEKRNAALNRLRSDILDHAVRQAEQAPGLFTLTVPTGGGKTFTSMAFALEHAKRHGMRRVIYVIPFTSIIEQNAAEFRKAFGDLGEAAVLEHHSTFDDSKLKDQHSKDKLRQASENWDMPVVVTTAVQFFESLFADRSSRCRKLHNISGSVIILDEAQMLPLKLLLPIMQVIKELARNYHCSVVMCTATQPATQAEHGFYRGFENTRELAPNPAELFDKLRRTTVQHIGLQTDADLLEKLTQHKQILIIVNNRRHARSLYDSAKQLEGVFHLTTLMCAKHRSQVLETIRGRLKNSEPCRVIATSLIEAGVDVDFPLVMRAEAGLDSVAQAAGRCNREGKRPSESSFVWVFKPEEQWKAPSELGLLSASMREVVRHHADDLLSPQAIRRYFQRVYEEKGKELDSKGILEMHKKAGNSLNFPFQTIAQKFRMIETHMQPLIIPFDQEAERLIDSLRHADQIGSILRELQYYTVQIPEKALRALFKAGRIETVNENRFGKQFYSLIGLDLYDEVAGLWWEDVEFLKAETLVF

SEQ ID NO: 12519 - protein, 764 aa, Neisseria weaveri LMG 5135; identical to SEQ ID NO: 12518

SEQ ID NO: 12520 - protein, 848 aa, endosymbiont of Riftia pachyptila (vent Ph05)
MSGLPYLPEDIHTNMPDGRTNHIIESWQNNSMDNSHSNHSHIIAHRRSSDGKLQLLETHLEETAAIAASITAKIGLSEVGELLGLLHDVGKYSAKFQGYIQSATGMIDPDADYFSDFRTQKGKIDHSTAGAQWVWQRLGRYGDRGRFCAQILATCLASHHSGLIDCLKPEGEDGFKRRIDKPDQDTHLSECQSKAATDYLKHLERLADRPLLMAMLGKLQQLGAGKQHGQSISETIKHFYVGMFTRFLFSALIDADRINSADFEHPENQGLRNNAPIEWEVAINRTEAALNELPVRNRIDEIRRDISDRCRQRAEEPQGIYSLTVPTGGGKTYASLRYALHHAKTHKLDRIIYVIPYTSIIEQNAEAIRELIECGSDARPWVLEHHSNLEPEQQTWHSKLAAENWDAPIVLTTMVQFLEALFSGGTRGARRMHQLANSVIVFDEIQTLPVNCTHLFCNAINFLTTYTRTTALLCTATQPLLNQLRTPEKGGLSIPPENELAGDLSQLFAELKRVDISNRVRDKGWSAEEIRDLILEQFSEQGNCLVIVNTKGWAKRLYQLCREQISDTDTLFHLSTHQCPAHRKELLGKIRKRLDDDKPVVCISTQLMEAGVDVDFASVIRFLAGLDSVAQSAGRCNRNGRLKSATVHVINPADEPINRMADIKEGRDQALRIFNEFSNDELLTPPVMSQYFYYYFFSRDKVMSYPLTSRQAGQQESLLNLLADNKNNSMGGRLIRLNQSFMTAGKAFKAIDAPTEAIIVPYGEGELLIAALCGVSIEYDPREYYRLLKAAQKYSVNLFPNVLQKLREQEAIHEIQPGEGIFYLDERYYSEAFGVATEEVAVLGFLNV

SEQ ID NO: 12521 - protein, 879 aa, endosymbiont of Riftia pachyptila (vent Ph05)
MKETSPNAFGKLQRNEEGIISAWHTLTDHQTDVAACFEHLCRCHNIRRALETTAEQKLQPRDISRLSALVFLHDLGKANSGFQAKRWTRDKLPQEWPLPAGHGIEASKIFSADVPTSLAERLPIEAMDSWGEAVLSLLIASISHHGRPIDFESTSNWNPAIWKPVTDCNGNIIYDPESVLQQIGELMVALYPNAFEPAGNDLPDTPAFGHLFAGLVQLADWISSDTDFFPYAKENEQRTETAPRYAAAAITALGLDTENWRDQINALSPEFAHVFQVPSPYPIQKAMDDPDLGPLVILESETGSGKTEAAIWRYLHLFRTGQVDSLYFALPTRVSATQAYQRIKSAINRIWSTDAPVTVRALPGYASADGQDIKILPDFKVQWPDDPGDVEAQRRWAAESPKRFLAAPIAVGTIDQALLGALQVRHAHLRHALLSRSLLVVDEVHASDPYMTALLERLLKAHLDCGGHALLLSATLGSSARDRYLALAPQREKPAATTTNYDSACTIHYPAISDFSDIRPIASAAPEKTISWTLHDCMDDPEQIARMALDAAGEGAKVLVIRNTVPAAIAVLRALEESNPDPAWLFNVNGINTLHHSRFSRQDRPILDKAIQEQLGKTGKPGPRIVVGTQTLEQSLDLDADLLITDLCPMDVLLQRVGRLHRHHRSQNERPERFQTAQAWVLTPPGHNLTPMLKRSRHGLGRFRNGGGIYDDLRIIEATRRLIDKHLVVNIPEKNRYLVETATHSEQLTAIQDELGEPWQTLAQQVEGDTGAQNVIARLHALNFNEVFGERKDNLFPNDVKIGARLGAEDRLLQFDPALPGPFGAPLKQLPVRHFLVPDGLDLDAQPNQIVQQDGLIEFTLGTTRYRYGRLGLERLTDD

SEQ ID NO: 12522 - protein, 774 aa, Desulfovibrio sp. 6_1_46AFAA
MLYAHSLPDQPVSLWQSLEQHLRKSAQRAETFGRAFGAGDWAALAARLHDLGKASPEFQAYISGQGGRRRIDHSTAGARLLLRHWKTRGKEGEHMALWLAYCIAGHHGGLPDLGDGASDAGSLRSRLDPSYAVPDYSAGLDLATPVDIPQPGALPFPFRLSREHAAFSVSFFVRMLFSCLTDADFLDTEHFYAPENRQQRDRWPSLDTLCERLHDFLSAQGFLLATSGDSPIVAARKEILQHCLNAAALPPGAFTLTVPTGGGKTLSSLAFALEHARRHHLDRIILAAPYTSIIEQNARVLRDALGADAVLEHHSNYVHPVEQAAADQTGESDALQGAAALPFRLAAENWAAPVIVTTAVQFFESLFSSRPSRCRKLHNMTRSVVILDEAQMLPVPLLEPSVLALRELTEHYGASLVLCTATQPALRRDGPLKNGFAKNSLRELIPAPRMAELFKTFTAHRRLTISQPGKLSDEELARRLLREHQVLCIVNSRAQARAAYESLERDDDAHFHLSARMTPRHRLLVLDTIRQRLRRGLPCRVASTSLIECGVDISFPCVYRVRCGLDSVAQAAGRCNRSGELPSGSLHVYTPERPVSRAQADLYLRARFFSQVAEKHADILAPEAVEAYFSELYGFADLDAKHLLKTLREKNRRFAVPHIFDFRTMDALYQLIPEDTAPVIVTHGVNDGGDLAEKSHALVRRLETEYPPHRLTLRLLQGFSVQVYPYELERLRAAGNLERLHGCFDVLRNGAGYDPKLGLLVDDPTRQTPEDCLF

SEQ ID NO: 12523 - protein, 817 aa, endosymbiont of Tevnia jerichonana (vent Tica)
MDNSHSNHSHIIAHRRSSDGKLQLLETHLEETAAIAASITAKIGLSEVGELLGLLHDVGKYSAKFQGYIQSATGMIDPDADYFSDFRTQKGKIDHSTAGAQWVWQRLGRYGDRGRFCAQILATCLASHHSGLIDCLKPEGEDGFKRRIDKPDQDTHLSECQSKAATDYLKHLERLADRPLLMAMLGKLQQLGAGKQHGQSISETIKHFYVGMFTRFLFSALIDADRINSADFEHPENQGLRNNAPIEWEVAINRTEAALNELPVRNRIDEIRRDISDRCRQRAEEPQGIYSLTVPTGGGKTYASLRYALHHAKTHKLDRIIYVIPYTSIIEQNAEAIRELIECGSDARPWVLEHHSNLEPEQQTWHSKLAAENWDAPIVLTTMVQFLEALFSGGTRGARRMHQLANSVIVFDEIQTLPVNCTHLFCNAINFLTTYTRTTALLCTATQPLLNQLRTPEKGGLSIPPENELAGDLSQLFAELKRVDISNRVRDKGWSAEEIRDLILEQFSEQGNCLVIVNTKGWAKRLYQLCREQISDTDTLFHLSTHQCPAHRKELLGKIRKRLDDDKPVVCISTQLMEAGVDVDFASVIRFLAGLDSVAQSAGRCNRNGRLKSATVHVINPADEPINRMADIKEGRDQALRIFNEFSNDELLTPPVMSQYFYYYFFSRDKVMSYPLTSRQAGQQESLLNLLADNKNNSMGGRLIRLNQSFMTVGKAFKAIDAPTEAIIVPYGEGELLIAALCGVSIEYDPREYYRLLKAAQKYSVNLFPNVLQKLREQEAIHEIQPGEGIFYLDERYYSEAFGVATEEVAVLGFLNV

SEQ ID NO: 12524 - protein, 743 aa, Candidatus Arthromitus sp. SFB-mouse-NYU; identical to SEQ ID NO: 12061

SEQ ID NO: 12525 - protein, 957 aa, Streptomyces zinciresistens K42
MADSAAVAGLLWDHWLPRNVREMLAGPLPGGEDDGRRLCVWLAGTHDIGKATPAFACQVDELAGVMNAAGLGMRTRKQFGDDRRMAPHGLAGQVLLEEWLEERHGWTRRASGQFAVVAGGHHGVPPDHLQLHNLDAHPELLRTPGPSEAVWRRVQGELLDACAGAFQAEERLAEWQRVKLPQPVQVLLTAIVIVSDWIASNPGLFPYFPEEYSRGEAERITAAWRGLTLPAPWAPAEPRETAAELFATRFGLPPEARIRPVQEQAVTMARAMPEPGMLIIEAPMGEGKTEAALAVVEVFAARSGAGGCYVALPTMATSNAMLPRLLDWLGRLPGSVVPDDEAGAGFPADPPAGEPHSVLLAHAKAALQEDYALLLRSGHRTIAAVDAYGGEYAQETGGARSASADLVAHQWLRGRKKGLLASFAVGTIDQLLMTGLKSRHLALRHLAMAGKVVVIDEVHAYDAHMNTYLDRVLSWLGAYRVPVVVLSATLPAARRAELAEAYTGSSTTAVRDATGYPLLTAVSSGSEPVTASPAPSGRRTDVALEALADDDAVLVDRLATELADGGCALVVRNTVDRVLNTAATLRERFGPQHVTVAHARFLDVDRARKDAALLRRFGPPDSDGRSPHRPRQAHIVVASQVAEQSLDVDFDLLVTDLCPVDLLLQRMGRLHRHPRGERQSDRPPRLRNPRCLVTGADWQSAPAPEPVRGSRNVYGAYPLLRSLAVLAPHLGTTDGPDEPVRLPEDISVLVQLAYAESEEHCPSPWAEALGTARARHEEDRAKQQRKAEVFRLDGVRGPGRPLIGWIDAGVGDADDSPAGRAQVRDSRESLEVLVVMRRSDGTLRTLPWLDGGRGGLELPTGAVPSARAAKAVAACGLRLPYHFSFPEEFDQALAELEELYVPAWQEKESHWLAGELVLALDEECRTRLAGFFLTYDPDEGLMVSRDEPSKKEEGAAR

SEQ ID NO: 12526 - protein, 788 aa, Erysipelotrichaceae bacterium 2_2_44A
MNILAHINNKQEMQSLQEHSVNTFTAIKEYAAARGLTNCMKLIAFLHDCGKASKEFQKYITKAAMENIFLPKVNHSSAGAQILLEACRFYNNMSECLVKLMFANAIVSHHGLCDFINVHGDNALRSRCYPEKSLDMNHITTFMNDFISTEELEKLFRAAHKEISVYLANFMKQRTVKDAKDYYFYIGALQRLLMSLLIHGDREDTRNFMEQTKTIVYTEDTIWQAATDKLESHLAEITANSSFNPINELRASISDQCKAFSSHSPGIYRLSCPTGSGKTLASLRYALHHAKKYHKKHIIYVAPFKTILEQNAEVMKQFFNEDLVLEHHSNIIPSQYTDYDYYSSSWNKPVILTTAVRLFDVMFKDRTTDVRRFHQLADSVLIIDEAQKIPVQTISMFNEMMNFLAYNCNTTVVLCTATQPLLETTTYPIKLASESEIVKQTKEMQEQFKRVHIEDACRRGGYSIADLSDFIFQKLQPGCSMLVIVNTKAEALNLYRACEQHHEIDGLHLYHLSTSMCPEHRHLTLEDLKEHMEQKDTVLCIATNLIEAGVDIDCDVVIRSLCGLDSILQAAGRCNRNGKNSELGTVYLINSNEEHIEKLKDVRKGQNETDILLSQLHASKEGNRVDELLTLPFIRQYYDSYLFDRRQDTEYSTKIENRKVSLFDLFSRIGSKNESDDLAHPCLGHALKSAGEKFEMIDSQSIGVLVPYKDGEKLINQLNSSISNAEKYALLDKTQRFMVNVYEHKYKELEKEDMIYKLEFNGMLVLRDGFYNKDTGLEVRKELEDMFV

SEQ ID NO: 12527 - protein, 882 aa, Nitrospirillum amazonense Y2
MEKPHDCTYSISILNTGLQELMVIRGNAWGKYDDESLTSHHLAHHSADVAACFEFIISLPVIQARFEKLAGRPLTPTMRAQLTAVTFLHDAGKLHPGFQAKGWPKGIWQGPLHGHGAEGRALLMSGGAPAAVRRALRLAEIPWWIDAQPFVLAALSHHGRPLTGLAMHAGWTTVSTPDFTYDPQEAAGIFGHALHSWFPEAFGDGDRQELPDNPALQHLFAGLVALADWIGSDRDYFPFEAMFREDYIQTARKGAREALSAIRIDLEAVRSRAHGRTGFEILTGFAAPAPHQRAIVDLPLSERLIILEAETGAGKTEAAFWRFARLFEAGLVDGLYFALPTRAAALQLHGRVDRMLKRMLGAAALEAVLAVPGYLKSGEIQGRPLPNWQVRWDDDGTAAEDILAARWAAESTRRFLAAPVAVGTVDQAMLAGLQVKHAHLRAACLARSLLVIDEIHASSHFERAIQTDLLEAHLDRGGYALLMSATLGSSARARWLHGRKANPPSFADAVATPYPALWCRGAQAPIAVETSGQEKGVAMALAPGWKAEAVAERAIAAARAGAKVLVIRNTVKAAVAAWEAVRANGGEALLLPIAGGPALHHSRFASEDRALLDAAVQRVLSPGEARPNGGMIVIGSQTLEQSLDIDADFLITDLCPVDVLLQRLGRLHRHSRVSRPCGFEKPQCVVMAPDRGLDPLLAPAFENGLGAWRDDSGSVSGIYLDLSMLELTQRLIADHPQWSIPSMNRFLVESATHDEPIAALHAELGGSWDSYRNVVIGLGMAQAGAGRMRLLQVNEPFGDEPFPENEEKVRTRLGGEGIRLTLPNPIKGPFGETITALTLPAHWSAGVDASGAVTVENADGGMRIGIGGRWFRYDRRGLSRRL

SEQ ID NO: 12528 - protein, 675 aa, Verticillium dahliae VdLs.17
MADFDVNSAFIPALHKPAALLPIAKHREGLLYLIETKPVTIIVGQTGSGKTTQIPQFLEASGWADGGKVIGVTQPRRVAATTVALRVAEEVGCEVGKEVGYSIRFEDVTSSSTRIKFLTDGLLIREALVDPLLSRYSVIMVDEAHERSISTDILLGLLKKIMRKRPELRLIISSATLQADAFLKYFTPATDSEAPGTQVPESPATVVNIEGRAFPIDILYLEEPTEDYFERAITTVMDIHTKEADGDILVFLTGREEIDKAVQAVADRLLEMGPQERTLEPLPLYAGLSTEQQMLIFDKPPENKRKVVFSTNIAEASVTIDGIVYVVDCGFVKLRTYDPDLGIDSLTTTPLSKASAMQRAGRAGRTRAGKCFRLYTEETWESLADANVPEVQRTNLAPFILQLKALGIDNILRFPFLSAPPAKLMAKALELLYSLGALDEYAKLTRPLGYRMAEIAVEPMMGKTLLSAQSFGCLSEILTIAAMTSVAGNVWFYHDGERKKMESSRRKFATEEGDHLTLLNVYLAFITKGKKEARFCHDHNLNFKTMTKAVSVRAQLKRYIERFGIPVDESPGTKLTQQDMLKKAEQIRRCLTSGYFAHAARMRPDGTFQKVAGDMTLHAHPTSLLFSRKADWVIYHEIIETGSKVYIRDITKIERNWLLEYAPDFYKISKPADRV

SEQ ID NO: 12529 - protein, 763 aa, Aggregatibacter aphrophilus ATCC 33389
MSQSVIRYAHSAQDKLGNLLPYEHWQTLQSHSVNAGEMAAEFARVFGAQEIACQTGQLHDVGKYSEPFNQRLHGGPSVDHATAGAKIAVERWGNVIGKLMAFCIAGHHAGLANGNGEGDNRRTLKDRLALRFGADIPVLDNLWQQEIKLPETLSAPPLKADAHHPFFSYAFFTRMLYSCLVDADYLDTEAFYSNLENKAIERGGYPDLNALQHNFNQFINNFRRRIAQAPEQTEAEKRNATLNCLRSEILDHAVEQAAQPLGLFTLTVPTGGGKTFTSMAFALEHAKQHGIRRVIYVIPFTSIIEQNAAEFRKAFGELGEQAVLEHHSTFDDGKLQNEATKDKLRLASENWDAPIVVTTAVQFFESLFADRSSRCRKLHNIAGSVIILDEAQMLPLNLLLPIMQAIKELAQNYRCSVVMCTATQPAVQAENGFYRGFENVREIAPKPTALFDKLRRTTVQHIGTQTDANLLAKLAEHPQMLIIVNNRRHARSLYDQAKHLDGTFHLTTLMCAKHRSQKIDEIRGRLKNGEPCRVIATSLIEAGVDVDFPLVMRAEAGLDSVAQAAGRCNREGKRLPENSFVWIFAPEEQWKAPPELATQAAVMRLTADEFSDDLLSTQAVAAYFAELYQLKGSELDNKKILKMHNDTGQSLDFPFQTIADKFRMIESHMQPLIIPFDGEAENLISSLHHTDHIGGLLRKLQPYTVQIPEKALAALYKAGRIEPINEKNFGKQFYTLIGLDLYDEVAGLSWEDTAFLKGESLAF

SEQ ID NO: 12530 - protein, 821 aa, Aggregatibacter actinomycetemcomitans serotype d str. I63B
MSRNAIAHVRQSDGLRQLLIDHLFETSSIAGQLASKLNLSLAGELLGLLHDFGKYSLSFQDYIKAATGIDPNADDYVLPGGRKIDHSTAGAQWVYRALRKYGVAQGIGELFGQMLGLCIASHHGEGLIDCLDESGNAVWKKRFEKEDELTHLAECSRNADAQVLQRAQTLAGEELVRELLNAVKPILSDKTIPQKKQEFYLGCLTRFLFSCLIDADRINSSDFEKAHQKDVRRLVEKPDWQDAIEKLENHLAQFAIRYPIDQIRRNISDDCLKRAVDFQGVYTLTVPTGGGKTLASLRYALHHAKKHDLDRIIYIIPYTSIIDQNAAAVREILGEDWVLEHHSNLEPEQQSWQDKLLSENWDKPIVFTTMVQFLDAWFGGGTRGARHIHPMTNSVLIFDEIQTLPVKCVHLFCNVLNWLTQFGKSTAILCTATQPLLGEAGLNHFPENEREKIIRRGLIKLPENAEIMGDHQDLDNLFNALSRVEIQFKEKAGGWTAEDAGEFLLEQFQTTQSCLFIVNTKKWAQQLYQYCEQQNVPPEALFHLSTHQCAAHRKAIFERIKGRLKNGEPVICISTQLIEAGVDISMKCVIRALGGLDSIAQAAGRCNRHGEKDSKGQVYVLNLQEPDFQKVLPDIQEGKSNAGHVFRDFAGQDILQPAAMQRYFQYYFYNRSGEMIYPVKNSATGSLFDWLSDNQNNPYGNKNNKKTKAFPLLMQSFKSAGRAFHVIDAPTRAVIVPYGEGKALIGKLCGEWNPAEMRRALQKSQRYSVNVFPNVWDKLQKDQAVHETIEGSGIYYLNERYYNDAFGLSLDETSNMTFYDL

SEQ ID NO: 12531 - protein, 834 aa, Aggregatibacter actinomycetemcomitans serotype e str. SC1083
MQMSEFIAHARQDSKWHFHPLQNHLAKVAKLAKRFAGRYGALFAEYAGLLHDLGKFQAAFQEYIRKVTGFERENAHLEDIESSKPHKIPHSTAGAKYAMQNLEPFFGHLLAYLIAGHHAGLADWHDKGSLKHRLARADDELAESLAGLEKSGLPEDFLSLSDDALEEDLLNFWKNGINPEELHIWMRFLFSCLVDADFLDTEAFMNGFADADAVQQAGFRPKFPGLEELHCRYEQHLFELAEKPDKDSALNQERRAILAQCFSAAESDRTLFSLTVPTGGGKTLASLGFALKHALKFGKKRIIYAIPFTSIIEQNADVFRKALGDGAVLEHHSNLEVKEDKETAKTRLATENWDAPLIITTNVQLFESLFAARTSRCRKIHNIADSVIILDEVQQLPRDFQKPITDMMRVLARDYGVTFVLCTATQPELGKNIDAFGRTVLEGLPDVREIMADKIALSERLRRVRIKMPPPNDKTQSWQEIADEITERSCVLAVVNTRKHARRLFAALPSGGIKLHLSANMCATHRSKVIALVRRYLELYRKGRLKKSLWVVSTQLIEAGVDLDFPCVYRAMAGLDSIAQAAGRCNREGKLPDLGEVIVFRAEQGAPSGSLRQGQNITEEMLKAGLLADPLSPLAFAEYFRRFNSKGDLDKHKITALLTAESSNDNPLAIKFRTAAERFRLIDNQGVALIVPFIPLIHENGDKSPKIVQASELDDFFRRHLDGVAESDWQKTLDDYRYPSPPDNHFGQTDKPPLPEPFEMWFKLLEADPLKNKWVYRKLQRYTITVYETELKKLHKDAVFSRAGLLVLDNGHYHDVLGADFDDDTVLSSNRLVL

SEQ ID NO: 12532 - protein, 719 aa, Aggregatibacter actinomycetemcomitans serotype a str. H5P1
MAQGIGELFGQMLGLCIASHHGEGLIDCLDESGNAVWKKRFEKEDELTHLAECSRNADAQVLQRAQTLAGEELVRELLNAVKPILSDKTIPQKKQEFYLGCLTRFLFSCLIDADRINSSDFEKAHQKDVRRLVEKPDWQDAIEKLENHLAQFAIRYPIDQIRRNISDDCLKRAVDFQGVYTLTVPTGGGKTLASLRYALHHAKKHDLDRIIYIIPYTSIIDQNAAAVREILGEDWVLEHHSNLEPEQQSWQDKLLSENWDKPIVFTTMVQFLDAWFGGGTRGARHIHPMTNSVLIFDEIQTLPVKCVHLFCNVLNWLTQFGKSTAILCTATQPLLGEAGLNHFPENEREKIIRRGLIKLPENAEIMGDHQDLDNLFNALSRVEIQFKEKAGGWTAEDAGEFLLEQFQTTQSCLFIVNTKKWAQQLYQYCEQQNVPPEALFHLSTHQCAAHRKAIFERIKGRLKNGEPVICISTQLIEAGVDISMKCVIRALGGLDSIAQAAGRCNRHGEKDSKGQVYVLNLQEPDFQKVLPDIQEGKSNAGHVFRDFAGQDILQPAAMQRYFQYYFYNRSGEMIYPVKNSATGSLFDWLSDNQNNPYGNKNNKKTKAFPLLMQSFKSAGRAFHVIDAPTRAVIVPYGEGKALIGKLCGEWNPAEMRRALQKSQRYSVNVFPNVWDKLQKDQAVHETIEGSGIYYLNERYYNDAFGLSLDETSNMTFYDL

SEQ ID NO: 12533 - protein, 595 aa, Aggregatibacter actinomycetemcomitans serotype d str. I63B
MPPLKADAHHPFFSYAFFTRMLYSCLVDVDYLDTEAYYAGVENQPVIRDGYPDLNALQQAFNRFIDGFRRRPTQSAQQTEAEQRNVALNRLRSEILDHAVAQASEPPGLFTLTVPTGGGKTFTSMAFALEHAKRYGMRRVIYVIPFTSIIEQNAAEFRKAFGEWGEAAVLEHHSTFDDGKLQNIDTKDKLRRASENWDVPVVVSTAVQFFESLFADRSSRCRKLHNIAGSVIILDEAQMLPPALLLPIMQAIKELAQNYRCSVVMCTATQPAVQAENGFYRGFENVREIAPKPTALFARLRRTTVQHIGTQTDADLLAKLAEHPQMLVIVNNRRHARSLYDAAQHLDGIFHLTTLMCAKHRSQQLDKIRGRLKNGEPCRVIATSLIEAGVDVDFPLVMRAEAGLDSVAQTAGCCNREGKRLPENSHVWIFAPEDQWQAPPELATQAAAMRLTAGEFSDDLLSTQAIAAYFKELYDLKGSELDKKQILPMHNKAGPSLDFPFQKIAEAFRMLESHMQPLIIPFDSEAEALIDHLRYADQIGGLLRKFQPYTVQIPEKALAALYKAGRIEPLNEKTFGKQFYALIGLDLYDDVAGLS

SEQ ID NO: 12534 - protein, 595 aa, Aggregatibacter actinomycetemcomitans serotype e str. SCC393
MPPLKADAHHPFFSYAFFTRMLYSCLVDVDYLDTEAYYAGVENQPVIRDGYPDLNALQQAFNRFIDGFRRRPTQSAQQTEAEQRNVALNRLRSEILDHAVAQASEPPGLFTLTVPTGGGKTFTSMAFALEHAKRYGMRRVIYVIPFTSIIEQNAAEFRKAFGEWGEAAVLEHHSTFDDGKLQNIDTKDKLRRASENWDVPVVVSTAVQFFESLFADRSSRCRKLHNIAGSVIILDEAQMLPPALLLPIMQAIKELAQNYRCSVVMCTATQPAVQAENGFYRGFENVREIAPKPTALFARLRRTTVQHIGTQTDADLLAKLAEHPQMLVIVNNRRHARSLYDAAQHLDGIFHLTTLMCAKHRSQQLDKIRGRLKNGEPCRVIATSLIEAGVDVDFPLVMRAEAGLDSVAQTAGRCNREGKRLPENSHVWILAPEDQWQAPPELATQAAAMRLTAGEFSDDLLSTQAIAAYFKELYDLKGSELDKKQILPMHNKAGPSLDFPFQKIAEAFRMIESHMQPLIIPFDSEAEALIDHLRYADQIGGLLRKFQPYTVQIPEKALAALYKAGRIEPLNEKTFGKQFYALIGLDLYDDVAGLS

SEQ ID NO: 12535 - protein, 595 aa, Aggregatibacter actinomycetemcomitans serotype f str. D18P1
MPPLKADAHHPFFSYAFFTRMLYSCLVDVDYLDTEAYYAGVENQPVIRDGYPDLNALQQAFNRFIDGFRRRPTQSAQQTEAEQRNVALNRLRSEILDHAVAQASEPPGLFTLTVPTGGGKTFTSMAFALEHAKRYGMRRVIYVIPFTSIIEQNAAEFRKAFGEWGEAAVLEHHSTFDDGKLQNIDTKDKLRRASENWDVPVVVSTAVQFFESLFADRSSRCRKLHNIAGSVIILDEAQMLPPALLLPIMQAIKELAQNYRCSVVMCTATQPAVQAENGFYRGFENVREIAPKPTALFARLRRTTVQHIGTQTDADLLAKLAEHPQMLVIVNNRRHARSLYDAAQHLDGIFHLTTLMCAKHRSQQLDKIRGRLKNGEPCRVIATSLIEAGVDVDFPLVMRAEAGLDSVAQTAGRCNREGKRLPENSHVWIFAPEDQWQAPPELATQAAAMRLTAGEFSDDLLSTQAIAAYFKELYDLKGSELDKKQILPMHNKAGPSLDFPFQKIAEAFRMIESHMQPLIIPFDSEAEALIDHLRYADQIGGLLRKFQPYTVQIPEKALAALYKAGRIEPLNEKTFGKQFYALIGLDLYDDVAGLS

SEQ ID NO: 12536 - protein, 821 aa, Aggregatibacter actinomycetemcomitans serotype f str. D18P1
MSRNAIAHVRQSDGLRQLLIDHLFETSSIAGQLASKLNLSLAGELLGLLHDFGKYSLSFQDYIKAATGIDPNADDYVLPGGRKIDHSTAGAQWVYRALRKYGVAQGIGELFGQMLGLCIASHHGEGLIDCLDESGNAVWKKRFEKEDELTHLAECSRNADAQVLQRAQTLAGEELVRELLNAVKPILSDKTIPQKKQEFYLGCLTRFLFSCLIDADRINSSDFEKAHQKDVRRLVEKPDWQDAIEKLENHLAQFAIRYPIDQIRRNISDDCLKRAVDFQGVYTLTVPTGGGKTLASLRYALHHAKKHDLDRIIYIIPYTSIIDQNAAAVREILGEDWVLEHHSNLEPEQQSWQDKLLSENWDKPIVFTTMVQFLDAWFGGGTRGARHIHPMTNSVLIFDEIQTLPVKCVHLFCNVLNWLTQFGKSTAILCTATQPLLGEAGLNHFPENEREKIIRRGLIKLPENAEIMGDHQDLDNLFNALSRVEIQFKEKAGGWTAEDAGEFLLEQFQTTQSCLFIVNTKKWAQQLYQYCEQQNVPPEALFHLSTHQCAAHRKAIFERIKGRLKNGEPVICISTQLIEAGVDISMKCVIRALGGLDSIAQAAGRCNRHGEKDSKGQVYVLNLQEPDFQKVLPDIQEGKSNAGHVFRDFAGQDILQPAAMQRYFQYYFYNRSGEMIYPVKNSATGSLFDWLSDNQNNPYGNKNNKKTKAFPLLMQSFKSAGRAFHVIDAPTRAVIVPYGEGKALIGKLCGEWNPAEMRRALQKAQRYSVNVFPNVWDKLQKDQAVHETIEGSGIYYLNERYYNDAFGLSLDETSNMTFYDL

SEQ ID NO: 12537 - protein, 567 aa, Aggregatibacter actinomycetemcomitans serotype a str. H5P1
MLITSTPKYYAGVENQPVIRDGYPDLNALQQAFNRFIDGFRRRPTQSAQQTEAEQRNVALNRLRSEILDHAVAQASEPPGLFTLTVPTGGGKTFTSMAFALEHAKRYGMRRVIYVIPFTSIIEQNAAEFRKAFGEWGEAAVLEHHSTFDDGKLQNIDTKDKLRRASENWDVPVVVSTAVQFFESLFADRSSRCRKLHNIAGSVIILDEAQMLPPALLLPIMQAIKELAQNYRCSVVMCTATQPAVQAENGFYRGFENVREIAPKPTALFARLRRTTVQHIGTQTDADLLAKLAEHPQMLVIVNNRRHARSLYDAAQHLDGIFHLTTLMCAKHRSQQLDKIRGRLKNGEPCRVIATSLIEAGVDVDFPLVMRAEAGLDSVAQTAGRCNREGKRLPENSHVWIFAPEDQWQAPPELATQAAAMRLTAGEFSDDLLSTQAIAAYFKELYDLKGSELDKKQILPMHNKAGPSLDFPFQKIAEAFRMLESHMQPLIIPFDSEAEALIDHLRYADQIGGLLRKFQPYTVQIPEKALAALYKAGRIEPLNEKTFGKQFYALIGLDLYDDVAGLS

SEQ ID NO: 12538 - protein, 522 aa, Aggregatibacter actinomycetemcomitans serotype c str. SCC2302
MLNQERSAILAQCFSAAESDRTLFSLTVPTGGGKTLASLGFALKHALKFGKKRIIYAIPFTSIIEQNADVFRKALGDDAVLEHHSNLEVKEDKETAKTRLAAENWDAPLIVTTNVQLFESLFAARTSRCRKIHNIADSVIILDEVQQLPRDFQKPITDMMRILACDYGVTFVLCTATQPELGKNIDAFGRTVLEGLPDVREIVADKIALSERLRRVRIKMPPPNDETQSWQEIADEIAERPCVLAVVNTRKHARRLFAALPSNGIKLHLSANMCATHRSEVIALVRRYLELYREGRLKKPLWVVSTQLIEAGVDLDFPCVYRAMAGLDSIAQAAGRCNREGKLPDLGEVIVFRAEQGAPSGSLKQGQDITEEMLKAGLLADPLSPLAFAEYFRRFNSKGDLDKHKITELLTAEFSNDNPLAIKFRTAAERFRLIDNQGVALIVPFIPLIHENGDKSPKIVQANELDDFFRRHLDGVVESDWQKTLDDYRYPSPPDNHFGQTDKPSSAFSSSLKWQGNSRQPK

SEQ ID NO: 12539 - protein, 832 aa, Aggregatibacter actinomycetemcomitans serotype b str. SCC1398
MSEVIAHARQDSKWHFHPLQNHLKKVAKLARRFAGRYGALFAEYAGLLHDLGKFQEAFQEYIRRVTGFERENAHLEDIESSKPHKIPHSTAGAKYATQNLDPFLGHLLAYLIAGHHAGLADWYDKGSLKYRLAQADDELAESLAGLEKSGLVEDFLSLSGDALEEDLLNVWESGINLEELHIWMRFLFSCLVDADFLDTEAFMNGFVDADAAQQAGFRPNFPDLEDMHSRYEKHMLDLAEKSDKHSVLNQERSAILAQCFSAAESDRTLFSLTVPTGGGKTLASLGFALKHALKFGKKRIIYAIPFTSIIEQNADFFRKALGDDAVLEHHSNLEVKEDKETAKTRLAAENWDAPLIVTTNVQLFESLFAARTSRCRKIHNIADSVIILDEVQQLPRDFQKPITDMMRILACDYGVTFVLCTATQPELGKNIDAFGRTVLEGLPDVREIVADKIALSERLRRVRIKMPPPNDETQSWQEIADEIAERPCVLAVVNTRKHARRLFAALPSNGIKLHLSANMCATHRSEVIALVRRYLELYREGRLKKPLWVVSTQLIEAGVDLDFPCVYRAMAGLDSIAQAAGRCNREGKLPDLGEVIVFRAEQGAPSGSLKQGQDITEEMLKAGLLADPLSPLAFAEYFRRFNSKGDLDKHKITELLTAEFSNDNPLAIKFRTAAERFRLIDNQGVALIVPFIPLIHENGDKSPKIVQANELDDFFRRHLDGVVESDWQKTLDDYRYPSPPDNHFGQTDKPPLPEPFEMWFKLLEADPLKNKWVYRKLQRYTITVYETELKKLYKDAVFSRAGLLVLDNGHYHDVLGADFDDDTVVPPEESVL

SEQ ID NO: 12540 - protein, 595 aa, Neisseria shayeganii 871
MAFFTRMLYSCLVDADYLDTEAFYAGLEGKTVQRGGHPDLLQLQQRFNRFLGDFRRHIAEKPQQTEEDKRNAALNRLRSDILDHAVIQAAQEKGLFTLTVPTGGGKTFTSMAFALEHAKRHGMRRVIYVIPFTSIIEQNAAEFRKAFGDLGKDAVLEHHSTFDDSKLKDQHSKDKLRQASENWDMPVIVTTAVQFFESLFADRSSRCRKLHNISGSVIILDEAQMLPLKLLLPIMQAVKELARNYHCSVVMCTATQPAIQAEHGFYRGLENTRELAPNPPELFDKLRRTTVQHIGTQTDADLLEKLGQYPQILIIVNNRRHARSLYDSAKQLDGVFHLTTLMCAKHRSQVLETIRDRLKNGQPCRVIATSLIEAGVDVDFPLVMRAEAGLDSVAQAAGRCNREGKRLPEESFVWVFAPEARWKAPAELGLLSAAMREVVRHHAEDLLSPQAIRRYFQYVYAEKGKELDGKGILDMHKKAGNSLNFPFQTIAREFRMIETHMQPLIIPFDQEAERLIDSLRHADQIGGLLRKLQPYTVQIPENTLQALFKAGQIETVNEKQFGKQFYSLIGLDLYDEVAGLWWEDVFFLEAEKSVL

SEQ ID NO: 12541 - protein, 833 aa, Neisseria sp. GT4A_CT1
MNFDYIAHVRQDSSENWHSHPLQKHLQKVAQLAKRFAGRYGSLFAEYAGLSHDLGKFQEAFQKYIRNASGFEKENAHLEDVESTKLRKIPHSTAGAKYAVEHLNPFFGHLLAYLIAGHHAGLADWYDKGSLKHRLQQADNELEASLLGLAESGLPKDFFPLSDDDLMRDFFAFWEDGAKLEEVHIWLRFLFSCLVDADFLDTEAFMNGYADADTAQAAGLRPKFPGLDELHRRYEQYMAQLHEKSDKDSFLNQKRHAILQQCFSAAETDHTLFSLTVPTGGGKTLASLGFALKHALKFGKKRIIYAIPFTSIIEQNADVFRKALGDDVVLEHHSNLEVKEDKETAKTRLATENWDAPLIVTTNVQLFESLFAAKTSRCRKIHNIADSVVILDEAQQLPRDFQKPITDMMRVLAHDYGVTFVLCTATQPELGKNIDAFGRTILEGLPDVREIVADKIALSEKLRRVRIKMPPPNGDTQSWQEIADEIAAHPCVLAVVNTRKHAQKLFAALPSDGIKLHLSANMCATHRSEVIALVRRYLALYRAGSLHKPLWLVSTQLIEAGVDLDFPCVYRAMAGLDSIAQAAGRCNREGKLSFGEVVVFRAEEGAPNGSLKQGQDITEEMLKAGLLGDPLSPSAFAEYFRRFNGKGDVDKHDIARLLTVESSNENPLAIKFRTAAERFRLIDNQGVALIVPFIPLAHWEKDGSPQVVKANELDDFFRRHLDDVEVSKWQDILDEQRFLQPADNSFGQTDQPPLPEPFESWFNLLESDPLKHKCVYRKLQRYTITVYEHELKKLSANAVFSRAGLLVLDKGYYKAVLGADFDDTAWLSENSVL

SEQ ID NO: 12542 - protein, 821 aa, Aggregatibacter actinomycetemcomitans D17P-3
MSRNAIAHVRQSDGLRQLLIDHLFETSSIAGQLASKLNLSLAGELLGLLHDFGKYSLSFQDYIKAATGIDPNADDYVLPGGRKIDHSTAGAQWVYRALRKYGVAQGIGELFGQMLGLCIASHHGEGLIDCLDESGNAVWKKRFEKEDELTHLAECSRNADAQVLQRAQTLAGEELVRELLNAVKPILSDKTISQKKQEFYLGCLTRFLFSCLIDADRINSSDFEKAHQKDVRRLVEKPDWQDAIEKLENHLAQFAIRYPIDQIRRNISDDCLKRAVDFQGVYTLTVPTGGGKTLASLRYALHHAKKHDLDRIIYIIPYTSIIDQNAAAVREILGEDWVLEHHSNLEPEQQSWQDKLLSENWDKPIVFTTMVQFLDAWFGGGTRGARHIHPMTNSVLIFDEIQTLPVKCVHLFCNVLNWLTQFGKSTAILCTATQPLLGEAGLNHFPENEREKIIRRGLIKLPENAEIMGDHQDLDNLFNALSRVEIQFKEKAGGWTAEDAGEFLLEQFQTTQSCLFIVNTKKWAQQLYQYCEQQNVPPEALFHLSTHQCAAHRKAIFERIKGRLKNGEPVICISTQLIEAGVDISMKCVIRALGGLDSIAQAAGRCNRHGEKDSKGQVYVLNLQEPDFQKVLPDIQEGKSNAGHVFRDFAGQDILQPAAMQRYFQYYFYNRSGEMIYPVKNSATGSLFDWLSDNQNNPYGNKNNKKTKAFPLLMQSFKSAGRAFHVIDAPTRAVIVPYGEGKALIGKLCGEWNPAEMRRALQKSQRYSVNVFPNVWDKLQKDQAVHETIEGSGIYYLNERYYNDAFGLSLDETSNMTFYDL

SEQ ID NO: 12543 - protein, 567 aa, Aggregatibacter actinomycetemcomitans D17P-3; identical to SEQ ID NO: 12537

SEQ ID NO: 12544 - protein, 674 aa, Aggregatibacter actinomycetemcomitans serotype c str. D17P-2
MQRKILILYLGHLLAYLIAGHHAGLADWYDKGSLKYRLAQADDELAESLAGLEKSGLVEDFLSLSGDALEEDLLNVWESGINLEELHIWMRFLFSCLVDADFLDTEAFMNGFVDADAAQQAGFRPNFPDLEDMHSRYEKHMLDLAEKSDKHSVLNQERSAILAQCFSAAESDRTLFSLTVPTGGGKTLASLGFALKHALKFGKKRIIYAIPFTSIIEQNADVFRKALGDDAVLEHHSNLEVKEDKETAKTRLAAENWDAPLIVTTNVQLFESLFAARTSRCRKIHNIADSVIILDEVQQLPRDFQKPITDMMRILACDYGVTFVLCTATQPELGKNIDAFGRTVLEGLPDVREIVADKIALSERLRRVRIKMPPPNDETQSWQEIADEIAERPCVLAVVNTRKHARRLFAALPSNGIKLHLSANMCATHRSEVIALVRRYLELYREGRLKKPLWVVSTQLIEAGVDLDFPCVYRAMAGLDSIAQAAGRCNREGKLPDLGEVIVFRAEQGAPSGSLKQGQDITEEMLKAGLLADPLSPLAFAEYFRRFNSKGDLDKHKITELLTAEFSNDNPLAIKFRTAAERFRLIDNQGVALIVPFIPLIHENGDKSPKIVQANELDDFFRRHLDGVVESDWQKTLDDYRYPSPPDNHFGQTDKPSSAFSSSLKWQGNSRQPK

SEQ ID NO: 12545 - protein, 634 aa, Peptoniphilus indolicus ATCC 29427
MEEYRDDFVYDKFKFPQKIVLNSNYIQLSKITEKEELYYEYILLKGLLNKIDYAASAYIDSSQRYLDVDRKNDFLEIALSNFMNKLSVKLKKIGKDAPDWNELQRYMMNNQDKNLVIIAQTGMGKTEAGLWWLGNNKGFFTLPIRTAINAIYNRIKDDLLDGENFDEKVGVLHSGTKSIYLEELDSGKINNLDEYFSSTKQLSLPLTICTLDQLFTFVFLHRNFESKLATLSYSKIIIDEIQMYSADLVGYLIRGLKMIQDVGGKYAILTATFPGFLKKLMKREGLKFDMPDKAFVNDRIRHSVSVVREQLTANDVIEKYTDNRVLVICNTVKKCQEMYQDLQKLIEENELGIKLNMLHGKYIKMHKEKKSKEIIDFGKLFDDEGNPNKKKGIWITSSIAEASLDIDFDVLLTELSEISSLLQRFGRCYRNREWIGEGYNCYVYDGGDRATSGIVSIIDRDLFDLSKKYIREFFDNNSSELRELDKMKLVEETLSSENVKETKYYKEIEKTIEYTKNLFHAEFSKEEAQKLFRNIMSETIMPRPVYENNLRDINEILNIIKSNEYTQYDKLREREKLMGYTLDIESRALINMDYCEIEISKYQKLKVVECDYDYELGFRRKEKEKSENLYDNFF

SEQ ID NO: 12546 - protein, 793 aa, Thiorhodospira sibirica ATCC 700588
MSTPAPLPFYKCQAHPGDALNQHLLRVAQRAAASIAPTARPEIARIAFIAGLFHDLGKATPWFQQYLNGQARRSALTHHGELGAILSWWYSAQLDGPLWQRLAVFSAVRRHHGALRIQNWPDLFAQTRSEFREPDSPLRTQLAALDSPGIANWLSEQATAHPQYGLPVHCEPPSLEHIEARVYERDCVGSKLRRAYTSLDEALATLSAFGALLAVDKTDAALSGAHIARQALPADAVSHYKRQVFPAEASSSPLNQRREHIAKTLTTTWLAHLEQPLLTFTAPTGAGKTLSVLHAALQVRTHLAKQHGHAPRLIYCLPFTAVIDQNHAVIRAILKASGLAEREDILLKHHHLSTGVFRTGDDAAEHQPDGAGQLLTETWQSEIIVTTFHQLLHSLLSPCNANLKRAGQLSGAILVLDEVQALPLRYWEALRQLFKALARTAGTRILLMTATRPLIFQPGDALELLPDHAQHFQALNRTRLHLQHHNPLPLTAFAGQLIAHLHNNPRPTLIIVNRRKAVSTLFHELTRAFPQRPCVALSTHLTPRDRRARIRLIQRLQRQGQPVIVISTQLIEAGVDLSFPVVHRDLAPLDALIQSAGRCNRHGEQAKALGEVYLWQLATDPSETQTSEPLWRRIYDAALIEVTCEILGHAAYWDERDFLELSARYFSGCRARQDQQRLDEQLKNGDLAGIERDFQLIEETPSLTLFIHRTPKDQALWQIYRDIQDNPALSPAQQERALRPYRAAFRERIIQIHANTTTGLDRDTVNRLDATPETYHRSTGFIKTPGVDATCIL

SEQ ID NO: 12547 - protein, 758 aa, Neisseria wadsworthii 9715
MVGKTKTYYAHSAENRPEQYWQTLLGHLANVGDTAARFATFFGAQEMARYTGCLHDLGKYSPEFDRRLRGGPSVDHATAGAKIAFERWGLPGKLMAFCIAGHHAGLANGDGEGDNRRTLRQRLALQFGKDIPNLDEVWRQQIALPEKLPAPPLQADKHHPFFSYAFFTRMLYSCLVDADYLDTEAFYAGLEGKTVQRRDYPDLPQLQQQFNRFIGNFRRPIANAAQESEEQQHNADLNRLRSEILDHAVAQAAQTKGLFTLTVPTGGGKTFTSMAFALEHAKRHGMRRVIYVIPFTNIIEQNAAEFRKAFGDLGEAAVLEHHSTFDSSKLQGENSKDKLRQASENWDMPVVVTTAVQFFESLFADRSSRCRKLHNISGSVIILDEAQMLPLKLLLPIMLAIKELAQNYHCSVVMCTATQPAIQAEHGFYRGLENTRELAPNPPELFDKLRRTTVQHIGTQTDAELLEKLAQHRQILIIVNNRRHARSLYDSAKHLDGVSHLTTLMCAKHRSQALETIRGRLKNSKPCRVIATSLIEAGVDVDFPLVMRAEAGLDSVAQAAGRCNREGKRPSENSFVWVFKPEEQWKAPPELGLLSAAMREVVRHHADDLLSPQAIRRYFRRVYEEKGKELDSKQILAEHHKAGNTMDFPFQTIAREFRMIETRMQPLIIPFDAEAEALIDSLHHADQIGGLLRKLQPYTVQVPEYAMRELFKNGLIEAINDERFGAQFYSLIGLGLYDKVAGLSWENSIFIAAEESIF

SEQ ID NO: 12548 - protein, 751 aa, Thiorhodospira sibirica ATCC 700588
MTVYFAHSTQTDDKADWQRLSEHLITTSKRAGEFAQPFGAEEFASVAGLLHDLGKYTQTFQERLKGGKLRVDHATRGAMLAVEKFDQLGYLLAYGIAGHHAGLANGREGGERTALSDRLKGTGLPPLHDAWQGEISLPSKLPWPPLDIHKERGNFQLTFFVRMLFSCLVDADYLDTEAFYDRIASPEQTRQRSTARALESPSLEVLREQLNSYLCGFSADTHVNRVRAEILSHTRNAAPQPPGLFSLTVPTGGGKTLASLAFALDHAIEHGLRRVIFVIPFTSIVEQNAAVFRAALGKYGEAAVLEHHSAFVTAQPAHAEAERYQSREKLRLAMENWDAPIIVTTAVQFFESLFAARPSQCRKLHNIAGSVVILDEAQTLPLKVLRPTVAAIDELARNYRSSIVLCTATQPALNAPEFAGGLENVRELAPKPAQLFRTLERVRVRHVGTLEDDALTAQLRALDRVLCIVNNRRHARAVYQSLADLPGSRHLTTLMCAKHRSEVLAEVRARLKADKPCRLVSTSLIEAGVDISLPTVYRAEAGLDSIAQAAGRCNRNGERAAELSEVRVFATANSDWAPPPELRQFAEKAREIMRQPQFRDDPLSPPAIEAYFRLLYWQKGDKELDAANLLGLCAGSPIDTLPLETLAAKFRIIETVQMPVIVPFNDEARQLINSLRHAQSSGSLARKLQLYLVQLPRDKFDALRKAGAVQPIAPEKWGEQFMELVNQDLYNQQFGLSWDDPAFVKTEQLLW

SEQ ID NO: 12549 - protein, 894 aa, Synechococcus sp. WH 8016
MTFQTKLIGKLNKDFEYDTVLQHCINAANMAYHRVINLDDRRLNHLANPIGVSTQSCAQLIAIIAGSHDIAKMDIAFQTQRGIYDAYQQINDCHFPSEIVGAVQAFKEQQSGMKLNPLHHGPMAAVILPRLFSEEFGVDQSTAVMMAHCVTAHHGLYPSRERVKNLNDYFSQLEIHEPYREFEAQRLDLLHQLRQEIDPDKTMEIPDAIPVAWSLLVAGLVINADHNASREANFRLINGEQKPAGLSSDEASSVIHRYGIQKPQEIINKTLNGFDIIARPHQEKLEQLGKQDGMTVLKMPTGSGKTIAAFISAIYHVCGFSLLANRRSTANGMFYALLSFLKRNPDATQSIPALAHSDAGCIFESAMESVLADPEAYRDIDCFTDVWKAALALQGESLQDCLSAQYSVATIDQALMSVIADGKFVGRGYWLFSRPIIIDEIHSYDGRMDCILERLLYYCGFFGTPVIALTATISTNKLTKFLEAYAEGQQTKLSSDLELTEHAQAIILSPSGELRQEDLPCDVHDAKQVEVKWFEHGTWFETIKQLAADNDRIAVVCATTTHVRELTSQVRAKLASVGFHVMSYHSRHRPKDRNAKEKTLFEYCGKDPSMQGKIIVIATQVLRESLDVDFDVVVTHVQPAEDLIQIMGRVGRFNRSNKMPTYELYLEEPCITEDDKFSIGQADFVLLPKRIQGFRGVPVLQTYAYLKQDSILLLPQQAQLFVDTAHQMPSNLKDAPVPKGLPVIYHRFWQAFVDKQALVPRAERSQAEEFVIPKLPDPMDTSVPIDGLSGLTRFKEQYISHSPRDINWTIQIFVRPANYKDDFLYKSNFLLYVKNHSVSVSNRPHFWQQAQGSVMKPDHPVLGNVVDMTEGSIKMIGPYEIVYTIDGLGIRYIR

SEQ ID NO: 12550 - protein, 728 aa, Paenibacillus lactis 154
MSAANPFSRLAPFIQEFIYKKRWDTLREAQVEACRVLFDTPNHLLIASGTASGKTEAAFFPALTELYNRPSSSVGILYIGPLKALINDQFERISDLLKEGQVPVWHWHGDVSQAEKTKLMRKPSGVLQITPESLEGLLMNRPNAIPALFQDLRYVIIDEVHAFMGADRGIQVLSQLTRIERMASCEPRRIGLSATLSDYETAAGWLGAGTQHAVEVIAPQGGRKLRLSVEHFSFPDARDEKQAEQLELARKAYYDFVYDHTHMKKALVFTNSRSDAELTTLELRRIAAKRQQPDVFHVHHGSISAMLREEAEAALRSGPGPAVAAATLTLELGIDLGELERVIQLGAPYSCSSFVQRLGRSGRRGDQASEMMFLCPEDEDEEALLPARMPWMLLRAIAVIELYIREKWVEPLTLRKKPVGVLYHQTMSTLKSMGEAEPQDLARAVLTLPAFRGIEPEEYKEFLQYLLQTDHIQRTEEGSLIIGLGGEKIVNNYRFYAVFKDDEEHVVYNGSEEIGSITTVPPPGYCFSLAGKLWKVEEVDTKHKALYVKAAKGKVDTLWLGAGGDVHTRVVQKMREVLADSTIYPYLAPGAVNRLERARRLARESGLLKQVVIPAGGDSLFILPWAGSKQFRTLERLLKHNLSEPLSLRSIVPMEPYYMIVAGKADAGTLLEEIRRELAECSDASSLLDPDEAPYLGKYDEFVPPKLVRTAFAADGLDVHGLAELLRS

SEQ ID NO: 12551 - protein, 808 aa, Paenibacillus lactis 154
MTYIAHIRQSDGKIQTVDEHLREVKELSERHGAKIGAAHLAGLAGLLHDMGKYTTEFKNYIEEAVAHPEAPPRKGSVDHSTAGGRLVYERYHRTASTAIDKFAAEWIANCVISHHQGLRDFVEPNASSPFLERVEKKALNEYEQAKQRFFEAVAEEEIDACFEGAKKELARYLSKIKERKLLPIAASLLLKYIFSCLIDADRTNTRRFDENEEPEEPLNRQAFFARSYKSLLCKLQVLEQGMDSDHPINRLRREMSQRCDEFAERASGIYTLSIPTGGGKTLASLRYALKHARIHGKDRIIYVVPYTTIIEQNAAEIREILQEDEWILEHHSNVIEHEDDLETEDYDVHRKKIRNARDSWDSPIIFTTMVQFLNTFYAKGTRNVRRLHRLSNAVIIFDEVQSVPVNCISIFNAALNFLNILGRSSLLLCTATQPALDFVKHKLHISKEAEIIEDLEQVADNFKRVELVSAVTPLGWGAEELTDFVRSRLDEIRSVLVILNTKTAVRKLYDQLSQSEWMKERGVKLFHLSTNMCAAHRKEVLSKVIDSLEAQEPVICVSTQLIEAGVNISFDCVIRSLAGLDSIAQAAGRCNRHGKAPIRKVYIIKSADEKLTSLPEIRIGAEKTERVLRDFEQNPARFGSDLLSPAAMKTYFSYYYKHVQGEMDFPILRLGRNMFDLLSANKAYVDNYKYKHGKHLESVNRASFATAELYFEAISNTATSVVVPYNEEAESLIAALNGKVDAGELGSLFRRLQPYIVNVYDQDLKKLDNIGYVQHLLQGHVLTLLKPAYSDEFGVDAEGEGAWDEAIL

SEQ ID NO: 12552 - protein, 763 aa, Aggregatibacter aphrophilus F0387
MPQSVIRYAHSAQDELGNLLPYEHWQTLQSHSVNVGEMAAEFARMFGAQEIACQTGQLHDLGKYSEAFNRRLHGGSSVDHATAGAKIAVERWGNVIGKLMAFCIAGHHAGLANGSAEGDNRSTLKQRLALQFGADIPVLDNLWQQEIKLPETLSVPPLKADAHHPFFSYAFFTRMLYSCLVDADYLDTEAFYLNLENKAAERGGYPDLNALQHNFNRFINAFRRRIAQAPEQTEAEKRNAALNRLRSEILDYAVEQAAQPQGLFTLTVPTGGGKTFTSMAFALEHAKQHGMRRVIYVIPFTSIIEQNAAEFRKAFGELGEQAVLEHHSTFDDGKLQGEATKDKLRLASENWDAPVVVTTAVQFFESLFADRSSRCRKLHNIAGSVIILDEAQMLPLNLLLPIMQAIKELAQNYRCSIVMCTATQPAVQAENGFYRGFENAREIAPKPTALFDKLRRTIVHHIGTQTDSDLLAKLGEHPQMLVIVNNRRHALSLYDQAKHLDGTFHLTTLMCAKHRSQKLDEIRGRLKKGEPCRVIATSLIEAGVDVDFPLVMRAEAGLDSVAQAAGRCNREGKRLPENSFVWIFAPEEQWKSPPELATQAAVMRLTADSFSDDLLSTQAVAVYFAELYQLKGSELDNKKILKTHNDTGQSLDFPFQTIADKFRMIESHMQPLIIPFDVDAESLISSLHHADHIGGLLRKLQPYTVQIPEKALAALYKAGRIEPINEKNFGKQFYTLIGLDLYDEVAGLSWEDNVFIKAENSVF

SEQ ID NO: 12553 - protein, 658 aa, Salmonella enterica subsp. enterica serovar Alachua str. R6-377
MPVDTYWQQALAKAQTAITLFPSAANVSAFTGIETLFPFIQHPTPLQQKALELDINVDGAQLFILEDVTGAGKTEAALILAHRLMAAGKAQGLYFGLPTMATANAMFERMANTWLALYQPDSRPSLILAHSARRLMDRFNQSIWSVTLSGTEEPDEAQPYSQGCAAWFADSNKKALLAEVGVGTLDQAMMAVMPFKHNNLRLLGLSNKILLADEIHACDAWMSRILEGLIERQASNGNATILLSATLSQQQRDKLVAAFSRGVRRSVQAPLLGHDDYPWLTQVTQTELISQRVDTRKEVERCVDIGWLHSEEACLERIGEAVEKGNCIAWIRNSVDDAIRIYRQLQLSKVVATENLLLFHSRFAFHDRQRIESQTLNLFGKQSGAQRAGKVIIATQVIEQSLDIDCDEMISDLAPVDLLIQRAGRLQRHIRDRNGLVKKSGQDERETPVLRILAPEWDDAPRENWLSSAMRNSAYVYPDHGRMWLTQRILREQGTIRMPQSARLLIESVYGEDVNMPVGFAKTEQLQEGKVYCDRAFAYQMLLNFAPGYCAEISDSLPEKMSTRLAEESVTLWLAKIVDSVVTPYASGEHAWEMSVLRVRQSWWNKHKDEFEKLDGEPLRKWCAQQHQDKDFATVIVVTDFAACGYSANEGLIGMMGE

SEQ ID NO: 12554 - protein, 574 aa, Salmonella enterica subsp. enterica serovar Montevideo str. S5-403
MAAGKAQGLYFGLPTMATANAMFERMANTWLALYLPDSRPSLILAHSARRLMDRFNQSIWSVTLSGTEEPDEAQPDSQGCAAWFADSNKKALLAEVGVGTLDQAMMAVMPFKHNNLRLLGLSNKILLADEIHACDAWMSRILEGLIERQASNGNATILLSATLSQQQRDKLVAAFSRGVRRSVQAPLLGHDDYPWLTQVTQTELISQRVDTRKEVERSVDIGWLHSEEACLERIGEAVEKGNCIAWIRNSVDDAIRIYRQLQLSKVVATENLLLFHSRFAFHDRQRIESQTLNLFGKQSGAQRAGKVIIATQVIEQSLDIDCDEMISDLAPVDLLIQRAGRLQRHIRDRNGLVKKSGQDERETPVLRILAPEWDDAPRENWLSSAMRNSAYVYPDHGRMWLTQRILREQGTIRMPQSARLLIESVYGEDVNMPVGFAKTEQLQKGKFYCDRAFARQMLLNFAPGYCAEISDSLPEKMSTRLAEESVTLWLAKIVDGVVTPYASGEHAWEMSVLRVRQSWWDKHKGEFERLDGEPLRKWCAQQHQDKDFATVIVVTDFAVCGYSANEGLIGMMGE

SEQ ID NO: 12555 - protein, 658 aa, Salmonella enterica subsp. enterica serovar Wandsworth str. A4-580
MPVDTYWQQALAKAQTAITLFPSAANVSAFTGIETLFPFIQHPTPLQQKALELDINVDGAQLFILEDVTGAGKTEAALILAHRLMAAGKAQGLYFGLPTMATANAMFERMANTWLALYQPDSRPSLILAHSARRLMDRFNQSIWSVTLSGTEEPDEAQPYSQGCAAWFADSNKKALLAEVGVGTLDQAMMAVMPFKHNNLRLLGLSNKILLADEIHACDAWMSRILEGLIERQASNGNATILLSATLSQQQRDKLVAAFSRGVRRSVQAPLLGHDDYPWLTQVTQTELISQRVDTRKEVERCVDIGWLHSEEACLERIGEAVEKGNCIAWIRNSVDDAIRIYRQLQLSKVVATENLLLFHSRFAFHDRQRIESQTLNLFGKQSGAQRAGKVIIATQVIEQSLDIDCDEMISDLAPVDLLIQRAGRLQRHIRDRNGLVKKSGQDERETPVLRILAPEWDDAPRENWLSSAMRNSAYVYPDHGRMWLTQRILREQGTIRMPQSARLLIESVYGEDVNMPVGFAKTEQLQEGKVHCDRAFAYQMLLNFAPGYCAEISDSLPEKMSTRLAEESVTLWLAKIVDGVVTPYASGEHAWEMSVLRVRQSWWNKHKDEFEKLDGEPLRKWCAQQHQDKDFATVIVVTDCAACGYSANEGLIGMMGE

SEQ ID NO: 12556 - protein, 718 aa, Clostridium  citroniae WAL-17108
MKYLAHISEDKQREQSIKSHLEGTALLAKEFAEEFGYGEWGYFCGMLHDIGKYSTKFQGRIMGSGEKADHATAGAQLCLRLGKEKGSYYVAPAYCIAGHHAGLPDTGTSADTGDRGTFAGRMKKRVEDYGAYQEEISIPPLPPPVLSAAEKKDLTFSMSFLIRMLYSCLVDADYLNTEDFMKDGETSRITGETIPVLLEKLNRHIAKWLVNDDQDTINERRTEILKSCIEKGKKKKGLFRLTVPTGGGKTVASLAFALNHAAEHGMKRIIYVIPYTSIIEQNAKVFSHILGEENVLEHHSGIDYESTDELKLKQLAAENWDLPIVVTTNVQFFESLFSNKSSKCRKLHNIANSIIIFDEAQMLPNDYLRPCIASMEELIRHYESSIVLCTATQPSLQNFFPKDMQYTELCPRMEEQFRFFKRAIFKNLGKITEDELLDRVRNEEQALCILNTKNNVQKLYEKIKGEGVYHLSTFMYPRHRQERMETIRERLAAGEKCIVIATSLVEAGVDLDFQTVYRELAGVDSMIQAAGRCNREGKRDALGSFACYFQLEESRTVPGQEQQIDTAKQVIRRYEDIGSLDAVQEYFTRLYQFKGSALDKKNILEEFQKMRFAFATVGKEFKLIEQNTKTILIPAQERAKEIAEELRLKGANKKLIREAGKYCVNVYDNLFRKMYDAGMFVSVSEELKEDFFVLKDCSNYSDETGLQVKAELGMDIWL

SEQ ID NO: 12557 - protein, 774 aa, Clostridium sp. 7_3_54FAA
MAILCFLTAEKLGLGKLAKLMGLLHDFGKGTADFQNYLRGAGSRHHNHAGLGALYVHRHWWQREAAKERRQTAQLISLCIYGHHAGLPDCLTASGRSPYLDGLREQPENYYIEAMENFYTEVASAEKLDKLFDDACKELKEFGLDSHSFNWGMLARLLLSILVDADRWDSACFEYDEDPFEMAQEAQPDWEKLLIKLEAYVEKFPREGELATIRRNISAWCRAAGEYGPGLYTLSVPTGGGKTFSSLRFALSQAEKYRQRRIFYLIPMNTILDQNSRDIRDALSDYPSILEFHSNVIPENEAEEENYRRLTERFDSDIILTSLVQFLDTFFQKGNGKARRMYRFANSVLIFDEVQALPKKCRELFKLALQFLVRFCNCTVLLCTATQPNLGLEAKELVPDVDALYQKLKRVTYISEMGPRKYQEAADDIAGFIGKKTSVLMIVNTKDAAWNIFQGISEQLETLNYRQVQIRQDLTDEELEKCAGGCAEDEILCVHLSTLMCPMHRKEILRWIKVWLSKKKLVCCVSTALIEAGINVSFPTVIRSLAGIPSLIQAAGRCNRNCEADMGNVYLWNLAEERLSRLPDIQKGKEISMSLLSNVENPDELGNPEMIKRYFAKEEIYTQEVEKYQYKEWNSDLVTMLSTNRECRCTAGNLRDENNPLPDLSKRFYQSFRTAGTVFQVIDQKTKSVIVPYGKGKELIERLGDRHTLSEEIRLLKEAQQYSVNLFEHIFNRLAGEGALVSLGETGAVILKDEYYDPWAGVTITPQEMKELIM

SEQ ID NO: 12558 - protein, 804 aa, Selenomonas infelix ATCC 43532
MKEYLAHIRRDESAVQTIRVHLLRVGDLMASYAEKMELSATARLIGVLHDLGKCSREFADYLDYCRKHPGDYSRKGAVDHSSTGGQLLQRKYSVLGEAECLTARMAALVIFSHHAGLLNYLGEDGTSDFLRRMEKKDVPQVHLSYYYEHVISENALDVLFKKAVHEFSVLDERIAACTDMGSEAYHFAWGMVHKLLLSMLVDADRLDSAEFEMGESLTTEWDTAALWTDFSQKLEQKIARFSIPTEPKAREIAKLRQRISDDCLKAADEPPGIYRLCVPTGGGKTLASMRFALRHAQKYDKKRIIVVIPYTSIIDQNVREIRDVFHMDAAILEHHSNVIEEEVSEDTECMDFRRVLTDRWDVPIIFTTQVQFLNVVFAGGNTPLRRLHALEDSIIIFDEIQTLPVRCTYLFNAALNYLKNFMNVTAVLCTATQPPLAHLDIPLEMSLRSEMTGDVADLFDGFRRVQIENICVDGGVSVHEIAAEIVQSAEELGDVLCIVNLTAQARALYETVAGLAQMAEHDICVLHLSTKMCPAHRKTILKLVREELAVRRQHPERRLICISTQLIEAGVDVSFPVVYRALAGFSSIAQAAGRCNRHGEMEYGLVRLFTLENENLSRLEDIRQGKKIASDILYKTSADEILTPQTMETYFHRFYKGRTARDMRFPMKDSNTIFDLLSANEAGLQEAAENGEQPDLWFTHAFCDAGRAFTVIDSHTEPVLVPYAGGKELIVEFNDIQFDKLRISKKMNAVQQYMVNLFSYELQKLVLLGGIWRTESGVMALREEYYNESFGVRTEDQGNAYCMV

SEQ ID NO: 12559 - protein, 803 aa, Selenomonas noxia F0398
MKQYLAHIRRDGSAKQTMRAHLLRVGDLMAASAAGIGLSATARLIGVLHDLGKCTKEFADYLDWCRKPGNYNEGKKVDHSTAGGQLLMRRYGDRDVDGLLTVHIAALVIFSHHTGLMNYLGEDGTSDFLRRMEKIDVPNVDLSYYYDTVISESELDLLFEHAVHEFTVLDAKITALDPERGEKYHFYWGMVHKLLLSMLVDADRLDSAEFELEKPLTDEWDTAEIWADFSDKLEQKLTGFSIPPEPKAEKIARLRQKISDDCLESGDESPGIFRLCVPTGGGKTLASMRFALRHAQKYNKKRIVVVIPYTSIIDQNVKEIRDIFHMDEAILEHHSNVITEDDGEDTGSMDFRRILTERWDVPVIFTTQVQFLNTVFAGGNSSLRRLHALEDSIIIFDEIQTLPIRCTYLFNAAMNFLKDLCRVTALLCTATQPPLEQLDVPIEMRDNADLTSDLAEVFEGFQRVQIKNICEDGGVSINEIAGEIVHSAEEIGDVLCIVNLTEQARSLYEKVSELAQISERDIHVVHLSTKMCPAHRKEVLRTVREELDTRQEYPEQRLICISTQLIEAGVDVSFPVVYRALAGFSSIAQAAGRCNRHGEMERGIVRLFTLEQENLSNLKDIQQGKKIAQIMLYQQMENEIVTPQIMDEYFRRFYRDHTEKEMCYPIKGRNTIFDLLSANNAGWNACQGRGDKIDLYFMQAFHDAGNMFEVIDTYTESVLVPYKDGDSLIPLFDGKTADKKVFFREMKQAQQYAVNLFSYEIQHLEAWGAVWRTESGVIALRKEYYSENFGVQLEEQQNDYCMV

SEQ ID NO: 12560 - protein, 725 aa, Clostridium  clostridioforme 2_1_49FAA
MQYYAHISDDKARRQTVKEHLTGTARRSELFAEAFRCGAWGYGCGILHDIGKYSQGFRKRLEGGSITDHATAGAQEMMGLYARTNPLAAYCAAYCISGHHSGLLDGGRNGDTAGEATLQGRLKKQLEDYSPYKDEVEMPDFPGLPFRQIGKGGFSLSFFIRMLFSCLVDGDYLDTEQFMLGHDAVRGDHDCMDVLLRRLESHVESWLSNDDLISVNGRRTAILKACLQAGRRKQGLYQLTVPTGGGKTVSSLGFALRHAVEHGLDRIIYVIPYTSIIEQNAQVFKEILGKKNVLENHCNVTYEDNESARELKLEQLAAENWDKPVVVTTNVQFFESLFASRTSACRKLHNIANSVIIFDEAQMLPVKYLMPCIRAVSELICNYHCTAVICTATQPSLQPFFPAKIQELEAAELCPDVKGQYDFFKRTRIHLAGRISQEHLVKELEGRHQVLCILNSRKRVQRIYESIEDRGTYHLSTLMYPKHRKELLKEIRGRLSSGEPCRLISTSLVEAGVDFDFPAVYRELAGIDSVIQAAGRCNREGKRDPEECITQVFTLEEEEDIHIPQELKLPISVAGQIVEKYEDISSPEAIGEYFTRLYRYKGEGLDAKDVVEQFEQGSHSFMFPFASVASEFRLIESNTRTILIDTEPQAAQIAMQIRRGEHNRELIRQAGQYCVNVFEHDFEALNGAGRLEQIDQEFYVLRNKEQYTRERGLVIDVSRGDAVMF

SEQ ID NO: 12561 - protein, 848 aa, Hungatella hathewayi WAL-18680
MQLNDVLNFEEPIYAHICEGKNAETLQQHTKLCQKYYKKLMDTKMLKLILGRFLQRYMENCTKEAELFFWEMLEGSIIFHDTGKINPAFQRERMKKPFKYQKDFQILEGSKHSLLSSVIYLDYCYYLLAQMTMSIDEKRKLKSLIYVNAYIISRHHDDLGAMREYGEKFLEGGQIYEMISRLPNEKQTLYKGPFHFNQENIGTVCKAFPGGGKKRESREDDRKGGMELYIYARLLYSLLTSADYYATTEYMNGFAINQFGEVNQVDELRRVYEACGVLKSIREYEKTNVGTKFVAENEINALRCQLFLEAEAEWKVHKEENVFFLEAPTGSGKSNTAMNLSFQMLKAGQTKLCYVYPFNTLVEQNLDSIKRIFGGNEDIMSMVTVVNSVTPIKIDEDKKKAMSENNSEFYQSALLDRQFLNYPFILTTHVGLFETLFSNKREALFGFLQMAGSVIVLDEIQSYKNTLWSEIIIFLKAFAEFMNMKVLIMSATLPDLEYLTEESGQVVRLMKRRDQYFLNPVFRERVQLSYEMLKEKTDFEQLHHHICDHVQQEKKVLVEFIKKKSAYEFYEYACEYGILGMELRLLTGDDNRLDREKILNEIRCSDKGVILIATQVVEAGVDIDMDIGYKDISKLDSEEQFLGRINRSCKKGGVTYFFDLDNAGDIYKDDFRINRELTLENEEMREALKNKQFAEYYLSVINLLKESRNKSASEEGLEHFFKEVKHGNFKEIAAHMHLIEENSWTMSVYLSRMIELPDGTQLDGEVCWEEYKKLLLNQELPYAKKQVLLSKVRSQMNYFIYEIKKNSNLVYSDRIGELYMIQNGDRYFENGKLNKQALEEAGGMFIEL

SEQ ID NO: 12562 - protein, 365 aa, Streptococcus ictaluri 707-05
MISNFPSQWQDKLKEAGFTSLTPIQEKAFSAIKEGQNILGISPTGTGKTLAYLFPTLLSLKPKKAQQLLILAPNTELAGQIFEVTKEWAEPLSLTAQLFISGTSQKRQLERLKKGPEILIGTPGRILELIKLKKIKMMSVNTIVLDEYDELLSDSQFHFVQKITHHVPREHQMIYMSATNKVKQEELVEGTLLIDLSDQESSQVKHYYIKVDKRERTELLRKFSNIPNFRALVFFNSLSDLGATEERLQYNGATAVSLASDINVKFRKTILEKFKNHELSLLLGTDLVARGIDIDLLEYVINTEVARDRENYTHRAGRTGRMGKPGTVITFVDHPEDIKKLKKFATVSELRLKNQELIEVKSPSR

SEQ ID NO: 12563 - protein, 890 aa, Streptococcus ictaluri 707-05
MLYRKVLPFQKLIIDSLETNNDIDNLGKKVIQFLAAVHDIGKASPAFQTQKGYCHSEDLDLRLLERLERNGFEGISSLQLAKPSKSHHSIAGQYLLHSYGVKEDISTIIGGHHDKPIDEVDHYKNQGLSYPSNYFQIQDSGNGINKKWKDKQRSIFDWALGISGFDSVESLPKIRQPAQVILSGLLIMADWIASNEYYFPLLSIDDIAVRHPLERKILGFEKWKKTGLWEPGVTVNFNRLYEKRFDFQPRNVQMVLADTIANTRNPGILILEAPMGIGKTEAALVAAEQLAAKTGRNGIFFGLPTQATSNGIFSRIEKWLESVQGELEENLSIHLVHGKAQLNEDFSCLSENINIDDADNGSVIVNEWFSGKKTTSLDDFVVGTVDQMLMVALKQKHLALRHLGFSRKVVIIDEVHTYDAYMNQYLLEVLRWMGAYGVPVIILSATLPAERRVELLKSYMFGLGKEFNKTERKQLAHELKTDAYPLITYNNGTEVCQIKEFQESKHKRIIIEKLKEDQLLNLIKDALRDGGVIGLIVNTVKRAQKLAQYFAEKLGEDMVELLHSGFIATHRAQKEKELLQMIGKKAKRPKQKIIIGTQVIEQSLDIDFDMLISDLAPMDLLIQRLGRLHRHDDIKRPAQHEQPHCYVLGTSDQLEFEEGSSFVYGDYLLARTQYFLPDSINLPEAISPLVQKVYEFDIKSEDVPNIDIDEVLLSKYMEGRQKYISKMEEKKSKAKNYRIANPVLKPSRKRSENLIGWLKNPNPDENEEKAYAQVRDIEDTIEVIALKKINDGYGLFGDEKDISADIVEGDLAKQVAQNTLRLPLTLSKFYNVDKTIEELERYYLKHFSNWSSSPWLKGSLGIIFDDNNEFIIKGFKLIYDEKYGIQVERM

SEQ ID NO: 12564 - protein, 926 aa, Streptococcus sp. oral taxon 058 str. F0407
MSKKKSDTLWAKKKEENGRFFWLPLSQHLEDTKNIIGLLWEHWLSEGQKKLIEDSLDSATYDGDLGKRLAQFLAAVHDIGKATPAFQTQRGFANSDDLDIQLLEKLEQSGFTKISSLQLSSPKKSHHSLAGQYLLFSYGVQEDISTIIGGHHGRPIDTIEDVKNQGSYLSNYFQNESKESAIHKNWDLVQKEIFNCAIDECGFDSVKELPKIKQPAQVILSGLLIMADWIASNENYFPLLSVNEKEEVDKSRRLQDGFERWKKTSLWQPKYISEPDSLYKERFGFEPNNVQSILSHVITQISKPGIVVLEAPMGLGKTEASLITAEQLATKTGRSGLFFGLPTQATSNGIFNRIEKWVESLKDDSEDILSIQLVHGKAALNEDFLKLKANTFNFDDVENGSVIINEWFSGRKTSALDDFVVGTVDQFLMLALKQKHLALRHLGFSKKVVIIDEVHAYDAYMSQYLMEAIKWMGAYSVPVVILSATLPSQQRENILKSYMSGMGLKWRDIENTDQLKTDAYPLITYNDGSEIHQVTTFNKQNIKDIHIIRLQEEQLLGTVKDGLEGGGVVGIIVNTVRRSQELARNFSEIFGDDMVELLHSSFIATERIQKEKELLQQIGKNVERPHKKVIIGTQVIEQSLDIDFDVMISDLAPMDLLIQRIGRLHRHQIERPQKHEIARFYVLGTSEELDFEEGSSFVYGDYLLARTQHFLLDIMRLPDDISPLVQKVYSPDFTIEFSSQEFQQKYLDAKAEHDITIKNKETKARTYRINDPVLKISRYRNNSLIGWLKNLHPNDSEEKSNAQVRDVEDTIEVIALKKMSDGYSLFIENQDISQNIDNPSVAKKVAQNTLRLPISLSKGYNIDQTIEELERYNNSYLSQWRNSSWLKGALGIIFDENNEFILNGFKLLYDKKYGITTERLNKNESI

SEQ ID NO: 12565 - protein, 739 aa, Clostridium sp. DL-VIII
MIYYAKTKPIETIREHTDNVLKECKNLKGVYEIEINNIIKNFIEPEYFWKLLEFCCEYHDYGKCNVQFQNKLRKKIREMKEVEQKSGDFNEIPCDEHEEIPHNYLSPAFLPIEKLREINDERLRNSIYQAIAYHHERKSIPDPSEIKEYIKDTLNKELDGINKHMENGVNKVFAGYAAKIENIRRIKDKDENYRFYIMLKGMLHRLDHSASAHVDVEEKLKKTVGECTEDFFNKNHWDLREPQKFAMEHREDNLLITASTGIGKTESALLWIDDKKSFFTLPLRVSLNALYSRVKDDIGYNSVGLLHSSALEYMEKQEDEEAYKTYEEASLLSKKLSFSTIDQIFKYPFKYLGYEKVLATLAYSKVVIDEIQAYSPEIAAVILYAIKQLNDMGGKFMIMTATLPRIYKDKLKEFNINFKEEKFISDNDRHKIKLVDDEIINSIEKVLKFGRKNKVLIIVNTVDKAIEYYKALKDSGLNVNLLHSLFNNNDRSRKEEEIKQFTKNENKECGVWITTQIVEASLDVDFDYLISEMSTLDSQFQRYGRCFRKRIFQGIEPNIFIYTKNSSGIGSVYDEEIFNKSIELLIPYDNQILKEAVKVDLVDKLYSKELLKGTKFLKKFIEACNVLENIIPYENTSREAQQVLRDIDSVRVIPNEIYSSNINLFDEIIESKSEDRHKLFREINNLTISIPKQKLKKFTKLNKELRVDTIVNIDNILLINAKYTNEEGLCLGELYDNIF

SEQ ID NO: 12566 - protein, 802 aa, Crocosphaera watsonii WH 0003
MDSMDSLNQSAIREAVKQDIYPIPDWLEVGKYAFSTEHQRNVKVNGFLGHIANCLVSGETVHIEIEKLSPSTIEVTEFDISKISHLTYASVATEWQNEIKDIQIFPGDSAKSSTIPAEIHPSLKQALIQTGINEFYSHQLKAWNELNQGHSICITTPTASGKSNSFIPFAFHQALTKQRTSLFIYPLKALASDQYSKLIKLNQALPSQEQLFIAKCTGDVPLETRKNYFKGVKCPDIIVISPDVLHHLLYHTDKSQLVLLKDFLSRLNLIVCDESHTYISSFGIHFANLLRRLRLAAQNSGNSALRLRSGLVEEINWVISTATISNPLELASQLTGLSSNQITLINESGAKSHEKTLLVFNPQNSPNFASTNLISSLLNFDLKGLVFVNSRQTAKHIFSLLSYHHGGYISSVDLFYGSLRSEQRKERIEQLSNCETKILITTNCLEAGIDLPELDFVVLRGFSSLNSFWQRGGRCGRKSPGLIIFIPDSNNHIDYYYATQPQRLLSPVEKVKIQPNYPSILSRHLLCAAAEGGLNSDEVTQYFGDKSDLVTAELLKQKQLSWSLGKRLWKRGYPHKYVSLRGIQDETISLIDVKTSKILEEMSLYIAHKECHTGAIYLTASEGKTNVWRCKELDLKQNKAFLELENSSDKRTKPDVQLAVEPLSKLEDPSIVKTAIPNGNLRLIFYWGKVKRQVMGFKELQLVYAPTCINRNCSHYQIPKASQMTKCPGCGWTLKQRLNTQEIAKFEFKPPLETTIEVPLLRIEVNETLATAITNKAQEIKKAILKTYHNPDDIPHQLSPYF

SEQ ID NO: 12567 - protein, 802 aa, Clostridioides difficile 002-P50-2011; identical to SEQ ID NO: 12171

SEQ ID NO: 12568 - protein, 802 aa, Clostridioides difficile 050-P50-2011; identical to SEQ ID NO: 12171

SEQ ID NO: 12569 - protein, 802 aa, Clostridioides difficile 70-100-2010; identical to SEQ ID NO: 12200

SEQ ID NO: 12570 - protein, 773 aa, Clostridioides difficile 70-100-2010; identical to SEQ ID NO: 12210

SEQ ID NO: 12571 - protein, 744 aa, Desulfovibrio carbinoliphilus subsp. oakridgensis
MGKKAASDGPWFAHSREGQPQSAWQGLAAHLHGVGALARDFADRFGAGEWGALAGLFHDAGKYTEAFQRRLAGDGQRVDHSSAGARLAVDRFKGPGKLLAYCIAGHHAGLPDGRDNDLACLAARLKAALVPEPARTLADSRQAPEAFPFTPALGRTGFQCAFFIRMLYSCLVDADFLDTEAFLDREKHAHRGGYPTLETMRERLTAHLAQFAAKAEPSPVDPWRAKVLGWCLGAAGDAPGLFSLTVPTGGGKTLSSLAFALNHAITHDRKQVIYVIPYTSIIEQNADVFRSAVGPEAVVEHHSNYDPKRRTDKDAAEPAGDEGLGRRHELAAENWDAPLVVTTSVQFFESLFAHRSSRCRKLHNIAKSVVILDEAQMLPPTLLRPCLEALRELSESYGTTVVLCTATQPALTRREGFAFGLEPPREIVADVPGLFAALKRTRVAHLGKLTDDELVKRLREHEQVLCVVNTRAHARRLHGLLGPGAGVFHLSASMCPAHRSEKLAAIRAALKAGQPCRVVSTQLIECGVDVSFPAVYRAEAGVDSVAQAAGRCNREGELAEGVVYVFEAEAAPPAGELRRAAEEGHVVLRAFADPLSPEAVAAYFEALYWRVGPDGLDKKNDRIAGIFAALHAGANTLDFPFRQVAHEFQMIESACEPVIIPWGQAGEAIVRGLEHAEHTGGLARSAQRYTVQVPARVRAALVAAGDVECVQERFYVLRRMSRYDDEEGLSGDAAGVFRGEDWIA

SEQ ID NO: 12572 - protein, 831 aa, Aggregatibacter actinomycetemcomitans RhAA1
MSEVIAHARQDSKWHFHPLQDHLAKVAKLAKRFAGRYGALFAEYAGLLHDLGKFQAAFQEYIRKVTGFERENAHLEDVESSKPHKIPHSTAGAKYAMQNLEPFFGHLLAYLIAGHHAGLADWHDKGSLKHRLARADDELAESLAGLGKSGLPEDFLSLPDDALEEDLLNFWKNGINPEVLHIWMRFLFSCLVDADFLDTEAFMNGFADADAVQQAGFRPKFPGLEELHCRYEQHMFELAEKPDKDSALNQERRAILAQCFSAAESDRTLFSLTVPTGGGKTLASLGFAFKHALKFGKKRIIYAIPFTSIIEQNADVFRKALGDDAVLEHHSNLEVKEDKETAKTRLATENWDAPLIVTTNVQLFESLFAARTSRCRKIHNIADSVIILDEVQQLPRDFQKPITDMMRVLARDYGVTFVLCTATQPELGKNIDAFGRTVLEGLPDVREIMADKIALSERLRRVRIKMPSPNDKTQSWQEIADEIAESSCVLAVVNTRKHARRLFAALPSGGIKLHLSANMCATHRSEVIALIRRYLALYRKGRLKKPLWVVSTQLIEAGVDLDFPCVYRAMAGLDSIAQAAGRCNREGKLPDLGEVIVFRAEQGAPSGSLKQGQDITEEMLKASLLADPLSPLAFAEYFRRFNSKGDLDKHKITSLLTAESSNDNPLAIKFRTAAERFRLIDNQGVALIVPFIPLIHENGDKSPKIVQASELDDFFRRHLDGVAESDWQKTLDGYRYPSPPDNHFGQTDKPPLPEPFEMWFKLLEADPLKNKWVYRKLQRYTITVYETELKKLHKDAVFSRAGLLVLDNGHYYDVLGADFDDAVVPPEESVL

SEQ ID NO: 12573 - protein, 742 aa, Desulfitobacterium hafniense DP7
MAKAHRRWQSYIRGQNKGGPNHAPEGAFLFSYLGFHLLQQESKWPSYAVFWLWLTRDIADHHGALKHLDEKHRIGAGTWEEMDLPGITRFIEQIYPELRQVPITAEALDQWIDRLYDVLQEASDGLDLGYSPDYGKAMAQLTFWRELTTALIAGDRFHVAPMERVGFSQEDHIRHDRALDEFCRNNGEQVMADIRGQAQRQILNQLARDPRRRIYTLEMPTGYGKTITALKIATWLGREQGYERIIYVAPYLSILEQTSGVMEKAMGASVLEHHSLAVLEEKQKDEDREEEGQFHSGQLMMEAWANPVICTSFQQWSKALFPGKAQDTLRRAYLHNSVVIIDEPQIFAPESWNVFLCGLESVAQLYNLRIFFLSATMPPFDYGLSEQPGCLAVNPVQQIERYQVEQKREMDEQGVAGYLLKGSELLAADERGLSQAAILNTIADAYLVYKQLAARVEPSQLKLLHGMMIPLHKRVEIEKIRHFQAENKREGQYVVSTQIIEAGVDLSFDHIMRALPILPSLIQAAGRVNRNGSGRRGILTLMTFLRGGEKNTRGFIYPSELQKLTDELLQKQDVWLESELLELIKEYYRRMFARNSYEAGKQAIIDAYEGNWPLLGQQFKPFGEDYFKLPVFVPWQTEEEDQAYFPQRFVELQERLGLYEAEDIYACYEDRDYYSRLSFKGRKEFMILLNHYVVNVPAKLAFSLVGKELYLKNRIPCLWSGNDYDPVAGLAKRAVEGFDAII

SEQ ID NO: 12574 - protein, 792 aa, Peptoanaerobacter stomatis
MIDDKLYDKLKHCYAKEDESIEVHVSNVLEQMGILKKLGYIDDEKAEILGDAIKCHDVGKANKYFQNRILSAKEGKKKYFDKENEVGHNILSPFLCRFGDDERDYITAYAIVNHHYYVKNNFNEIKEKEDILNKNIEEIYKSYNLEFDKNNILDLYKFISILQTELEENPKILKKALLILGLLNKCDYAASAHMEVEYSADFLQNALENMMDEWKNKNSSASWNDIQKFCMSNKDKNLIVVAPTGMGKTEAALSWIGDNKGFFILPLKTAINSIYDRVKKDIVKDNISKRVALLHGDTFNIYNDEKINDNNKNEEDIWAYYEKSKLFSIPLNISTPDQIFDFIFKAIGFEPKYAMLSYSKVVIDEIQAYDSNLLACIIIGIQNIIDIGGKVSIFTATLPPFVEDLLSLKKAGSSKIERYKFVKNIADIKGYKKRHNIKILEEEMNADLIYEHYKNSYSKKYLVVCNTVKKSQEIYQELKDKGIDNINLLHSKFVKLERKVKENNIMSVGKTYKEDNETINEIDEVWVCTQIVEASLDIDFDYIFTELSDLNGLFQRLGRINRKGAKNINDHNCFIFTEINQKLLIKKEDSIRGFIDEAIYKLSKKAILSHGDGILTEEDKLNLIDEYLTTENMKESLFLKRYWISYDYYSKLYMHELSAKDAEKYLRNIISFDVFPKDINNGLLNEEEINLIFERIKAVKEHLNDKNKSREEKKKYVFELSELKNEIMKYTVSVGLYDLGGEKVKYLENIEISKNTSIPILLCHYDELGFRRLTEEESKNENFDNKDDENFI

SEQ ID NO: 12575 - protein, 792 aa, Peptoanaerobacter stomatis
MIDDKLYDKLKHCYAKEDESIEVHVNNVLEQMGILKKLGYIDDEKAEILGDAIKCHDVGKANKYFQNRILSAKEGKKKYFDKENEVGHNILSPFLCRFGDDERDYITAYAIVNHHYYVKNNFNEIKEKEDTLNKNIEEIYKSYNLEFDKNNILDLYKFISILQTELEENPKILKKALLILGLLNKCDYAASAHMDVEYSADFLQNALENMMDEWKNKNSSASWNDIQKFCMSNKDKNLIVVAPTGMGKTEAALSWIGDNKGFFILPLKTAINSIYDRVKKDIVTDNISKRVALLHGDTFNIYNDEKINDNNKNEEDIWAYYEKSKLLSIPLNISTPDQIFDFIFKAIGFEPKYAMLSYSKVVIDEIQAYDSNLLACIIIGIQNIIDIGGKVSIFTATLPPFVEDLLSLKKAGSSKIERYKFVKNIADIKGYKKRHNIKILEEEMNADLIYEHYKNSYSKKYLVVCNTVKKSQEIYQELKDKGIDNINLLHSKFVKLERKEKENHIMSVGKTYKEDNETINEIDEVWVCTQIVEASLDIDFDYIFTELSDLNGLFQRLGRINRKGAKNINDHNCFIFTEINRKLLIEKEESTRGFIDEAIYKLSKKAILSHGDGILTEEDKLNLIDEYLTTENMKESVFLKRYWISYDYYSKLYMHELSAKDAEKYLRNIISFDVFPKDINNGLLNEEEISSIFERIKTAKEHLNDKNKSREEKKKYLFELSELKSDIMKYTVSVGLYDLGGEKVKYLENIEISKNTSIPILLCHYDELGFRRLTEEESKNENFDNKDDENFI

SEQ ID NO: 12576 - protein, 792 aa, Peptoanaerobacter stomatis
MIDDKLYDKLKHCYAKEDESIEVHVNNVLEQMGILKKLGYIDDEKAEILGDAIKCHDVGKANKYFQNRILSAKEGKKKYFDKENEVGHNILSPFLCRFGDDERDYITAYAIVNHHYYVKNNFNEIKEKEDILNKNIEEIYKSYNLEFDKNNILDLYKFISILQTELEESPKILKKALLILGLLNKCDYAASAHMEVEYSADFLQNALESMMNEWKNKNSSASWNDIQKFCMSNKDKNLIVVAPTGMGKTEAALSWIGDNKGFFILPLKTAINSIYDRVKKDIVKDNISKRVALLHGDTFNIYNDEKINDNNKNEEDIWAYYEKSKLLSIPLNISTPDQIFDFIFKAIGFEPKYAMLSYSKVVIDEIQAYDSNLLACIIIGIQNIIDIGGKVSIFTATLPPFVEDLLSLKKAGSSKIERYKFVKNIADIKGYKKRHNIKILEEEMNADLIYEHYKNSYSKKYLVVCNTVKKSQEIYQELKDKGIDNINLLHSKFVKLERKEKENHIMSVGKTYKEDNETINEIDEVWVCTQIVEASLDIDFDYIFTELSDLNGLFQRLGRINRKGAKNINEHNCFIFTEINRKLLIEKEESTRGFIDEAIYKLSKKAILSHGDGILTEEDKLNLIDEYLTTENMKESVFLKRYWISYDYYSKLYMHQLSAKNAEKYLRNIISFDVFPKDINNGLLNEEEINLIFQRIKAVKEHLNDKNKSREEKKKYVFELSELKSEIMKYTVSVGLYDLGGEKVKYLENIEISKNTSIPILLCHYDELGFRRLTEEESKNENFDNKDDENFI

SEQ ID NO: 12577 - protein, 765 aa, Acidovorax sp. NO-1
MASDSSSFFLLDERIQRYIWSEGWEELRDVQEQAIPVVVKADRDVVISAATAAGKTEAAFLPALTHLLAAGGKGLIVYISPLKALINDQFGRLERLCEHLDISVWPWHGDISASKKSKFMAKREGVLLITPEALEATLCNRGTSVGGIFQSLTFFVVDELHAFIGSERGKQLQALMHRVETVLGRRVPRIGLSATLGDMSLAGSFLRPGSTPAQVNSRSEGAEFKVMVKGYEEPITVRNSRPAPKTAASQAEADDTDDDEPETPAYIASHLFQTLRGSNNLVFPNSRRQVEQFTHLLNKLCETHRVPNEFWPHHGSLSKEIRAETEAALKQKEAPATAICTSTLELGIDIGAVKSVAQIGPPPSVASLRQRLGRSGRRAGEPAILRAYSTEDEIGPTASLRNVLRLDTIQMVAMVTLLLENWFEPPRVQGVHLSTLVQQLLSSIAQSGGASAGALFNLLCAPGAPFAGVTSAEFAVLLRHLGEKDVIMQESSGVLLPGVKGEKLIGHFSFYSAFATKEEYRVLAGGKTLGTLPIEQMLLVDQRILFAGKTWRVDAVDEKQRAIHVSRTRGGVPPAFSGGTGSTHTKVRQRMRELLASDKVPVFLDDGAKRLLAQGRDAYKRLNLESEFAIDQGRELVLMTWLGDSGNVALAARFGALGFSATAGGPGVEVQKEGTSNDEIMRALAAIASTDAPPLELLLGKAKNLMKERWDWALPDNLLRKAYASLNLNLDEARTWAQKMTVENENTPLNANEGPDGTQEEGSSS

SEQ ID NO: 12578 - protein, 814 aa, Acidovorax sp. NO-1
MQSALFPPDAAFAAACHDIGKVSPSFVEKLRRHCTSGAEHIPQQAIAPELEKQWGGHAGVSQAAAKALGAPAWIPEIVGQHHGFSPQLGGKHADAEVFGGSAWQAQRAALVQELQQRLGMKWPHIASAAQARLVAGLTSVADWIGSGRHFEDPTQPWQGLIDTALREAGWMAPSYRPGLGFADVFGFAPRAAQQQFLEAAQRPGVYVLEAPMGLGKTEAALYAAYQMLDGGQASGIYFALPTQLTSNKIHERFNAFLSRILAPECPHRSALLLHGKAWLQQTDMGEEGRPGGAWFHQAKRGLLAPFAVGTIDQALMAAMNVKHGFVRAFGLAGKVVILDEVHTYDAYTGTLLDALVALLRSLHCTVIILSATLSQERRSHLLQAPLHSQAYPLITALQNTADVPTVQEYPVAPPPSTQVEVRLLDDEACALQEALDRAAQGQQVLWIENTVDAAQQRYLDLAARAQELGIACGLLHSRFTASDRQNIEDRWVNLFGKPGWPQRAAQGRILVGTQVLEQSLDIDADFLVTAFAPTDMLLQRLGRLWRHFETPRASTATCSAWLLAPALEPAVAQPLQAFGASAFVYAPYVLCRSLQVWQTLQHIALPGDIRPLIEATYASRDEEGAMARWLHELEHGTPRTPGRPERKGRQALRQLARVGVAQDGKTLPDVDAQTRYSDSESHEVLLLRRVDYDSTSHTTHLTLLDGSTLALPTQRHRLDKQAWKALTAQLMQQQVPVRAADAPLPLARSQWQKLGLGHCFYLGDDTWPDDVSVLRLCLVDDASQLQGLHGATVHERHRLEYRTDLGYRRVKNDT

SEQ ID NO: 12579 - protein, 764 aa, Synergistes sp. 3_1_syn1
MCGPDGPVEKYLAHSARPELDIPAQGYFEHAGNVARFCKNELSSIVVGDGYQRGYDFFKYCLLHAALFHDLGKLNDKNQSVLRGDKKARHLPINHCDAGVAYMMRHKALLSALLIYSHHIGLPDMAGEKIRKNSPSGDLRFRDNDEAVRQDSENLEEYLVRHCESFGSELSSIENIRTDGRFDLRVATRLLLSCLADADHTDTAIHYRNFHEEKIPLLQAEKRLAALDRYVASLASGDKSVKLSKRNIARSGMYQKCRCGPTKDWMYYCDSPVGTGKTTAVMAAMLNAAQAKELRRIFIVLPFTNILKQSVDVYRNALRLPGESDSDMERVVAAIYHKAEYENENSRQLSALWRAPVIVTTAVQFFETMAAASPAGLRKLHALPNSAIFIDEAHTALPTNLWPLAWWWINKYAMEWRCHFILASGSLKKFWELDEFKIKGTDNNIPSLLPKEFSEWLNALETRRVPIKRKSEKMDEVRLCEWLLTLKGPRLVVLNTVQSAAVVARTLADRCGRERVEHISTAIAPKDRELLVKKIKGRLCDKEDDNWTLIATSCVEAGVDFSFRNGVREAAGLVNLLQLAGRIRRNEEDCYNDSVVWSIELDFSGLLKRHPSFEIASKVLLDLFAENPDLINEETNISDLCTRALRRELNECGMREDSSITEDEAACAYASVEKKFKVVDSQTVTVIVDTHIKERLESHDKVTWRELQDNSVQIYVHTAKKFKAEPVRGHPDIYFWPYKYDGFIGYMAGVLDNEELNNCGYGFL

SEQ ID NO: 12580 - protein, 766 aa, Synergistes sp. 3_1_syn1
MKGKIDHSTAGAQFVWQQLGCNKKDWIKLIAAEMMAVILAGHHGGLMDISSEGDDLFLKRMKKEDGKTHLTEVETKISPEIRDRVDKLMTSCEALSKFEQLILDIKAREDAITKESLNELELAVGAGSAELKCNEIKTAGAARLWFGLGCMTKFLFSTLVDADRCGTIDFCVDGAAEARQNSNYTGWSILSERLERYLSHFSADTSVNRIRRDISDSCRDAAQRGRGIFTLTVPTGGGKTLASMRFALELAKRSADDAHPIERIIYVLPYTTIIDQNAAKAREILEPESDRGKIVLECHSNLLEENETWEGKLLSENWDAPIVFTTNVQFLEALFAGGTKSIRRMHQLAGSIIIFDEIQTLPIKAVHLFCGALNFLVGQCGTTALLCTATQPLLNGVSRDYGSLRYGTKDEVIPDVSALFAALKRVEIKDSTKTGGYSIGELGDMAIEKRQEFISLLVIVNTTTVARKLYIDIRSKLEVDTEISVVHLSALMCPAHRKVVLDNISKLLKAAKPIICVSTQVMEAGIDVDFGSGIRSLAGFDSIVQAAGRCNREGRKVRAPLFIVNPADENVDKLIDIKAGRHAARRVLSALSLKGEKGEGDILSLENIASYFQYYFYERQKEMRYNVETEHGDDTLLNLLSWNAKTCIPPGRKLRQAFATAGNLFNVIDAPTKGVIVQYGEGNELVGQLALEDDFAAVKKLLHRAQRFSVNVYPYQLDTLYEHVGVYKQSLCGMSGTEVWILMPEFYSEEFGLSTAQIEKLKLEVT

SEQ ID NO: 12581 - protein, 741 aa, Bacillus smithii 7_3_47FAA
MIFYAKSSPVETIQEHTNELLIRLKDFKKLYQSSIPLLSERDWELLEWAVRYHDIGKVDAVFQNKIRKVIGKSLLSEASSYNIPHNLLSVMAIPFQELGLDKEETKLLAQIVAYHHERGILPDKQQIIANYEQNILPLKEEIEKQFGLPIDGKIRRSKISKIERRFLPSDGMYYRYILLKGFLHRLDHAASAHVPIELASEMDVGDHVTRYFRERLKVNKNPLQVFTESHQDYHLVVVAQTGMGKTEAGLLWLGKKKGFFTLPLRVSINAMYNRITREDNIAFTKKDVDLGEEATGLLHSTSLDYLYDQVEGNDKILEKVHSQSKEYANKLVISTIDQILKFPFYYLGFEKEYATMATSKVIIDELQAYDPKIAAVLIRAMTMIDKIGGSFMIMTATLPDFYFKALQRELSSSNLPLIYKEFINDSVKRHNVLVRDQSILEDSVLEEIANNHFSKQILVICNTVDRACEVYDQLSKRDTSVWLLHSRFTKMDRARLEKQIMDFTTSNECGIWVTTQLVEASLDVDFDLLYTEMSTLDSQFQRYGRCNRKGLKPVDKANIHVFTEDVSGISKHKSGGVYHRDIYDRSLALLKEHPGGLLLESVKQNMIKELYDERTLKNSSFKKEFDQTLEELKNRPHYDPDFKKGKAQELLRDIHQVQAIPISFAKQEEFQEKLDEWQNAQTSQDKRRYRNKIEAYSVGVNKFRAEKVGLTELEGLKGLYYIHCDYNPEKGLVLQSESIFL

SEQ ID NO: 12582 - protein, 418 aa, Tannerella sp. 6_1_58FAA_CT1; identical to SEQ ID NO: 12277

SEQ ID NO: 12583 - protein, 623 aa, Klebsiella sp. 4_1_44FAA
MFPFIQHPTPLQKAVLELDISQPGPQLFILEDVTGAGKTEAALILTHRLMSAGKAQGLFFGLPTMATANAMFDRLAQSWLALYQSDARPSLVLAHSARGLMEGFNQRIWPGAVSGSEEPDDEQPFSQGCAAWFADSNKKALLAEVGVGTLDQALMAVMPFKHNNLRLLGLDNKVLLADEIHAYDAYMSRILESLIEQQARSGNCVILLSATLSQQQRDKLVASFSRGSGCALAAPLLGDDDYPWLTQVAGREVSSRYVATRKEVERSVNIGWLDNEEACLTRIEQSASEGRCIAWIRNSIDDAVRIYRQLLARGAIPAEKISLFHSRFAFYDRQRIETETLSHFGKDDSTQRAGRVLIVTQVIEQSLDIDMDDMISDLAPIDLLIQRAGRLQRHIRDRRGRLKIGGEDERASPQLLILAPEWDEAPQEEWLTSALRNSAYVYPDHGRLWLTQRVLRQQGAIRMPQSARLLIESVYGEDIAIPDGLAKAEQAQLAKYYCDRAFAHQMLLNFKPGYSPDSSDFLADKLSTRLAEESITLWLAKNVDGQLLPYACGAHQWEMSMLRVRESWWRKHKAEFTLLAEKPLQQWCVQQHQNPDFAVVIIVTDSPDCGYSASEGLIGTMEV

SEQ ID NO: 12584 - protein, 765 aa, Thermanaerovibrio velox DSM 12556
MKGWLSGLGTLRQNLAIEIGGNVLGFWHDLGKFLPAWQGYIRKETGYDVEAHLETLGGKVQHSRAGAVLAFKKLRKCPAVARVLAYPIAGHHTGLPDWDYESAGGETLQERIFDPRDLNPDEKKLETRDIDQIEREPQAIEFLDKPIPKSAPMSVEKPLRGKPRESLHLWVRMLFSCLVDADYLDTESFMDRDKSLERSGYASLAELKDRFDRYIDYKQRHAKDTLINRRRREILSKCRQKAELEPGIFTLTVPTGGGKTLSSMAFALEHALAHGKRRIVYAIPYTSIIEQTAKVFKYGTDRDEEIEEMVNRGVPGLFGEENVLEHHSNLDPDRESPRSRLAAENWDAPIIVTTNVQFFESLFACKPSSCRRLHNIVNSIVILDEAQLLPPEFLRPILSVMRSLVDHFGVTFVLCTATQPALTGKIGAGQAEFEGLDGTVEIIDTPPGSDDAFRRVSFHFPDAKKLERREWADLAEELSQFDQVLCIVNTRRDCRDLCALMPEGTLHLSALMCGEDRSDVINVIKNKLKSGEPLRVVSTQLVEAGVDIDFPVVYRAMAGLDSIVQAAGRCNREGRLNSSGKLGRVVVFNPPKPAPPGLLRKGEEACLEILAKGDLMDLSGSVFGEYFRVFYARVNELDKPKFADRLVSRASEFKFQFRSLAQDFSMIDDQGQRSVVVFYQSPFNAKRSSRLLIEELRHKGPSRTLFRKLQRFAVNLRKREFEMILRGGMVEEIHGLYVQCCDGLYKPGLGLLVDPSQWSDEVLFA

SEQ ID NO: 12585 - protein, 796 aa, Jonquetella anthropi DSM 22815
MKAIAHTRREEDHLIEQTVEEHVRGTAALAESFANQWGDGFWGRLAGMYHDLGKSTCQWQEYLRVQDYDESASSESSEDEDKDDDKKKNPIHKVSHSEAGAAAVLEGFWDNWDEPNVSGPLTGLAYAIAGHHAGLADWRTGGRGALINRLATKNGDLDVSRLLNPLRQALGTGARQVDYPAELTRLDSVALNLNEEIRQWLEKWFADDGSEDVPREYLNLWVRMLYSALVDADSLDTERFCRPDQAAQRSRQFDMQDLKHRFDSYMDEKERLAEKSPVNEVRSKVLGWCRQAGHCEPGFFQLTVPTGGGKTLASLAFALEHCLTNGRRRIIYAIPYVSIIEQTADVLRGIFGDTGAVLEHHSNILPERETLQNKLAAENWDAPIVVTTNVQLFESLLSDRRVLCRKIHNISRSVIILDEAQMLPLQHMRGVLSVLKGLVKHFGVTVLLCTATQPALTRTFSDGQNVSFPGLPEPRQIVPAGADLYQKLLRAEWVRDYNPTQPRTWDELADDLLKHQRVLAVVNRRGDCRELYEVIKSRSGENLFHLSADMCPQHRSDRIGEIKALLKDESRTVRVISTQLIEAGVDIDFPVVFRALCGLDSAVQAAGRANREGQLNKLGKLGQLYLFSPMKPSPVGLLLKGEQTFKAMLGQKTEFDLFCPSVIKEYFNRLYRDVGTFDQSKYYELLVENAECFEFQFRTFGRDFHMIDDEGRQSVFVAYGAGAELIGELKRNGANPQLLRALQRYSVSIPESKLKELRYSGAVDETDEGYFVQSEAFVYDLETGAIGQPSVGFFIR

SEQ ID NO: 12586 - protein, 358 aa, Enterococcus faecium E4452
MFDQPEAKPREVVFFWTGQLTEKQTEISKRILCHSEKRHHLIWAVTGAGKTEMLYPILVETLKAGGRVAICTPRVDVCNELFLRYRYVFPEEKITLLHGNTATAYTFTSFVICTIHQLYRFYRSFDLIVIDEIDAFPYNGDAGLAHAVQTAIKPDGRFIYLSATPDKKLLKEIKQTFDIHKLALRFHRRLLPEPVLVFMNNWRQKCKNKKKIKSLVRIIHQLIKENHILLFCPSITMMHRLKATLQEALPRYEITDVSSRDNQRAEKVQKMREAKYDILLTTMILERGVTFERISVIVLGADHPVFTKSSLVQIAGRADRKGPYTNSQVYFFYEEKTAAIRKACQEIKEMNEEGKKML

SEQ ID NO: 12587 - protein, 747 aa, Cardiobacterium valvarum F0432
MPTTYYAHSADNQPYARWQTLADHAHKVGEMAAAFATAFGAQEIARYTGELHDLGKYSPAFQERLHGSSKPVDHAAAGARIAIERWGKSIGKMMAYCIAGHHAGLANGSDEGENRRTLKERLALQFGADIQSLDDIWQQEIRLPPTLAVPPLKPDIHHSGFSRAFFIRMLYSCLVDADYLDTEGFYAAIENKTIERGNYPALSNLQANLCHYLAALCDSAAQQSGEDSAHAALNRLRSDILHHATAQAAEPPGLFRLTVPTGGGKTFTSMSFALEHARRHGLRRIIYVIPFTSIIEQNAAEFRKAFAPLDEAVLEHHSTFDDSKLKDQDSKDKLRRASENWDAPVVVTTAVQFFESLFADRSARCRKLHNIAGSVIILDEAQMLPPDFLLPIMQAIKELAQNYRCSIVMCTATQPAVQAADGFYRGFENVREIAPEPEALFAQLRRTTVQHIGQQSNADLLAKLGGYPQILVIVNNRRQARSLYDAAAKLALDGVFHLSTLMCAAHRSQTLDNIRAHLRSGAPCRVIATSLIEAGVDVDFPLVMRAEAGLDSVAQAAGRCNREGKQAPENSHVWIFAPEDGWKNPPELAFQAGVMRVITRHHADDLLSTAAITAYFRELYALKGRELDKENILQKHSKAAKSLDFPFQTIADKFRMIKSPMLPLIIPFDRKAEKLIDSLRHADHIGGLLRKLQPYTVQIPEKALASLYTGGRIEPINEKNLGKQFYALIGLDLYDEVAGLSWGIRNF

SEQ ID NO: 12588 - protein, 989 aa, Actinomyces graevenitzii C83
MIRKPAPAFPLPQPQLEASELSELARSFWAKSGNAETWLSVVQHLLDSADIAGYLFDEYLSEHHRQLMASAWGGDQAKARASLTFLMSIHDLGKVSPQFSCQRTDLAELIRNQGLTVMRKRDYPERSYLPHGLVSQFALWDEISEAGGNRLAARQWAILVGVHHGRYPDAAAVALAQQQYRYQEGSSQDDPRWGQARSEILRFMARRSGFPLIAPDTALPELPIAVASAYTSALVIADWLASNEDYFPLRLRPVDDGGKLSISGYPELNARQQRERVRRAWKRAQFPTPMRVPSFHSENATDFYRHRFSWPASYQPTKAQREVIEIAAAENPDLMIVEAPPGSGKTELAFAAAEVLMRERGLQGIFVALPTQATTNAMFERVTSWLTSILGDEPQKLGVHLAHGKNNLNKSFMELLESGHSPLEVYDDDADNKDNGLHASRWMGQRWRSTLSPVVVGTIDQVLLAALKSRHVLVRHLGLMGKVVIIDEVHAADAYMQTYLKAALTWLGLYQIPVVLLSATLPPERRRELLDAYRRGQGATAANTALDKAIGYPVISTVTASEVRIHEIEGEAEVTKQIIPTQVASAEEIAKLLEQELADGGCAVVIRNTVREAQETYAAVKKVFGRQQATLLHSRFLAVERSARDSSMLELFGKNSTKRPQRHVVVATQVIEQSLDVDFDLMLTDPAPMDLVLQRIGRLHRHAGRNRPQGLQAARCLVLVNDLASAPWSYSSGTDYVYARYTNLRTLGILADRGQITVSEPNDYAQLTALAYNTAEPVGPQQWAASLDAALEKYLHDNQRSQAKADDWCLDGMNLPKWKAPALESKFMGNAATGEESNGPAVAASRAAVRDGEDQIPVLVVALDPELNNVPVAPPISGTQPDGTPLAVSEYNARGRIADICSWSISLPPWAFRASGQDLDEAVDAVAQEIWDDPITQDWACLQHPLLAGELILAMYLSPDGTRLTRDLYGHKLTYSIENGMEVQGNETP

SEQ ID NO: 12589 - protein, 935 aa, Stomatobaculum longum
MNVSKLMRSLAAKTNPNDSAQWLPLWMHARDTAGIMKKLWKHWLPAAVRREICGGSEEALQENEALFQKVCVFLGMAHDIGKATAVFQARILEMLPEVRERLAEEGLEIADIKTFTDPSAVAHALAGQVILQQRGVNEGICEIVGAHHGKPQEAVSESTFDGHLVNFRGKDSDATLWVEIWDAFLRYALEVSGIQDASIIPELSGPQRVLLSGLLVMADWVASNQFYHPTISIDELGREDMYPKRTRSAWKKLKLPAVWSAELGGMDEAAFAENFSFPPNELQKAVLEISEAVSSPGILIVEAQMGVGKTEAALAAAETFAGKCGSGGLFFGLPTQATANGIFPRIRTWAEEQVAVQGESKEKLSIRLAHGKAELNQDYADLLEAGKGEFTGEACIGEDEDKALVVHSFFRGRKQVLLSDFVIATVDQILMAALKQKHLMLRHLGMAGKIVIIDEVHAYDAYMNVYLERALSWLGAYHVPVILLSATLPASRRIDFVDAYLNTSKREIREREKRFTQGEEADWRYSRAYPLLTWTDGKEVHQRGLQLQSVSRSVAIRRVKESGRIQILQEKLRDGGCAIVILSTIRRAQEFAKEVRGQMPDADIVLLHSAFLMPDRAARERELLQKLGKRSTKAERDHLIVIGTSVLEQSLDIDGDVMLTDLCPMDLLLQRLGRLHRHPIHDNMRPEQLKAAQCYVIEPDEDAFESGTRAIYGDYLLMRTRKRLPDKITLPTDIPNLVQDCYDDREPDWETEADKEMYGKAKKEEANKTGHKKTKADSYCLDKPRRSLENWISNVETKLDEEEAEAQVRDSENSIEVLLFVQKGNEIHYLPWQHEGQRLSVERIPSPEEKRDLLRQSVKLPSALCREYQIKKTLDALKPMNELVLSGEWKHDPMLREESFLLLNEQLETELAGFRLWYSKEEGLFYEKGAADDKT

SEQ ID NO: 12590 - protein, 905 aa, Caldithrix abyssi DSM 13497
MSSNYFKTLESIKADFSCLLERLTECEKYWAHLHSHKAPEKLVDHTRLVGDYAFKLIQSHHLEIVIERLIQALIQKEFVLEKKAVGSFIKSLFWQTILFHDYGKINENFQRERMQNPHFSKKCKNKIGSRHSALSAFILISVKIQELRENSILSQNEKDFITLLIVPFAGVILKHHASYYDHDLDIPPDWIEAMKSYLSLLHIRTDFKLVKNLMQSFQDEQRFLPIVDFLFKDISAFSLFGLIRLCYSLLTAADYYATTEYTIDLAVKDFGVFLVGEKEKLQNTFKTSKSYNKDFYKRQEYYLSLPLDKLQKRNPENLNTLRQKLMAETLNAVKQNKNEYVFYLEAPTGSGKTNLSLAIAMELLQAHQYVNKILYVFPFTTLITQTAQSIKETLQVTNAQMVQLHSRSGFHSKREEVKDGQYGQQYQNYIDNLFVNYPIILMTHIKFFDILKSTQKENIYLLHRLANSIVIIDELQSYSPAEWDKIRFFISNFAYFFNIRFILMSATLPKLDALFLPESNQVPLPHNFISLLKNPKQYFQNPNFKGRVQFDFSLIDKITSIEELADFVFDECEKYSFQNNGVVKGIIEFIFKKRAGEFYKLIKERFNSANYQIYLLSGTILEPRRKEIIAHIKKSIEKKSSAKILLITTQVVEAGVDIDMDIGFKDRSLIDSDEQLAGRVNRNARTIPAKVFLFKLDRAYAIYGKDLRYALTRDHISQEQYQKILQEKRFEILYQQVCDYINRENKNEFIRGLKSYLEHFKKLRFSKIDRELQLISEQNVTVFVPLKISTCYFSNNDLEFISTLSGVTINDSLEGELVWKTYINIIKNKDMGFVEKRVDIKKIYGIMSQFMFSIYVNSGLLTELKNFADLEIFNSYQILYLSRWEQVYSYTDGIKDENFKEAMFI

SEQ ID NO: 12591 - protein, 925 aa, Lachnospiraceae bacterium oral taxon 082 str. F0431
MLEALWAKKEEKDGLMYWLPLTVHLEDTGRIMGLLWEHWLSEGQKRTIADDTDIGKQIAIFIGAIHDIGKASPAFQLKKGFANSKDLDKELTEKLVRAGFIDIDSPDLLSSPEKTPHGLAGEVILSVLSDRFKKENDIGSIVGGHHGRPIDNKSMISDTLSSFKKNLFQSENKDSDIYKKWLSVHTEILNNALKSSGFKRCEDIPILSQPAQAMLLGLLTMADWIASNTYFFPLIGIFDDTDIDMDKRCEHGFTKWRYSNQSDMWLPEIYADCNGLFKERFGFEPRDVQSIFAQTISDAKNPGLVILEAPMGLGKTEAALVGAEELAVKSGRSGLFFGLPTQATSNGIFPRIISWLKKQSVELGEKRGLRLVHGKAFLNEEYNNLTSASNIDVDGDNEGREGFVVNQWFCGKKTAIMDDFVVGTVDQLLMMALRQKHLALRHLGLSKKVVVIDEVHAYDAYMDQYLNMALEWLGAYNVPVILLSATLPKKSRVDFIMHYLTGKGVKFSKEDMSSLMVEDYPLITYTDNDKALNVKEFEPIEDKRIEIKYTDTENLPKLLDSLLDGGGNAGVIVNTVKKAQDIAKELSEKFGDENVMLLHSSFIATDRVKNEEKLMKYLGKDGNRPQKLIIVGTQVIEQSLDIDFDVMISDIAPVDLLIQRMGRLHRHIRDNRPKKHEKPVLYVLGNDRNLEFETGSEAVYGGYLLARTGYFLGDSIRLPSDISRLVQEVYDENIDPDLPDELNEKYSEYKAEYKALVNSKESRAGTYRLSSPILKKRISKEPNLIGWLNNQSKNSGEEDGNSQVRDTQDTIEVIALKKIKGGYTTFDSDEDISKSIEDAKTAKRIASCTIKLPNRLSKSYNIDKTIRELEDFYINNLQKWDNSAWLKETLCAMFDENNKCSINGVNMVYDKKYGLISKGENDAKV

SEQ ID NO: 12592 - protein, 894 aa, Prevotella maculosa OT 289
MKDFDKDFFDGLIKDSYKYYAHCVENGGECRHELLSEHSALTYSYARTLAKDNSLVPIIKILIRKSLEGNLEEALGNFVEEMFWTAIAFHDLGKMNAIFQKQKMNNNEELLYVDHPFSSQHSVISIYIYLAIAFQKMCELEDLTDGEQMFLCNIILYLSYPIYNHHEKALFECQDEDNWCFEQLLTLRPFLSLLNLSYSDETVEKFHQGLLLNANFNCLFEFFNEENEHLEHGFPLFALVKLEYSLLTTADYLATAHFMNHWDDMYRHTGFINETLRSKIIGAVQSSKPYNKSIIQRLEQEKFIQADEYKDVSCINLNILREGMAVETLHNIGKNLRERLFYLEAPTGGGKTNISILALAELLKCDSSINKVFYVFPFTTLITQTAQTLKDTLSVKDVEVFEMHSKAEMGSKKYGDEYLNYLDNIFMDYPIVLLSHVRFFNVITTNKKDANYLLQRLANSVVIMDELQTYPPAIWDKMAYFISEYATCFNMRFILMSATLPKLGKLLDLQNEEYGFVSLISNKGKYFQNPNFCNRIKFDFSLLGLGRPLKEQKGGYLEKLAGFVIKKSAFYAEHNQRNPQSVFTVIEFITKRTAGDFLKWIKQCNRFFDDVYILSGTILEPQKQKIIKQLKSVSNRNKKILLITTQVVEAGVDIDMDLGFKDVSLIDSEEQIAGRVNRNASKKGCKLYLFDCDSEKFLYGNDARLQVVELKNTHLYKNILESKDFDFLYDIIMTNINESNQSIFKQNIQDLYNAVISLNYPQVNNCIRIIDNTSITVFIPMELDKDLLREKLQIARDFNCIIGNAVDGKEVWGKYLELVLYKNGNFINNKLKMRQLMSLMSSFTFSIYPSGKDYEILKTFGSLQYGFFYLESWEPVYSLEDGINTQILKDTLFF

SEQ ID NO: 12593 - protein, 845 aa, Fusobacterium nucleatum subsp. animalis F0419
MTKFEDIFDFQDKYKYLAHIKDNREETLQEHTELANKYFEKIIEYKNLKSFFERIKNILNLKNQEEKLYYKMIDDVVNFHDFGKINSQFQIDKMLNEEILKMEDEYNISGVLGSDHSLLSASMFIAYYFGKITDLIEIVETKKIVILFEILFALSYVISKHHGNLDSFEEYIEKLSRNNDENILKELKNISVSNGGILLQAFLEKETITIFFNFIETYISERKKKENISSHEAMSIFVFTKMMFSLLVASDYYSTNEFMQEIKYENFGNMGNIDTIKKEYENSEIIKSIRDKEKNGIPNDEDINNFRTKIFLEAEKNLEKNKENNIFFLEAPTGSGKSNTALNLSLKLLDKDRRKIFYVYPFNTLVEQNMNTLKNIFGNNKEAIKNITVVNSITALTNKDSRDIPIEEYSDILMDRQFLNYPFIVTTHVGIFNTLIGNTKEDCMPFYQLTNSVIVFDEIQAYKNTIWTEIIKILNSYAKLLNIKIIIMSATLPNLSYLLDEEEKNNISKLIENRDEYFNNTIFKNRVEVNYDLLSEQKIEYEELLQHIIKNSLNSQKILIEFISKNNAKKFYELCENNEDLNVDHEILILTGEDNKARRNSIIKKINSKDKKIILISTQLIEAGVDIDVDVGYKNISGLDNEEQFLGRINRSCKKSGKAYFFYLTDAKKVYKNSVIIENKLNLFSDEMRDVLENKNFDVFYSKVLEILKRKAKEKINNDNFETIIFNKKFRLLKERMQLIEEQDDKKTYFFNRTLTDEEIEEIGENIDGSEVWERYVDILKEENYAKKIVELSKIREKMMYFLYEVKKNTELNYSDIKGSIIYIDDGDKYFTDGIYTGGEGDMFI

SEQ ID NO: 12594 - protein, 852 aa, Eubacterium infirmum F0142
MSMIWAHKNNETNVKQSLIEHLVNTATESRKSGDEANVGSICCLIGLLHDVGKAETKFQEKLEKNTNNNVIHSTAGAYFLYKNFYNNSDYGTIVGKLQKRFMEMCMYIIEAHHGLFDTVESKKIIKNNEIPEEINLNNIFYRFRIYERDAYTEVEYDWNNVDSYIRDEVEPQIEKITNLECRKFEDLVACSFKEFCQFQKRYTDSFKINTNKYEYSNHDKSRIIKQEYEFFEATLTRLLLSILKSADVKDSINAYGIEIENSCKHDCETIRDSFIKSIEAEYLKYSCIDKDHLTINSVRNKIADGLRVRGEIDDAGIYRLDVPTGAGKTKSAIRYALHQFKRKSKNRIFYITAFLSVLEQNALEIKKIIGDEYVLEHHSNIDILNESGAINESSLDEKENIQKEYIVDEWDSPVVITTMVQFFNTLIKGKSANIRRFSSLMNSVIIVDEVQSLPIEVTYIFNLFMNFLKTEMNCNIILCTATQPTYDHKSIEHKIWYGNKEAKNVDLVELDGTERECFNRCTVSKNKAGIETTSVEEVAEYVMGNRDESILIIVNTKRAAKAIADMLINYGLKDEKLFYLSANMCAAHRSDEIKKIKAALKANKKIVCVSTQIIEAGIDVDFYKVIRSFAGIDSIVQSTGRSNREGKYEKGGKVILINMDKSVENTKGLESIEKKKEVTIDLIKNIDEPLDIYELQKDFYNSYFNLEKMTGTKMEYSLGKDKPTLFKEIIGHSSNFKLERKGFFNHNLRKAADSFELIKDETESIFVHYNAEGDEKLKTLIEIVSKTYLDSNDYGEIKRLMIELKPFTINIYKNSNMNQYMKEYLGGEIKVLYDDHYSQKFGAIFDAEALIV

SEQ ID NO: 12595 - protein, 819 aa, Eubacterium sp. 3_1_31
MGELLAHRIKKTAYSQTLKQHEENTAALCQKFLTTCELDKIGYLSGILHDLGKAKSLFQAYLMKDEDTNEKINHAFAGAIYLYDHFYNLDNTNEVIQKCFIESVSLIILSHHSKLYDMYNPDKEMPFHSKLMTKKEILDYEESVNTFFSIFDKRYLQTLIQEAIQQYQTLFLRMKEHVNKLKPFLEEQGCKKKNGTLLYFQLGLQTRLLQSALRDADCYDTYLFMNHPTLSYNVLQPPYFEKNRLHIWETLEEKLNAHLLTLQQGNKQTEINQLRNQISLECYQAGEKKQGIYTLAAPTGSGKTLASLRFALAHAKKHKHIRHIYYVIPYLSILTQNAANLRDVLGEKDEVIILEHYSSLVIDDDEQHQLFTERWDHAVILTSYVQVLNALFHGSKQNIRRMHQLTDAILIFDEIQSLPVSCKNMFQTAIDYLTEFCGSTVLLCSATQPFPPNKLNAIPPYEEILSHLKIYNEAFQRVRYEDKTQCIMHTDELVKVISEDMQLRQSALIILNQKKRAYDVYHELKTLLDKDYKIFFLANTMCAQHKEDMIKEMTTALKKDTKVICVSTSLIEAGVDLSFETVWRACTGLDSIIQAAGRCNRNREYEEGITYIFSDADENLSRLSEIARAKALTLRVLKKFRDNPLQYDNNIASQKTLHSYYKFYYENLSAYKSELAIETDYIKKVGQVTYNLYDLLSENEQSIKQFSNDEKKQCVMRQAFRKAGDLFEVIPNATTTVIVPYGKGEDIITELCADIKDYERIDTLIKQAQRYSIEVYTQGNHYQDCFTAIKDLGVMILNDGYYDETCGFHMMAQKGGYFL

SEQ ID NO: 12596 - protein, 531 aa, Metallosphaera yellowstonensis MK1
MKSTSSRERDLSSVTFVDSLRSLSPEGKPRDLLLRTAEILDSWRPGQVVLLTAPTGYGKTTLSLSLANAVISGNRELAERVIHVLPLRSIGDDLFIKAERTFRGLKPFRKYVGLQHMGRMDSPLLGRRFNITTLDTFVLSFFKLPPYELHKVVNKYDAHYEVSRGFILSSLVVFDEVHLFLTETKSAIAFVTSLESLVESNVPVVLSTATLPVSHLKELRKRVEAKGGELLVVGPKADDSPKREVRVVPFTGDWLDKAKELSEEKSLLIVTNTVKRAVEFFKDLKNAGLFPLLLHGRMTERHRQNVLSRVLGEDRAMSPGTILVATQVIEAGVDISAGSMITEVSPVESLLQRMGRVARYEGESGEVYVIRSSDNVYEGEKVDEAWKMVENGKLEVPQGDVLKLDNSLHRALWELHRNVFTGSKTALKLLEEECSFTRSGELIKVVPEERLASVDEGDYLALERGTLKRAKEKIVGGLRRGPEGVERVQLSEDFYRILEGGDPPCLSLWMMRNRIDSLVVKGYDEEVGFVG

SEQ ID NO: 12597 - protein, 722 aa, Geobacter metallireducens RCH3; identical to SEQ ID NO: 11562

SEQ ID NO: 12598 - protein, 786 aa, Methanotorris formicicus Mc-S-70
MILAKREGKVFQTLKGHTYDALKIYKEYLERNFDVVDDFCNRWQIPTEKFIRNTFFTIYLHDIGKITEEFQNNIKIGKRSNKHPHPLYVLPIINNIEFDYLLDIPIEVFAILSHHTQLYDNLYADYQQYKKGTFLIEEIKNFIKNSKDAYYSLGFSKFFEFEELEINKIPKDAKPLELHKLRRKYWIETNNYIKSLSFDEKIKIKSIFSFMFSILQLCDDFASLNFSEYAKDKEGTFDDVLENSKIYVPTLNIENPISFILKDYEPYKFQKELYNSKNKFVMLFAPCGRGKTEGALLWALNALKNFKRNKIILAMPTQVTSNAMYDRLIKIFGEENVGLFHGKSFIKLKDSKEVGDEEDLEEIMDENFKGNVFFKPITITTIDHVICSFVHGFSQADFALGNIQSSVIIFDEVHYYEKYTLEHLLTLFDILRKMDIPHLLMSGTLPSFLINCLEGYEIVVDEDGLNYKPFKLECSENHLIWKEDGEWKVNEDIINEIIENYKKGLSQAIILNTVERAKEFYKAIRDKVPAILYHSQFAYKDRVKKEAEIFNLEEMRKILNKPYVIVATQVIEISLDISVDIMYSELSPPDALGQRAGRLHRKGKNWKENGKEYKLKIFFPYKHLPYNKELIEKTINYIKSYGKPLTYRDIKNFVDDVYKDYNLDTPSDLKLSFDEAILFGRHWTDIATEDEEGKFFRVRDEKFIKIDVVPQVYFDRLGEDALKTEYLAKIPLYLIMNELKTGELSHFQQFEKRIGRKSRKYWICSFKYTYEIGFDYKEEEEFEDIL

SEQ ID NO: 12599 - protein, 925 aa, Leptonema illini DSM 21528
MHYLRFWGKADGESGRWRPLVLHMLDVAAVARQWLLRHPAFVHDWARRLQVERDVLADLVTFLTAIHDLGKFALDFQFKIPQLATLLTGRTGISYASRASHPSSGFGFWDASIWGQIKDQLSDLSSDDMGVLNRSIRPLLTASFGHHGKPVEALDPSTPPPLRQLYDDKVQLAAKAYIDDLLHLLPGSLTAMQQWAKTRSVRPELARFSFPLSGLIILADWTGSSSDNFPLNLPFTKEHASEFDLKKAFSESLELADAALLRQGLVAVPRRKLTNPWEELFPTFKPYTPTPLQTAMLQATEGRGPALYIIEDIAGAGKTEAALLLTASLMDKENVEGFYFALPTMATSNGMYSRLAAIYSNYFAAGSNASLILAHGRPELNAAFQDSLLPEHSRVTDVEFNATDAEEQQTTKAACNTWIADRARKAFLAQVGVGSIDQALLSVIYSKHNTLRMFGLSRKILIVDEVHAYDAYMQELLESLIKFQAQQGRSVVLLSATLPVSMKESLGAAYLSGCNGQGDEPEVNLREEMHYPLITIVESGKVDFIPIEPSARHCRSVGVEFLTSEDGAIEPVVERLAEISREGRCAVWIRNTVADVQRAYDQLSVEIDADKLFVFHSRFAMGHRSDIEERVLRTFGKESTSAERAGRILLATQVVEQSLDLDFDEMITDLCPIDLVIQRVGRLRRHARDQSGNRIDTVDGRGVGTVIIFGPDPDTTIEADWYMGCFPGGAKVYQNHGILWRTASVLKRERQIEIPARLRYLIEAVYGETETPHALVEQSHRAHSADDKAGFTAQTNLIDLEKGFLQSSDLNPWPDHSAPTRLTDETRTYRLCLLEGSTVRPLVASNDQSFALSEVKFRPVEVVLPSELRRIIEEAERRLPDQGRGGSLLPFEQLEQGLYRSLGETTKQERFVYSEKLGLRLEAQK

SEQ ID NO: 12600 - protein, 918 aa, Mucilaginibacter paludis DSM 18603
MITISNSIETFAGLKKAYYKADGIKNAAIYWAHTHSEKKPEPFNDHNELVLHYFTQLAQDHHLEQVIDKLIFDSLPAGATNPELGTFIKLLFFNVPVYHDYGKVNENFQLERMRNKNPLFKKKPNLIDSQHSILSAYIYIVHHLKLASSLMLNGDEKMFVYGLIFGFSYPIIKHHASRLSDVKPDVDFKEELQIHLKFYLELFDFEDCGEFYKHPAFRNTEGKSQKDRCFDGLFDLPDRKGFPLFALLKLNFSLLTAADYLATHEYMSDSKTIDFGVFCNRSRINEIVSSLRSYKHNRNTFDTEKAYHFKEADLQDCSNENLNLLRQEMAVELIHTIRKNSDKRLFYIEAPTGGGKTNLSMIAVTELLEANPEINKVFYVFPFTTLITQTYQVLKETLGLTTNELTELHSKANPKSKEEKSDGEFGDEKKDYIDRLFALFPVTVLSHVKFFDILKSNNKEVNYLLHRMANSVVIIDELQSYSPDIWDKMLFFISQYAQYFNVRFVLMSATLPKIGDLQLITEKNEFVSLLPNAIKYIRNPNFSKRVNFRFDLFEGEIELDTLADAVITKSEAYAASNLRHKSVHTIVEFIFKKTATEFHQLISEQSNPYVQILVLSGTILESRRKEVINFLKNPANRNKNILLITTQVVEAGVDIDMDLGFKNISLIDSDEQLAGRVNRNGNKLNCEVYLFKVNEAKLLYGKDKRYQVTREKIDLALYERILKEKDFRFLYNEVFAQINQDNALNYADNFSGFSDYVDKLNYEKVNREFKIIDQNNVSVFIPLALPLTIAAAGEGRLERIFEAADLDFLERFGGYNHGDEEVDGQRVWEVYKLLINNKPQGFDLKAQIDFKSLQRILSKFTFSLIQASKDVTNIKDGFGREEYGYVYFSHCDEHRSEGRLYDYHTGLNSKAFNDSYFI

SEQ ID NO: 12601 - protein, 590 aa, Ectothiorhodospira sp. PHS-1
MVDDLPREAGLLLVEGPTGCGKTEFGLAYAAHLLATGVAEAIIFALPTQATANAMLNRLEKVAPNLFPGRKNVVLAHGRASRHEGYMALKEAGRRPTAQGKEDAAVQCADWLAQSRKRVFLGQIGVCTIDQVLISVLAVRHHFVRAFGVRRAVLIVDEVHAYDAYMYGLLTRVLHAQATAGGSAILMSATLPAYQRDLLLDAWGGEVPEQQSSAYPLISWAGRGTPVRYWDLQGEPAHLPESRTVFLECRERVDLRLSDQDIDQVIQAANEGACVAVICNLVSEAQGLWRRLRERSLNVPVDLFHARYLFADRQVIEQRVMEYYGRDRMAAGRILVATQVVEQSLDLDFDWLITQLCPVDLLFQRMGRLHRHPRTDRPAGFEDPRCTVLLPPDEQYGLHEVIYRYRRVLWRTHRRLQETDRITFPDVYRPWIESVYSEEAWLDEPEAVLQNWETFQNSALGKFFGARQLAEADMMPLQDTDANAAAMTRDGDNGLKVLLLQSMSQGVAYLDGRQESALDDFERREAEDLNAVNAPKGWKAALGNPDEHGRYRLILEPQADGSWSVGAMRYSREIGLEWREGDSSLPSQPQ

SEQ ID NO: 12602 - protein, 825 aa, Paenibacillus dendritiformis C454
MQSIAHIRVSDMKVQTVERHLLEVKTLAEEYGKKLNIPHVTGLAGMLHDMGKYTEKFRTYILAAVSGAEDRLRRGDVDHSTAGGRLLYKRFHNYSKEPYKVILAEVVGNAIISHHSYLKDFLSPDLESPYLRRVACKKLEEFDQSVEAFFTLVMSEQEFQRYVDQAAAEVEQFLVRVPAKSMELKLMFLTKFVFSALIDADRTNTRWFELGEPNEPEQNVTALFQGYYDKLMAQLHSFEENKDADTPIARLRSEMSELCERFAAKPSSIYTLSIPTGGGKTLASLRYALKHALTYDKKRIIYVVPFTTIIEQNAATVREILQDEANILEHHSNVVEVEMEEDDEEQDGLALTARQKANLAKDNWDAPIIFTTMVQFLNVFFAHGSRNIRRLHNLCEAVIIFDEVQKVPTHCVSLFNQALNFLKEYGGSSIVLCTATQPALQFVEQRLDMPEDAEMISNLDKVIDAFKRVDLIDKATERPWSTEDLASFVRDTVQEAGNILVILNTKSVVKSLYERLQAMQEQHQFGEEIFLYHLSTSMCAAHRFAILEKVRAHLEAEEKVICVSTQLIEAGVDVSFNCVVRSLAGLDSIAQAAGRCNRHGKDEMRNVYIIDHAEENLKHLKEIQIGKELTRAMLVDMERDAKAHGGQLLSQQAMEFYFQKFYMRLEADLNNFVPKLRKNMTDLLYAGRYETDSYFQAYRKKKEEEKAKDTWLPLVLANSYGTAAKYFHVIDDYTRAVIVPYGEGGKKVIADLNGSGTIDDLTRLLKRAQQFTVNLYEHDLRQLDRSGGLESCLDGKVLVLKEGAYSEHFGVDLSSDSAMGFLGCF

SEQ ID NO: 12603 - protein, 857 aa, Megamonas funiformis YIT 11815
MEADILKNLVKNLNRYKAHKKSKDNEIIYETLLAHTELTNKYFFKFWQSKNSDEIFDRFCDVFWQKENIDNKLKNKAKDLLKEIIMTIPIFHDIGKVNPNFQLMKLKVNDFKENEAYVNTHHSFLSSMFYMDYCRKLVYDEKNEDEIVNLLAEFILYNGYIIARHHSELGSLTEFTKLINLDDDTYFSKLKRIINNEDIYSVKIDFIKSDIEDMFRNLNKVDKDAEKVGKRSIKQGVYLSIYIRWLYSLLVASDYYATSEFMNEADFSENTDLNDIDKWDSVYENTDLLKNIRQYQQERYPISNEELNTVTDINILRSEIFCEVEEKIKANTDENIFYLEAPTGSGKSNTAINASFKLMQHDKRLQKIFYIYPFNTLVEQNLETLEKVFADNEDIKQNIAVINSITPIKVSEKDLNDNEEKDVYQKALLDRQFLNYPMILSTHVSLFNIIFGNRQSDVLAFYQLANSVIVLDEIQSYKNKIWAEIICYLKELAKMFNIKIIIMSATLPDLDILSRFQAQAVDLLENSSRFFAVDCFKNRVKLNYDLLKVDKDSILDELKTHLKQYLKSDKKILIEFIKKKTAHDFWVDLQENEDFKDVQIEYLSGDDSIAERKRILDKVKKATDTIILVSTQVIEAGVDIDMDIGYKNISKLDSEEQFLGRINRSCKKEGIAYFFEVDEASDIYKDDVRLSESIVLKDVNMQKILELKLFDEYYKKVLETTMGKYSYHFDEFIKDISDLNYESISTHMKLIDDTQDMVQIYIIRTLCVDGEILDGKQIWDSYVDLWENGRKTMSYAEWKIELSRITSKMNNFIYQVSKHNLRIGKFYEQMGNITCLEDGDKYFIKDKFNREILYIEN

SEQ ID NO: 12604 - protein, 492 aa, Thermococcus litoralis DSM 5473
MRAFREALQKLAKAKGFEPERRPLLEEAFHFITSSEKPPFLILQAPTGYGKTLLSFALAVHSLWDASIFDRVIHVLPMRSIIEDIQKTAEEAFGFSRTKMMGSSGEFLHLFPLNITTADTFTWDLLKLNTKKRHRVKAGQEFGYDYLTQASILTSLVIFDEAHFLLEDESMVTAFLSVIEFLTSQKVPIVVMTATLSEAHRRIFEKYAKKNGYDFTVLSPQENDPFIERELKKDIKIEFRHGDPINFVEHGKRNAVIVNSVARAVELFDRVRNNPNIWHESERVMLIHGRMTPTHKRELIDRLRRWIKEGNFLLIGTQAVEAGVDFSVDLMITDKAPINSLLQRFGRVARYGNETKAKIIVLEDAPCGPYPRDKVEKTVELMKGNRVFSRVPKTYQGIVTEVHGKKPTSITKNVNKELEGKLLRLMKDPTKRAPHVLSAIESLTAKGISVMRGFLIPLLVGEEAVLISPSKLMELYSKGIVEVRGWKGRYGT

SEQ ID NO: 12605 - protein, 547 aa, Bifidobacterium breve CECT 7263
MENTADGYLAAPDKRPIDIRRCELLERCLDCGKDPSYGTGLYTLTAPTGSGKTISSIAFALEHARTNNLRRVIYVIPYTSIIDQTVGQFEAIFGMDAVLPHYSEAPYQLKNESDMDEMDLRRVLAAENWNAPIVVTTAVQFFESLYSNATSRCRKLHNIADSVIVFDEAQTLPVPYLRPCVRAIAELVERYGSTAVLCTATQPELQPLFDESFDGDHVRVPEISPFTRDDRDSFRRVTIERLGDIALDALAERLGNHKQVLCVVNTRSKAQYLHDRLAEDDAEGSFCLTTLQCAADRQRLFAEIRDRLDAGASCRVVSTSLIEAGVDVDFPIAYREEAGLDSVIQTAGRCNREGRRSASESVVHVFSTEGGCAPFLRQNIAAFRAVADRHADLNTDEAVRAYFAEVLCLRSGGVARANVGNDALDRKRILPLHGRDANWPFADIAKRFRLIDTPTIPVYIPLPGDGALLCERLERGDMDRTLFRKLGRYAVNVWPRHLEQLKSVGAVSTVGSGKNDEEDCFVLRDMGLYSSRLGLRLDGATADGIFV

SEQ ID NO: 12606 - protein, 730 aa, Escherichia coli DEC6D
MDELDNFLPEDKAAARDFLLEIKPLFPLIEIPAFWDDDEGIELIKHLSWYISATVVLADWTGSSTRFFPRVAHPMDIKGYWQKTLIQAQNALTVFPLKAKVAPFNGINTLFPFIENPTPLQQKVLDLDISQQGPQLFILEDVTGAGKTEAALILAHRLIAAGKAQGLFFGLPTMATANAMYDRLVKTWLAFYSPESRPSLVLAHSARTLMDRFNESLWSGDLVGSEEPDEQTFSQGCAAWFADSNKKALLAEIGVGTLDQAMMAVMPFKHNNLRLLGLSNKILLADEIHACDAYMSCILEGLIERQARGGNSVILLSATLSQQQRDKLVAAFARGTEGQQEAPFLEKDDYPWLTHVTKSDVNSHRVATRKDVERSVSVGWLHSEQECIARIESAVSQGKCIAWIRNSVDDAIKVHRQLLARGVIPASSLSLFHSRFAFSDRQRIETETLARFGKYCSLQRASQVIVCTQVIEQSVDIDLDEMISDLAPVDLLIQRAGRLQRHIRDINGQLKRDGKDERSPPELLILAPVWDDSPGDEWFGSAMRNSAFVYPDHGRIWLTQRVLREQGAIQMPHAARLLIESVYGEDVVMPEGFARSEQEQVGKYYCDRAMAKKFVLNFRPGYAANINDYLPEKLSTRLAEESVSLWLATCIDGVVKPYATGAHAWEMSVVRVRRSWWKKHRDEFSLLEGEAFRLWCIEQRQDPEMANVILVNDDESCGYSATEGLIGKVG

SEQ ID NO: 12607 - protein, 895 aa, Pseudomonas stutzeri ATCC 14405 = CCUG 16156
MARNPAYSYSNLSDSARRIWAKSGESGGHGLLAHLLDVAAVVETLLVIEPESTRRWAAREFGLEPSQIIRWVAAVAGLHDFGKAIPGFQAKWLEGMQVDQSLGLAFPASACSRSRHDLATAALLGVSLNGLAVADVGWLRHAVQAVSAHHGYHFLPAETDQGRPLNEPAEWRQTREDILLSYWQTLAPDGAPALDELSLAAVNWLAGLTSAADWIASNPEWFCLGERSIDDLRDYYRNACVLAQAALTRIGWHRYRPLLPQSMETNDLLARIVGRPELSARPLQLAGDRLLQAVQGPSLLLVEAPMGEGKTELAFLAHLRLQAANGHRGLYVALPTQATGNALFKRTLTFLDQFAEGPLDIQLVHGGAAMNEEVQHLRGIDHSAAESLSASAWFSQRKRPLLSPYGVGTVDQALFAALNVKHHFVRLWGLGNRVVVLDEVHAYDTYTSGLIAALLRWLKALGCSVVLMSATLPLARRAELLRAWGVELCAVPDLAYPRLLLADERGVCGEHFTARQLAPIHLTGLGESLEVLAETAVELLAEGGCGALIVNTVDRAQKLYAALRQRLGDEAQLLLFHARFPADQRGEREREMLARFGADGDRPVRALLVATQVAEQSLDIDFDFMLSDLAPVDLLLQRAGRLHRHDRPRPSRHAQACLYVAGLQADQLPELKETAWGYVYDAYILLRTWALLRREACLTLPADIDRLVQAVYGDEPLPDDLDEEVCARIEIESYGEYLARVQKERRESFNIAIDPAEEPQRAYNGKPRGSEEGEGVGLENKTRLGTESVTLIPLEMVDGGWCVRLGEAVFPLDGPLSDALARQLYNRQLKVSRMALVKRFKCDQLPAAFEHPLLRNCYPLPLQQGRYVHDGLRLRLDDHLGLVYEPSDGTNEENA

SEQ ID NO: 12608 - protein, 596 aa, Candidatus Arthromitus sp. SFB-2
MKYTEKLARRIEKEDGKIEYQKLIDHICGVSEFSEEFVSKFFLKNSGKILSILHDLGKYSDEFQDRIRGANIRVDHSTAGAIICDDLEKEFKGRGEYVIYKIFKYIIIGHHSGLLNYGTEMDDEGTISSRLNKRDILCDFSDWENEISIDDIKQINFSEEVLGFFKNNFSVQMLIRFLFSSLVDSDRLDAQRFVEGENSIVNSKKLMSLEEMLNVFNDFMKSKRLQESDNPINLIRNEIFNDCINKSRGDRGFYSLCVPTGGGKTLSSLGFALNHAKQNGHDRIIYSLPFTSIIEQNARVYSEIFGEENVLEHHCNFSFSNEIGEDEYSENQLKYKLAIENWDMPLIVTTNVQLFESMYSNKPSSARKLHNIYNSIIILDEAQVIPNEYLKPCIKALEELVRNYSCTVLFCTATQPEFKKNGLIENFDVVEIIDDTYKLFDDLKRVSGKFIGKKSVEDICNEMNSHKQVLTIVNTKKHAKEIFENLGESEGNFHLSTNMYPNHRKEVIKIIRERLKNGEECRVVSTQLIEAGVDVDFPVVFRSIAGIDSIVQAAGRCNREGKQKNSTVYVFKPEEESHLGLGYLKLTSQIGEGIID

SEQ ID NO: 12609 - protein, 743 aa, Candidatus Arthromitus sp. SFB-4; identical to SEQ ID NO: 12061

SEQ ID NO: 12610 - protein, 743 aa, Candidatus Arthromitus sp. SFB-5; identical to SEQ ID NO: 12061

SEQ ID NO: 12611 - protein, 743 aa, Candidatus Arthromitus sp. SFB-co; identical to SEQ ID NO: 12061

SEQ ID NO: 12612 - protein, 743 aa, Candidatus Arthromitus sp. SFB-mouse-SU; identical to SEQ ID NO: 12061

SEQ ID NO: 12613 - protein, 773 aa, Treponema saccharophilum DSM 2985
MDLIAHKTEEGLEQTLSEHLKNVAERSSFFAESFCNADWAYFAGMLHDLGKADSDWQKYIRGEKSTSVNHSEAGAQFAYSKMDSRDFFSKVIPYLIAGHHAGLPDWHEGSGNSLKSILEKSDISYLEKLLSNSKLKENVESFLPKSMPFGKNDLKKDNPQELLEHFHLWIRMLYSCLVDADFLDTEQFMQSEQSGLRGNYASLEELKQRFDVFMAEKTKSARPSKINEIRSSILESCREKGKLEPGFFSLNVPTGGGKTLSSMAFALEHALAHQKKRIIMAIPYTSIIEQTAKVYKYGTDNDDEIEEFKKSGKCLFGEENVLEHHCNFDFDKDDENGILAKQKLATENWDAPIIVTTNVQLFESLFNAHSSSCRKLHNLVDSVIILDEAQMLPPEYLKSILSVLRGLVKCFGVTVVFCTATQPALEGKIGSDVASFDGVPADSITPIIDNPATLAEQLKRVEINTEYAKEKMTDWQTVADKLCEFEQVLCIVQTRKDCRELHRLMPAGTIHLSALMCAEERSDVIAEIKERLRDGKTCRVISTQLVECGVDIDFPVVFRAIAGLDSVAQSAGRCNREGKMECGTVYLFNPPTNVPAGLLRKGAEVTKELLELHDYTLSLTPDLYKEYFTKYYKSLNDFDKCEFEIRMQAYKANIRKNRDGCLQFRTLSDNYHLIDNAYQATVYVRYCSSRTGKDNINLLTALEVCEIDKSLFRKLNRYSVNLPLKEIKELVKEGRVLEPIDGVFMQSLDDANLYQAGLGLVADSVKSFETYIF

SEQ ID NO: 12614 - protein, 750 aa, Hungateiclostridium thermocellum YS; identical to SEQ ID NO: 11589

SEQ ID NO: 12615 - protein, 750 aa, Ruminiclostridium thermocellum AD2; identical to SEQ ID NO: 11589

SEQ ID NO: 12616 - protein, 749 aa, Thiorhodovibrio sp. 970
MSSKKGFLAHARLDNQGRWHFHLLDDHLKAVARLASDFALLFGSSDWAAAAGLWHDLGKFRPRFQRYIREAVGLDPETAHLETRPGRAPHSTAGALLAERDMAIAGRVLAYVIAGHHAGLYDWDGGLKERMAGDDARDELAESLAAEPPPDILHPALPPRDLRQVPGGKEGFSLWVRMLFSCLVDADFLDTEAFMDPPQSERRAHWPELASLGPAFDKAMKALAEQASPTPVNQLRAEVLAHCRQAAEMEPGVFSLTVPTGGGKTLASMAFALRHAQRHGRRRVIHVIPYTSIIEQTAAVFRGIFGDAVLEHHSAAEATPDTENLRSRLACENWDAPIIVTTSVQFFESLFAARTSRCRKLHNIVNSVVVLDEVQLLPPALLQPIVDVMNLLAKHYGVTFVLATATQPVLGSRRYFDSARHFDGLDNVREIIPNPDALYDQLRRVRVRLPLDWRQPVSWETLAEELSHHDSALVIVNSRRHARELFRAMPPGALHLSALMCGAHRSRVIRRIRQRLADGVPTRVVSTQLVEAGVDLDFPVVYRALSGLDSIGQAAGRCNREGRMKQGEVVVFIPPEPPPAGLLRAAEDACRTTLHGIEDGDPLARSRFADYFERLYYSRDLDAHGIRRLLSIDDPKALNVQFRGAAEHFQMIEDDDSVSVVVLDRDTENNDIDMLLGSLRKNGPDRWLMRRLQRYMVTIGRRDALRLLDQGDVEEQVPGLFVQISDWLYDADLGLITEGAAPRPAQTIV

SEQ ID NO: 12617 - protein, 926 aa, Streptococcus oralis SK10
MSKKKSDTLWAKKKEENGRFFWLPLSQHLEDTKNIIGLLWEHWLSEGQKKLIEDSLDSVTHDDGLGKRLAQFLAAVHDIGKATPAFQTQRGFANSDDLDIQLLEKLEQSGFTKISSLQLSSPKKSHHSLAGQYLLSSYGVQEDISTIIGGHHGRPIDTIEDVKNQGSYLSNYFQNESKESAIHKNWDLVQKEIFNCALDELGFDSVRELPRIKQPAQVILSGLLIMADWIASNEYYFPLLSVNEKEEVDKLRRLQDGFERWKKTSLWQPKYISKPDSLYKERFGFEPNNVQSTLSHVITQISKPGIVVLEAPMGLGKTEASLITAEQLATKTGRSGLFFGLPTQATSNGIFNRIEKWVESLKDDSEDILSIQLVHGKAALNEDFLKLKANTFNFDDVENGSVIINEWFSGRKTSALDDFVVGTVDQFLMLALKQKHLALRHLGFSKKVVIIDEVHAYDAYMSQYLMEAIKWMGAYGVPVVILSATLPSQQRENILKSYMSGMGIKWRDIENTDQLKTDVYPLITYNDGSEIYQLTTFNKQNIKDIHIIRLQEEQLLGTVKDALEGSGVVGIIVNTVRRSQELARNFSEIFGDDMVELLHSSFIATERIQKEKELLQQIGKNVDRPHKKVIIGTQVIEQSLDIDFDVMISDLAPMDLLIQRIGRLHRHQIDRPQKHEIARFYVLGTSQELDFEEGSSFVYGDYLLARTQHFLPDIMRLPDDISPLVQKVYSPDFTIEFSSQEFQQKYLDAKTEHDVTIKNKETKARTYRINDPVLKISRHRNNSLIGWLKNLHPNDSEEKSNAQVRDVEDTIEVIALKKMSDGYSLFIENQDISQNIDNPSVAKKVAQNTLRLPMSLSKGYNIDQTIEELERYNNSYLSQWRNSSWLKGALGIIFDENNEFILNGFKLLYDKKYGITTERLNKNESI

SEQ ID NO: 12618 - protein, 756 aa, Mycolicibacterium phlei RIVM601174
MHRELIDLMVERTGVAAYLDGWAEVKLPASFQVLASGVAVLADWIASNEHLHPYFPGGAADPGNRSGVGRLHLPSPWRPKTDGIPVAELFDRRFRLPDGAQPRPVQLAACEVAGQMPEPGMVVIEAPMGEGKTEAALAAAEIMAHRWGAGGVQVALPTQATTDAMFDRVVAWLDTMEAGDQPVGAITLSHGKARFNRLFRGLVEAGVPVEIGCDEVQTDEGHVHDHSVVAHSWLAGRKKSQLANFVVGTIDQLLFAALRARHLMLRHLALAGKVVVIDEIHAYDVFMNSYLLKVLTWLGAYGVPVVALSATLPADRRGELLAAYQRGRVGEHATPDGEPKAGYPLITWTEGPRTVSRPVEPSARRLTVHLGRLRGGADDEASLIALLRDRLSDGGCAVVVRNTVSRVLRTAASLSVVFPGEVSVAHSRFIAADRMRIDAGLLRRFGPPVVNQQRPQRHIVVASQVVEQSLDVDFDLLVTDLAPVDLVLQRIGRLHRHLRGVGQCDRPEKLRTAQAFVTGVDLEQGPPRLDPGAAKVYGEYPLLRTAAVLRDRFGGVLELPTDIAPLVAAVYGPERIEPDGWCAAVDAAHATWCADQDRRAADAQKFQIAAPSKPGKAILGWVSGSVGETDDDAQGQGQVRDGEPSLEVVVVQHDDAGNWHTPAWLEPGRRARPVPRDEAPDDELAAVLASCTVRLPASLSDERSERALRAATPRPWASSPLLYRLPVLVIDRDGWGEIAPYTIRYTPERGLEVRRP

SEQ ID NO: 12619 - protein, 827 aa, Parageobacillus thermoglucosidasius TNO-09.020
MYLSHNNPDKKLTVHLKEVYEYSQDMLKHVPLSEENRDMLEYISKIVAVAHDFGKYLSYFQDYLRTGETNGDLHHHSFISAVFAAHLLRHPANLNASWSEFAPLLGYFVVMHHHGNLRDISLDVTKSRHIVENTVQDSLYYRVNTLKQQIDDIKNHASAIVEDLSPLWDELSIPLSLSAELHSFLQNYEKAFDEVYRQYYLIDKRRKQELTRELYYYVLLLYSVLIDADKLSAANIERKPRVHIPAHLVDQYRETNFDVNVTEGTNGWRNRMYNVVMERIEELFKTKPEQRLFTLTAPTGAGKTLLSLSVALKWREQAERQYGYSPKIIYALPFTSVIDQNEKVIRDLLSQLDDFHANEQRYLVKHHHLSTFQYRTENEELPLRKALLLTESWEAELIVTTFVQLFHTLIGYENRALKKFHQIAGSIIILDEIQNVPMEYWPLLRSVLYKMAELFSCKILLLTATQPLIFPEGETVELLESELVKPIDFFKEMERVELHWLGGDKGAYSPAEWMELFQNRFEDGKTYLAIFNTIKTSIEIYEGIKKWLKERGYDVIYLSTNIVPCERKRRIEQVRQLLKEKKKVVVISTQVVEAGVDVDFDVVYRDLGPIDSIVQAAGRCNRNGKLHELGKVYITPMEREGKLESQYVYGTVHTKIAKEVLPKTTVSEHQFFDIIVQYFTDVRGNKAFTASDGIIGAMEELKFDAKDKRGSKNEPEYVSEFQLIEDAHQAVDVFVEVDDQAADIWQQYIQQVIEEKDFETRFENYLRLKKDVRQYVISAPIKLVKNLDRDLYEKTRMIHLANDILNQYYNSEYGLIRTSEMVDAWIM

SEQ ID NO: 12620 - protein, 947 aa, Streptomyces tsukubensis NRRL18488
MGVPRAVADESIWAKSRGLDPGLPPYPLVRHLADAAAMALHLWDVYLSDGQRRTIERGLGLAGEPERARSLVGLCAGLHDIGKVSGFQFCSRHGREHLGTSFASGRRGMEADRLGHDVAGMEAAAEVLEVLGFDVEGSWATERVAEIIGGHHGRFHRNEAWGDSPFLGGLAWSQQRIAHASAVHGVLGAPVPPSSFDAPAAVLVTGVVILADWLVSQTHYLRTRQRQLASSLEAHFARSVADAPGLLEGAGLVPVCLEHVGFGEAYGIEGGPNPLQRSIMEELPGAVAGGGGRGGVALITTAPGDGKTEGALTAEKVLAEAFGTRGLVFLLPTTATSDQMYGRVSKALVRQSGQGAGLTLVHSMAWLNSAYSDEELDPGSGVVTCDGDECAAGSSRAEADMRPRRWLRGPKRPLLAQFSVGTVDQALMAVLPVRHNALRLLGLSGKTVVVDEAHAYEPYMQVLLGRLLNWLGVYGVPVVLLSATLPVSVSERLLKEYLDGSGADCESREDLPSSAPYPGWLYVDGATGRRTPMSGRRRREQAAERNMELGLRVEPVGERGRLAVVERLVEPVARGEGGSALVVCNTVGDAQETYRRLRERFDDRSHEDGGIVHLLHARFPGNVREARTRGVTDGLGRVGPRPERRIVVATQVVEQSLDLDADLVVSDLAPLALLLQRAGRCWRHENWWARHGYPGDRGRPGWARAPRLVVLDPLVGTGTVPKRWGEVYSEYLLRLTSARLRSLDGGVVSIPDDVQELVESVHGTGVESFDWDAPGGEYQQSWAAHAGTEAAERGQAALVAVPRAREVRGLHDLHKLPGTEDEWEAATRLGAPSLRLLCAYVQQNGRATLDLAGTELLPDPPKEQQGDTSIPVAAVRAVMRRTIPVSADWFRSAEANGLVSPPGSWEGHPMLGDVRVLYQPVRNGQAQTVDIGGMILRLDVDLGLVRA

SEQ ID NO: 12621 - protein, 769 aa, Neisseria sicca VK64
MKTPKEIQMTTYYAHSAQDEFGNLLPYEHWQTLQSHSVNVGEMAAEFARVFGVQEIACQTGRLHDLGKYSLPFQKRLEGEIEFVDHSTAGAKIAIERWGDVIGKLMAFCIAGHHAGLANGNGEGDNRHTLKDRLALQFGADIPALDNLWQQEIKLPETLSAPPLKADAHHPFFSYAFFTRMLYSCLVDADYLDTEAFYSNLENKAVKRGGYPDLNALQHNFNQFINAFRRRIAQAPEQTEAEKRNAALNRLRSEILDHAVEQATQAQGLFTLTVPTGGGKTFTSMAFALEHAKQNGMRRVIYVILFTSIIEQNAAEFRKAFGELGEQAVLEHHSTFDDGKLQNETTKDKLRLASENWDAPIVVTTAVQFFESLFADRSSRCRKLHNIAGSVIILDEAQMLPLNLLLPIMQAIKELAQNYRCSIVMCTATQPAVQAENGFYRGFENVREIAPKPTALFDKLRRTTVQHIGTQTDADLFAKLGEHPQMLVIVNNRRHARSLYDQAKHLDGTFHLTTLMCAKHRSQKLDEIRGRLKNGEPCRVIATSLIEAGVDVDFPLVMRAEAGLDSVAQAAGRCNREGKRPSENSFVWIFAPEEQWKAPPELAVQAAVMRLTADSFSDDLLSTQAVAAYFKDLYDLKGKELDYKQILQMHRNAGQSLDFPFQTIDDKFRMIESHMQPLIIPFDGEAENLISSLHHADHIGGLLRKLQPYTVQIPEKALAALYKAGRIEPINEKNFGKQFYTLIGLDLYDEVAGLSWEDTAFLKGESLVF

SEQ ID NO: 12622 - protein, 749 aa, Desulfovibrio sp. U5L
MGKEEALAGPWFAHSREGQPQATWQGLAEHLHGVAGQARDFAGRFGAGEWGALAGLFHDAGKYTEAFQRRLAGDGQRVDHSSAGARLAVDRFKGPGKLLAYCIAGHHAGLPDGRDNDLACLTARLKTALVPDPARTLADGRQAPGAFPFTPALGRTGFQCAFFIRMLYSCLVDADFLDTEAFLDQEKHAHRGGYPTLATMWERLTAHLAQFAAKAEPSPVDPWRAKVLGWCLAAAGDAPGLFSLTVPTGGGKTLSSLAFALKHAITHDRKQVIYVIPYTSIIEQNAEVFRKAVGLEAVVEHHSNYDPRRRTDKDAAEPCGDEGLGRRHELAAENWDAPLVVTTSVQFFESLFANRSSRCRKLHNITRSVVILDEAQMLPPALLRPCLEALRELHESYGATVVLCTATQPALNRREGFAFGLEPPREIVADVPGLFGALKRTRVVHLGKLTDDGLVERLREHGQVLCVVNTRAHARRLHALLGPGAGGFHLSASMCPAHRSEKLAAIRAALKAGQPCRVVSTQLIECGVDVSFPAVYRAEAGVDSVAQAAGRCNREGELEEGVVYVFEAADMPPPKGEISRAAQVGVSVMHRFADVLSPEAVEAYFQELYWLAGDKALDASVWDVKEKVSGIFDAFQGGVNTCNFPFRKVGEAFRFIESIYRPVIIPWDEEGEAIVEGLQHAENVGRLARRAQRYTVQIPPWEFAALEKDVALTCLRERFYVLTRPERYDDEEGLSGDAAGVFRAEDWIQ

SEQ ID NO: 12623 - protein, 724 aa, Escherichia coli 5.0959
MRKYPLSLLKDKNIVTFFDFWGKTRRGEKDGGDDYHLLCWHSLDVAAMGYLMVKRNCFGLADYFRQLGISDKEQAAQFFAWLLCWHDIGKFARSFQQLYLPPELKIQEGARKNYEKISHSTLGYWLWNHYLSECQELLPSSSLSPRKLRRVIEMWMPVTTGHHGRPPDRMDELDNFLPEDKAAARDFLLEIKPLFPLIEIPAFWDDDEGIELIKHLSWYISATVVLADWTGSSTRFFPRVAHPMDIKGYWQKTLIQAQNALTVFPLKAKVAPFNGINTLFPFIENPTPLQQKVLDLDISQQGPQLFILEDVTGAGKTEAALILAHRLIAAGKAQGLFFGLPTMATANAMYDRLVKTWLAFYSPESRPSLVLAHSARTLMDRFNESLWSGDLVGSEEPDEQTFSQGCAAWFADSNKKALLAEIGVGTLDQAMMAVMPFKHNNLRLLGLSNKILLADEIHACDAYMSCILEGLIERQARGGNSVILLSATLSQQQRDKLVAAFARGTEGQQEAPFLEKDDYPWLTHVTKSDVNSHRVATRKDVERSVSVGWLHSEQECIARIESAVSQGKCIAWIRNSVDDAIKVHRQLLARGVIPASSLSLFHSRFAFSDRQRIETETLARFGKYCSLQRASQFIVCTQVIEQSVDIDLDEMISDLAPVDLLIQRAGRLQRHIRDINGQLKRDGKDERSPPELLILASVWDDSPGDEWFGSAMRNSVNRPGNPGD

SEQ ID NO: 12624 - protein, 813 aa, Pasteurella bettyae CCUG 2042
MEHITPIAHIRQSDQKKQTVYEHLTQTAEITRKFANKLDLADVGELLGLMHDFGKYSIPFQKRIHRKNNLNYIDFDIDEPESNLPNKPDHSTAGAQWIYRHLRKFGVKNGIGELIGQILGLCIASHHGEGLIDCLTLDGTPKCFDRFSKDDSLSHLSEAEKNADLSILQRAESLASENLIKSLLSPIKAILKQQETHDKLKEFHLGCLTRFLFSCLIDADRINSSDFENEAQKDIRSLTSKPDWHIAINHLENHLANFAIRYEIDKIRRDISDTCLQRSSDEQGIYTLTVPTGGGKTLASLRYALHHAQKHNLDRIIYIIPYTSIIEQNATTVRDILGEDWILEHHSNIEPEKQTWQDKLLAENWDKPIIFTTMVQFLDAWFGGGTRGARHIHPMTNAVLIFDEIQTLPIKCVHLFCNVLNWLTTFGKSSAILCTATQPLLDKLHNPELGSLNLANNAEIIGDSIARNKLFSDLSRVEIHYKSKIAGWTVDEAGDFLLEKFEYSSSCLFIVNTKKCAQELYKYCKEKVPANALFHLSTNQCSAHRKDLFDKIKYRLKNNEPVICISTQLIEAGVDISMSYVIRALGGLDSIAQAAGRCNRHGEKQGKGQVYVLNLQEPNFAKVLPDIYQGQRNADRIFREFGEQDILQPKAMQQYFNYYFYERSDEMSYDISNSTSGSLLDWLSDNALNVYGNKNKNRAGKIPLLMQSFQSAGRVFQSIDAPTRAIIVPYGKGKQLITDLCGEQNSQEKHRTLAQAQRYSVNVFPNVWEKLQNENVIHKIFPDSEIYYLEEKNYLDEYGLSFDETGEMPFYGI

SEQ ID NO: 12625 - protein, 733 aa, Fusobacterium necrophorum subsp. funduliforme ATCC 51357
MEYYAKPNETIEEHNQDLQCARELLWKLGYIKSQEENKIVHEAIEHHDLGKKNEYFQRRVLSLKKKKFNPEMEVEHNVLSIYMINPKNYSKEEYESILYAVLFHHHYSDVVVTIDERKKDIARLLEGFSSYRLPMGFKIANLHTLKNQKLLGFLMKCDYAASGNYQIEYPNDFLEEKLERWRTSHSGFSWNPLQEFCYEYRMENIIAIADTGMGKTEAALRWIGNDKAFFTLPIRTAINAIYDRVSRDILHYENLEERLSLLHSSALEYYAKNLKDHELDIFDYHHRGKHLSLPLTICTADQIFNFVLKYKGYEMKLATLSYSKIVLDEIQMYDPNLLAAIILGMKTILELGGKIGIVTATFPPIVEYLMKKEIPDFSFQKEVFTSEDKIRHHVLTYEKRMGVDEITELFLKNRALGKSNKILVVCNTIKDAQKLYEHLLEKEELKEALFMLHSRFIKEDRAKKEKEILSFGKTDYIGEGIWISTQLVEASLDIDFDYLFTELQDLSSLFQRFGRCNRKGTKSVEEANCFVYLETEEGYLKEKDSSYGFIDKVLHTLSKEALIGYHGQISEKRKMKLVEEYLSYEKLENSSFLDEFEKAIKEYKNVLNVNKNEVSDLTRLRDIQNTTIIPFPVFQEYEEEIRELEEKLQKDEIPKEEKIHLREEMLKYTVEVPTYMLRDYEKALKSGNVDFMPVSPVKISQYDKIVILESLYDEMRGFQAKKFIEKNITFEFM

SEQ ID NO: 12626 - protein, 993 aa, Rhodanobacter denitrificans
MNLTPERFGDFFAALHPRQQAFPWQARLCCAVMQGEWPHALSLPTATGKTSCIDIALYALATGAPRAPRRILFVVDRRVIVDEAFQHANDIAHRLRHADNGILREVADGLRERRGTDPSGDTDPLACFQLRGGTYRDNAWARTPSQPTVICSTVDQVGSRLLFRGYGISDYLQPLHAALIANDTLILLDEAHCSNPFRQTLEAIAKYRTLSESPALPAPFAYALLSATPRAAGEDGAGTPASFGLDAADEANGTLGRRLSARKPARMIELGERTATVQFADRLVEQAKALADTGATRIGIIVNRVRSAQLVFDRLSALPAQKALLIGRMRPLDRDASIRQWHDTLRSGSTVSPDKPVFVVATQCIEVGADLDFDAIVTECASLDALRQRFGRLYRLGEPDGADPQTHPPGIVVIAKDSLKDDDPIYGSALRNTWAWLEEQADEQGRVDFGVSAMKLCLEGGAPTQTLVEAIDAPIMHPAYLDQWVQTSPKPEHEAEPSLFLHGTRDDSPDVHVCWRADLDKDTPEAWADVVAMCPPSVGECMSVPLVQFRRWMRGEKDASAGDVEGFDASDNAAESDGEAIDRSVLVWRGDQSFVADEPRKIRPGDTLVVPAMRRGWNSLGYAPQADEKNIDLAEQAMLQARWRLVMRVHPTLLDRFEGPSRQRLADLLKQQADTEETDPDIVDVLDALADALTPLDASANANADWRSIAARILDTRQGRSSLRIKKYPGTNGSHGKGWVIERRHPLPRQLMQNLGELARSGDFTTEDDSSSFTTVVPLKKHLDGVSTFAHAYATACGLPASLVDDITLAASLHDLGKADPRFQSMLRGGAPTFTSGTFDGLLAKSSGAQDRRSRDRARRRSGYPEGGRHELLSLKFAQSSDEVKVLAHDLDLVLHLIASHHGRCRPFAPVVEDAYGCELTLADNDRSYRYTGPTGAERINSGISDRFWRLVRKYGWWGLAYLEAIHMLADHRRSEFEERTASEPEGEVNNDE

SEQ ID NO: 12627 - protein, 702 aa, Eubacterium  cellulosolvens 6
MYLAHISDDGREQSIKEHLEKTAEMAASFAKPFCMEKQARIAGLLHDIGKYSAGFQKRLQGGPKVDHSTAGALEAWAKRFLVEAFCVAGHHAGLPNAGSSVEIDGASLNARIKRAKQGGIESYEIWKDEISLPQCDEEKLKDLLALSYKIRMIFSCLVDADYLDTERFMSGYIDRGRPFEIDELENALNEYIEPWFPANNDLNKLRCEILDHVMNEGMQLERGLYTLTVPTGGGKTVASLAFAIKHAKRNGMSRIIYVIPFTSIIEQTADIFRTIFGDEVVLEHHSGVEYEENEESLFYLKATENWDMPVVVTTSVQFFESFYKNKSSSSRKLHNVANSVVVFDEAQMLPVSYIKPCVALMTELVKRYKASVVLCTATQPSLNRIIEEFDPDYKEHELCPKEYYDAELFKRTTYKYDEMYTIEELVKLICQNEQSLCIVNSRRAAQQIFESMHGEGCFHLSTNMYPAHRKKVLAEIRLRLKEGMPCRVVSTSLIEAGVDVDFPCVYRQIAGIDSLLQAGGRCNREGKRDRSESVVHVFDLEEGSPEIFSIQIGASKHVIDKFDDIASKDAIHAYFEQLFYLKGDEALDEQKIIKQLRDSKLPFADISKQFNLIDNKTRTLYVDVEESKDLLEKVRMGIATKNDYRKLGLYGVNIYEYQYLKLLEHSAVELLDDGSVILIDSSLYSSDIGLHLEFKNGEAIMI

SEQ ID NO: 12628 - protein, 734 aa, Desulfobacter postgatei 2ac9
MIEEYQRLDKRVQKWLFNQGWPDLREIQKRAIAPILSGDRDVLISASTAAGKTEAFFLPACSAIAEEENGFGILYISPLKALINDQYRRLESLSEMLDMQVTPWHGDSLQSKKKKARNNPSGILLITPESLESLLVREPGWVKQSFTSLKYIVIDEFHAFIGTERGQQLLSLLIRLEHITGRISNPIPRVALSATLGELEKVPHSLRPNNSLPCETITSSKQQSTIKVQVKGYLEPIDIMADETRTSAEQRICQEIYKLCRGDSHLVFANSRSRTESIAAQLSDLCEQQVVPNEFFPHHGSLAKELRETLEARLQKETLPTTAICTMTLELGIDIGKVSSVIQVTAPHSVSSLRQRLGRSGRRNSPSILRMLIAENELSDKSNIVDGLRLELVQSLAMIRLLIVENWFEPADTEQMHLSTLLHQILAVIAQWGSVRADQLYSLLCEQGSFKEISIHHFKTLLSHMGTVQLIQQLNSGELVLGSEGERLTNSYTFYAVFKTPEEFRIVAGSKTLGTLPVDSLILKDQHIIFGGRRWKVTDIDDEKKVIYVSATKGGKPPKFNGSGMSIHDRVRQEMLSIYRTGDYRIEIGNQKIDFVDNPGRQLFIEGAYFFKEANLEYQPVYQNGKHCYIFSWMGDKVVNTLAVLLIRSGFLCSVFAGVIEVQNSNADDIKNCLIDIANGVLPDETELSRTLSIQQKLIEKYDEYLPEELLTVGYGRKSFNSRATKQWILGSLV

SEQ ID NO: 12629 - protein, 908 aa, Desulfobacter postgatei 2ac9
MIFPISKKTKGELTAIPYTKCYAKTDKNGKPGICVESHLRHTAEVCRILRQQLTENLTLLGDLAIPSASVHDIGKVSPGFQLKYFRDAIIKQISEYRDKPAGHFLTDHAHIGACALWAHVNKEDPFQCPTVAQIAAMHHGSVRTEPLPKDSGELLGGAAWSEERKNLIKIMETEYGRLTFHVPSIVQRDFISGMVTISDWIGSDESFFPPAGLPPEVNINTAAQMAVSACGLIKPAIIPGLSFEEVFEFSPYDIQKQFGASIMNYGKPGVFVLEAPMGMGKTEAALYAAYLLMASGKNSGFFFGLPTRLTSDRIHERLDPFLKKICENKTGARLSHGTAWLKAFWHSSFEKGGEDFKPGNSWFNPRKRALLHPFVVGTVDQALMSVLRVKHHFVRTFGLAGKVVILDEIHSYDGYTGTLIETMASQLTQIGCSVIILSATLTKKRLSAFFKESQPVKERENIISQALDESFNSIDSVPYPLISGPEYALASPPPKGQEYKIHLEEMSYFKIAKHAIDKAIQSQCVLCIANTVATAQTWFDAISAEMPDDAFPIGLLHSKFPGFQRAAIEDLWMIRLGKHKKDEHENLRPNGCILVATQVVEQSVDIDADYLITELAPTDMLLQRMGRQFRHDRKNRPCTIPETLILCGNPDQSDNLDGVLDAFGRSNCHVYAPWVLWRTRDVWKKHHTVNIPDDIRTLLEATYEELSKQFSKKAQLMDDLHSKFVQHKNALADKAMGNLSTATAMPVGEDHETCATRYSDLPTTQVLLVQDINSTGNEAQLTLLSEERVMVNAVRPDPAVTAQLHLNLISIPSWLLQRYGSLETPSFLKKHFFETTPILLWNESSAEITLNGQLTDFQYTNLKGLFRTSVPEPPGSNSAYQEDDSEDITVYLTDFESMDPFDKSKFDW

SEQ ID NO: 12630 - protein, 795 aa, Nitritalea halalkaliphila LW7
MKNLELISHDDRTLKEHLLGLKDVVDYLIKEKSQNLFSKDFLANILHNLVSYHDLAKASRYFQVYLTEALILKGRGHKYYSTYQLKAFLDLNKDIQKELIYSPELKSHAHFGAWAFLASIEKEKRYSIESLLLMKILKRHHGFLRNFELGNINPKNYVEIFEKAGKTIDFEKFASIADEIGLPFVIPDINQILADFKIMDFKKIEINLNRSSDPSYYFKTLFLYSLLLSADKGDVMLKEKNFLRSNIPSSIIDEFKGNSLTSNFSINELRELAYNTAVENAITYGTEHFFSITLPTGLGKTFTALKTAFLIKEKYSPDFRIIYCLPFTSIIDQNASVLQEIFKFGGLNLNGIGIHHHLAVPENSEENEFDYPQWEYHTEGWQNEVTITTFIQFWESVFTNQNRQVRKFHNLANSIIILDEVQSIPANLLPALEFMMEGLSRFFNTKFILVTATQPILLPGKTRELCFKNGEDFFFKSMNRTALNKELLNIGDISEDNLADIITDEYSQNAKSTLVICNTIRYSQNLYQKLKTNLQSVNIFYLSASIIPYSREKLLKEQIIPSLKTKEPIILISTQVIEAGVDVDFDLVYRDFAPLSSINQSAGRCNRNSTQGISEVKLFKSGKTKIYDPTLLSVTEDTLRIYDSIIEERNYFELNRRYFLGVKNRIQDNSSVSQDLIRSINRLKFDDIGSKKEFRLIVEKYKSYNFFIPVSDDAEKTWNSYIEILNIENHFEKKQKLKILFPKMMKYVIKIPEYVRPVTNEDKEKVIIYDSDWQSFYDLDFGYKKPDLEIPVEIF

SEQ ID NO: 12631 - protein, 757 aa, Opitutaceae bacterium TAV1
MPCYAHSLSSPDGQPLAVDQWELLWSGDPQRPGHLEAVASLAEQFAGKFGAAEWARLLGLWHDLGKFSAEFQAYLRSAGGAEAHLEERPAVASRVDHSTAGAQFAAEALGAAGLLLAYLIAGHHAGLPNGRDGTSPGGSLDGRLEKTIPDWRSATPECVLKEIIRNRLVLPDYSARSGASMAFFLRMLFSCLVDADFLCTEAFMNPEQAQVRPTQAQSMAGLDECLTRYMAEKFGVPVTPVHHARAGVLQACLDAATKRPGLFSLTVPTGGGKTLASLAFALRHAKAHGMERVIYVIPFTSIIEQNARVFREALAGCGVEVVLEHHSNLDPDAQHVTRTSRLASENWDMSVVVTTNVQFFESLHANGTSRCRKLHRMARSVIILDEAQTLPVTYLATCLHTLEQLATNYGSSVVLCTATQPFVVRRPEFPIGLPEPVEIIPEPTKLYTTLKRVEVKPVGKLTDAELLDRLKAHRQVLCIVNTRRHAAELYAALPAKCGRIHLSAQMCPEHRSVVIDKIRSGLVVGEPCVVISTQLIEAGVDLDFPVAYRALAGLDSIAQAAGRCNREGRLARGVTYVFEPERRPPAGFLRQTAQTCAQILELHDDLLSLDAVRHYFELHYWERQAETDARGILACWPKQVRTKDDLLSFEFKKAAEAFQFIESAQQAVIVPWGGKGKALCAELRKTFEPRAQRLLGRRLQRFIVQIPDPIFRRQLGTSVEMIHERFPLLVSELDYSEELGLQFHSETPYDSESLMCS

SEQ ID NO: 12632 - protein, 802 aa, Fictibacillus macauensis ZFHKF-1
MVYIAHLRSGNHDIQTVREHLLEVKQLAESFGEKLGVKHLAGLAGLLHDMGKYTDAFKNYLVEAVNNPDNPPKKGSVDHSTAGGKFLYEEFHHSGLYPAILAEVVGNAILSHHSYLQDFINPDLESNYLKRVRDKELDEFSMVKERFYKDVMNQESFKAYVGLALDELETFLNRDSPCKMEVKLMLLTKYIFSALIDADRTNTRLFEEGNNVDVSTENTPFEDYYAKLLKQLQLYDQSPLAHHPINQLRVKMSEQCDKFAEKPSGIYTLSIPTGGGKTLASLRYALKHANLHNKKHIIYVVPYTTIIEQNAEIIRGIIKDDENLLEHHSNVTLEEERYDSAIDTGTIEQKLRLAKDNWDQPIIMTTMVQFLNVFYAKGSRNIRRLHNLSEAVIIFDEVQKVPVNCVSLFNDALNFLKFYGNSSMLLCTATQPALDYVEKRLAINEHPEIIENLDEVIDAFKRVEVIDEATNQTIKNDQLVQRIKQQMESVSSLLVILNTKAVVKDLFSKLEEKELNASIFHLSTSMCASHRKEMLKEITRLLQEKKRVICVSTQLIEAGVDVSFDCVIRSLAGLDSIAQAAGRCNRHGEAELRQVYVIDHGSEELSKLKEISYGKQLSKRILLDLKRDCTAYGGHLLSTQAMNKYFKEFYDHFESQLDYFVPKAKQNMTDLLSASNSSYHQAYVQRHKKQLGLCIRNSYGTAAKYFKVIDDVATPVIVPYGEGRDIIAELNGQFSIQQLSKLLRKAQQYTVNVFAHEKEELSKQGGLVSYLDGKVLVLKESAYNETYGVDVKNESKLEFQMF

SEQ ID NO: 12633 - protein, 814 aa, Parascardovia denticolens IPLA 20019
MMIKDLLARKDQSGRAQTLQSHLFGAATLSGSFEDKFSSLSRLAAFLHDAGKASGDFQDYLLSDDGIRGSVIHAWQGAFMIDDLDAQNGYAKVAQQLLELVISKHHGALPDCVDQDGMTPFFDNFSAENKQDGKYSYNEVKRNLNDLQPQISKLFLEASDEIESFFVGMSEIRNAHGKQLSRESQFFYLGMLVKYIYSRLIDADRTDAASFESHTTYQSKDVRWEELISKLDKKMSGFDSATPINAVRNKISQTCRRASDRKTGIYKLSVPTGGGKTLASLSFAMRHAQKTGKRRVIYVIPYLSITTQTSQTFRDMLNLPEGNDVILEHYSSAMNETIEEITKERTDEEEEKESTKSKARKLAAERWNNPIIVTTMVQFLETIMSARGTNLRKFHNMADSVIIFDEIQSLPTDTINLFNEIISFLSGILGSTILLCSATQPLLEQTNRDNLCLASEPNLIKLNEQDSRFLKRTNIVASTKDKDCDELAEFAFEQAKENGDCLIILNLKSKAKNIYQALRDLNEDNQFDLIHLSTSMCGKHRKNQLDHIRNSFKSSEAKPIICVSTQLIEAGVDISFSCVVRAMAGLDSILQAAGRCNRNGESPTPKNVYVFPVKDEKGLSYLPDIKLGKELMSQLIREYPDEDLLSDAMLTEYYRRYFARLQPDDRKQFSKMDYPLKGFHTSAYDLLARNRMWRGTYKNRRGADFPYYYAQAFKTVSDNFHLIPGAACNVIVPYGDSGELLELLSASDMDTRYKALHNLQDYTISLFEWEERSLHESHAIKLIDDTFEIYVLNQEYYNEEYGFTVEASMPLQMY

SEQ ID NO: 12634 - protein, 786 aa, Thermoanaerobacter siderophilus SR4
MNMSSFSELYSHPDKFLEDHLINTSKIIRSYFNEKKVAIIDKETFLKTATIISLCHDFGKATNYFQKYLFTENEKERNKLKTMEETHHSLLSAVVAFYLVKNEINAQDRKGILFPFIAFLIVKNHHGDLKNVFNEVILDDKELEVLKKQLNSIDDEKLQVLNGKLRNAGLNENLTKSAINDYIDSINSELRKIKRELRRLKEEQDVSIYLLLNFLFSLLVDADKTEVVVGIDNIKRPEIKFEEQLVKEYKASFPDKESKINLLREEAYKEVLEKDIDIKQKIMSINLPTGLGKTLTTIAFAMKLWDKLYKETGVKYRIIYSLPFLSIIEQNSNVLEDLLRYNGIQPDTEIILKHHHLSDIRYTKNNTEFEDEQAKILIEGWNSEIIITTFVQFFHTLVSEKNKTLRKFHRLANSIIILDEVQSIPFKYWLLTKELLKAVANELNSYIIFVTATQPLIFREEEIYPLVAKTKYFTQMDRVEIIPKLSRDITLEELSEMFDLNDGKSYLFILNTIKSAQQFYNILRAKIPNDEIIYMSTHVVPMERMERIEKIKEGKMRFAVTTQLVEAGVDIDFDVVVRDIAPLDSINQSAGRCNRNWRGKGEVYVVSLIDEKGQKYSKYVYDKILLGITREILSKYDTIKEQELLKIIEKYYQEVSERMSSNEGRELLDAIYTLRYDSEDGNMCISKFELIEDDYYKVDAFIELNDEAKELWHKYVELKDIKNLFERRNIFNRFKADFYKYVISIPATVENMPPDIWGFKYVNYDSLNDYYDKETGFITKGVTSIW

SEQ ID NO: 12635 - protein, 773 aa, Porphyromonas gingivalis W50
MINKESPILAKPSGITLDVHAENVIQEGALLLKGLGCTKEKYFQTTAKQIVQRVELACKYHDIGKRNKIWQDACKKDYKAYLIWKKIHPNKSFEDYTIECREEAGKFLRQTHVRHEFYSIKGLLNNNPPPNNNPPYWLKIAIAAHHRKLSMKHEERWLSSDEDICSVWKDIRRLSNYFFDDRNSVLSDIAIKQYEFAGPRSLLQLADHRASAKEESKCIPDPIAFSYTFPEKWEKRPVQKLVEKHWRDELLLVRAPTGAGKTDAALLWASHQIKHRKADRLIIAMPTRFTTNALALSVSSTLSSTGLYHSSAWTQNFSSKIDNGEIALEQARYYHNQARLLQTPITVCTIDHLLSSLTLCDEEHQTITFALANACLVIDEADFYDQFTQANILVLLEVLKYWKVPILLMSASLPDNIVQEYRKIGYDIKHILEDTSDIERARFSLIEKRDVSEISQMQDLLQLCLDRGSAIIFANTVDRAQAYYQWFLENGHEEEVILYHSRYTETDKIEKEAQLLLRLGRSAWDNDRANGVAILTQIGEMSVNISADIMISDLCPIDRLTQRCGRLCRFSRKIGDLYIIRPMREGNLFPAPYYQNVGPSQKLEPNDALIQTDELLEKGMYSAANLVQLLNKVYANQTVFSTEASRNADRLREMFKANWLINPIEYLDEEIGSTNFWRARNIMPRCRIYIKRPLQSFRNYSDFRRWETDVAIDIPIYVIKKAMRMSDTVCSQVKVCIGKNDYTLIVINAKCYNNVRGLFFSESVLEEPNFEFL

SEQ ID NO: 12636 - protein, 720 aa, Bacteroides salyersiae CL02T12C01
MSKYDSILAKSTKNGGTTLKVHLESVAQLAMLAARCMGMDPEIARLGALLHDIGKANPLFQQSLEQERTSFFCSGFPFRHEIASLFFLNLVDRALWDPVIDMIIAHHKSVSNDDRKKGILDLEDEYGDEILEYHLSDFSAWSMDALGILGELSFPGVTSETVITEQDARCAYDYALTHCGKKTKGWSVWKGLLMGADHLASATEEQKDRLPDLFTIPDLHFYNRQSELYPLSLIESDVTKRHSFVKAPTGAGKTDFLMKRCRGRIFYTLPFQASINAMYERIAHDLGDCVEDVRLLHSISQLVIEDNRIVEKAIQNKFGAAIKVLTPHQLAAIALGTKGYEAMLFDLQGCDIILDEIHTYSDMVQSIVLKMVEVMNHIGCRIHVGTATMPSVLEQAILQILGGRENVQYVELPVDVSDSFNRHIVHKADSFIELLPVIRQAVDEEQKILIVCNRVAHAQEIFKQIDELYPDTDKMLIHSRFKRKDRNRLEKELKEVYNASPHACVAVSTQVVEVSLDISFDVMITEAAPIDALIQRFGRINRKRNADTVGKYKPVYVIAPPEEDRECLPYSREVLQRSYDVLPQNALLREAELQSLIDRVYPQIKRINIGLDAVFVDGKWRLKELRHLPKSALIEMLDIDSVSCITQQDDESGKYEQAIEKERLLMEIPVRYNSLRWKKLKQLPIGSRPFVVPDAAYSSDKGLDFSKIGTEYYDTNYQML

SEQ ID NO: 12637 - protein, 809 aa, Clostridium sp. MSTE9
MERKESMKSHLAHITEINGERLEQTVAEHSFHVADYAAEKLKGIGLWNTAYLAGLLHDMGKCTAKYQEYLSRASAGEEVVRGSVNHTFCGCIYLLKKYHVGRPQGMGTVTCEILVYAIGAHHGQFDCVTPQNTSGFEHRLEKDPKEIGYEEAVSAFLSECAPAEEIDRLLLLAQQEISALFETFRTRFRKNRTQVSFLMGLAARMILSAVIDGDRRDTAEFMTGVLQEYRSGSDRFWAEQIAYFEQKNSCLRAQTPINAARSGFSEQCRMFAQQHGGGIYRLTLPTGAGKTLSALRYTLYHAKAFHKKRILFVIPLLSILEQNSAVIRNYIQDKSSLTEHHSNVVKLFDTEEKLDQYELLTDTWESPIVITTLVQLLNTLFLDKTSAVRRMSALSQAVIVIDEVQSLPKKAMNLFTMALNFLAYGCGATVVLSSATTPCFEQTDFPLQYADPVEIVPYEPNDFEVFKRTEIINKTSPYGMSVEELADFSAEVLSRVSSLLLICNTKESALRLYRELEHRCDDCRVFHLSTSMCMAHRTDTLKKINAALKSREKMVCVSTQLVEAGVDFSFESVIRAAAGMDNIAQAAGRCNRSNDFGGIRPVYVVNFNQEAEKLGMLREIAAAQRCALQLLHRFAQSPDRYAHDLLSGESVAEYYQFLFQDADIKGKFGFPQRLPDGTTEDLFDLLAVNLRHIERPEFQGKYFLNQAFLTAGNLFQVFDENTTDVIVPYNMEAKELIADLFSQQSAYDLAFLKRCIEKAKPYTIQVFQYQIQKLSDYGMLSSTHDDRFTVLNEQCYDDKTGLIIENFIY

SEQ ID NO: 12638 - protein, 906 aa, Saprospira grandis DSM 2844
MAQEVKGPADYLAQADVYLAHRLAHNQDKETLAEHIDCVLQQSCRLFEAHQLDGVVDRLLLAVFEAFSKEEQLQLGNRAKIWMLNAVVFHDFGKVNPNFQVEKMKNPQFKKLAKHSFKSFHAPQSAVLYLVQALTSLDEESEEDDHFFALISLIYAFSQSILKHHASALEDYKIEQWDIWQEADLSLYFEAYAWTQKEQRPLFSLNELYGELKKNHLNPQDNFPIYALSRLLFSVLTASDYLGTAQYMQSLTAEDFELGVFSKARKNELAQTLKISTAYNKATYELAENQVSLVLPKEKSPLALNQLRQAMAVELLDQLKTLEEEERLYYIEAPTGGGKTNLSVLTAMRLLEGFPRTNKVYYVFPFTSLIEQTSETLVQLLGLREEEWIALHAKADFKAKKAGDTAEGQANYGADQMNFIDYQFLHYPLVLLSHVRFFNFLVSPKKSDNYILHRLANSVVVLDEIQSYPPDQWDKLFYFISKYAQYFNMRFVLMSATLPKLEALILEKGLLQEKVNYLLKEAKTRFFQNANFAQRLRFDFGLLERENISLDDLAQEVFRASVAYSQLDLGKAKPKGSVHSIIEFIFKKSAAEFILKMKEDAEIATFFDQIFLLSGTVLGPRRKAIIHYLKNPEYRNQRILVVSTQVVEAGVDIDMDIGFKNQSLLDSDEQLAGRINRNLKKEGAELYLFKHNEPRVLYANDLRYKMTKDLTQEDYRRILEQKDFDFLYQKVMLALNEWNKGLLNKNLASYLLHLQQLDYQKAQEDFQLIRQKNISVYVPLVLPFNDLGQANFSADQRLFLERFCPAAIGPEGVDAAEVFAVYLALILNPAEQYIQQQILLKQLQAIMAKFVFSLFDTPALRMQLAPFIDPEKSEYGYLYLLNWESLYSVEDGLNEQQFQTSEQQFL

SEQ ID NO: 12639 - protein, 725 aa, Methanofollis liminatans DSM 4140
MARDAFSLLHPTIQRELYRMRWSELRQIQVETIFAVKDGTEHLIISAETASGKTEAAFLPILSEIIGRREGGIGALYVGPLKALINDQFRRLEDLCEASEIPVFKWHGDVGSAQKKRFLSEPSGVLLITPESIESLFINHSSEVHLLFRSLPFIVIDEIHAFIGAERGMHLKSLIARIAQISAVRPRIIGLSATLGDLPTTQRWLSPGEPESVRIIAGQGGEKEISFLIKGYLFDTVSYDDGDDDPTLIKLSEDVIKHFYGKNSLIFINSRSKLELYTDQVKRSLEEARLPNLFRIHHGSLSRVEREETETALKSGRPTATFCSSTLELGIDVGDVSRIGQIGVPWSVHSLCQRLGRSGRREGTPSVMIMFVPESQKAEMDLVDRLSPSLLRALALSNLMLRRWCEPPETSLLHYSTLIQQILSVITERGGAGAVTLYNVLVERGAFSWVTQSEFTGILRSMSESDLIEQDPEGLLILGLKGERLVHRMDFYACFPTEPEMKVLWKSKQIGSIAPTYGIETLEYLILAGRRWEVLSVDLDRKEVLVQPSHGGKVPYFAGGGTVDIHPVVHQTVRDLLLSDTVPAYLDTPGKALLASARSVARSTGVAEFDLVPVPNGTYWFPWAGSAVLRTLMILGSCWGGFDVQERGIALFFHGASPDRVLNFYTDILATCPSKTEIAQKYGDLIREKYDSYVPEALLVKGFAERYIETRVVPPRTVAPSGECH

SEQ ID NO: 12640 - protein, 726 aa, Methanofollis liminatans DSM 4140
MYYAHSTDDPDKNNWQILKVHLQNVANIASGFAGEFNAERFGYAGGLLHDIGKYSPEFQRRLDGANIRVDHSTAGAKESETFYGSFQSHILEYIITGHHGGLLDYGSAESGLQERLSKPYLPDYSAYKNEISIPDLKNVRPCLTPINKRMGFAISFYIRMLFSCLVDADFLDTEGFMSPDKSSLRGQYEAFDTLSRKFDDHMNAILSTAEDNLINRCRREIYEQCREKAELPPQMFSLTVPTGGGKTLSSMAFALDHLKKHDLNRIFYVIPYTSIIEQNADVFRKIFGNHNVLEHHSNYDPKNENSENTDLVADKLKLSSENWDIPIVVTTNVQFFESLFSNRVSRCRKLHNLAKSVIILDEAQMLPTGFLKPCLAALSELVVNYGSTVVICTATQPNLNGLLDERVRPVEIMRSPQELYKVFRRVHVTDLGAIDDADLSARLMAHKQVLCIVNTRKHAQKLFELISESGNCYHLSARMCPVHRRKQLKEIKDLLRKGAECRVVSTQLIEAGVDIDFPAVYRAISGIDSVCQAAGRCNREGKLHSGEVYVFRSTEAYGRPTRWQSRVAEIGGMIFDECDDPLSLPAVERYFEKLYFYEADGLDDKGILPCFEERLNEIAFPFEAVAGAFNLIENNTRDIIIPYDDRARSIIEDIQRTGFPGRYVRSLQGYTVSIYLEEFRELEKANAITSIGDRFFVLRGGEDFYSENIGLLNRKYNLDENSLFII

SEQ ID NO: 12641 - protein, 810 aa, Brevibacillus sp. CF112
MQDFFAELFGAKAASSPIEPYPYQKKVAELLMQSRNLVLTAPTGAGKTWAALSPFLYARKQKRDFADRVIYCLPLRTLASSLYESTKDAIKGQQVTSTLQMGNQPNDPLFQGDVIFTTIDQLLSAYIGLPFGTSKAAANIPAGALIGAYVVIDEFHLLSYTEALPTFLDMMKRLHPYTRFLLMTATSPEPVVSALVKHLDGMSVKLQTEELEKLSTRTRSLYWRDKRMSGQDIANRHRGGRTLVIVNEVKRAQSLYFELTSILENEGRAIEVRVLHSRMFPKHRETVESWVWKTFSQESKEEAILIATQVVEAGLDISATLLLTDLCPANALLQRIGRCARFAGQEGTVEVYSLREGGVEHFLPYVSRQGKKEENDDYQVMLRTERVLKELESGTILTHELEKQLIETVHGEIDRKRIELVMHDLFLREDQISRALIRGDADMGELVRAIDNVSMIIHHSPDEVDLHRKPEMVSMGRRGLYFFLSGLEWTKEEWENNRLIFVPRFPDAQDISARVTWEPIQSPKEVLAHMTVLLSPKLAKYHAVVGLQLQKASLNCAEADERVSEFLESGEKASIQRFSYQRETYVEHVQDVRARNREQSGKYLQATNFLSRRFRMTPEQIEEIADLATALHDVGKLGVEVQRKMRRWQTEYKQKEELELLAHTDFDGTNPEERDAYRTGNYRPPHHAVEGAVALQEWCGKTFDRKIAVPILLAIMRHHNAYSKESEAIVFCKGAREHVRKSLQGLPYEPFLKPQSIRHRLDELVSWLRNNDVLALYWYLSRRLRLADRASQQVKNEKNNGKEETDVMLS

SEQ ID NO: 12642 - protein, 1001 aa, Actinomyces sp. ICM39
MACKDADSSGFSTRAVAASPVFPSAQPELDASLLTDLARCFWAKSGDGESTWLSVVQHLMDAADIAGYLFDEYLSEHHRRLMASVWGGEQSKARASFVFLAGVHDVGKVCPQFACQRQDLAQLIRHQGIPVMRKDDYPKRSSLPHGLVSQFALEEEVKAGGGNERRAHHWGILVGIHHGRYPGTNMVKVARGSYKSAEGSDCDDPRWGQARSEILRWMAARSGFPLVAPGTALPELPIAVASAYASALVIADWLASNEDYFPLRPRPVDEAGKLSIEGYPELTADQQRDRVRRAWKRAAFPSPLRIPGTHTGEAADFYRHRFGWPASYRPTEAQRAAVEIATREDPDLMIVEAPPGSGKTELAFAAAEVLMRARGLQGVFVALPTQATTNAMFERVAAWLTSILGDEPQKLGIQLAHGKNSLNESFAKLLERGKSPLEVHDDEEDLGLHASRWMGQRWRSTLSPVVVGTIDQVLLAALKSRHVLVRHLGLMGKVVVIDEVHAADEYMETYLEAALTWLGMYGIPVVLLSATLPPARRLALLNAYRRGRGSSGVSAESVDGVIGYPAISTVSAAGVRVHEIAGEAEVPKRIIPTSLGSPQEIAKLLDRELADGGCAVVIRNTVREAQETYEAVSSVFGREQSTLLHSRFLAAERAARDRRMLELFGKDSVQRPFRHVVVATQVIEQSLDVDFDLMLTDPAPMDLVLQRIGRLHRHDRAERPCGLCDARCLVIVEDRFAVPWTYSRGTDYVYSRHSVLRTLGLLADRGEVVVSESRDYAELTALSYCAAQSVGPADWAGSLAAALKEEEQDTAQSRTRASTWCLSGMSVSKWKAPKLEEKFQGNAATGEEARGPGVAAARAAVRDGEDQIPILVVALDPVLSNVPVAPPLSGVTTDDESLHVSEYNAGGRIADICSWSISLPPRAFRTCGQSLDEAVKAVAGAIWEDVVRRKWKCCEHPLLSGELILAMYKTSDGERLTRDLCGHTLTYSTEKGMEIWANEES

SEQ ID NO: 12643 - protein, 946 aa, Actinomyces sp. ICM58
MSVAQHLMDAADVAGYLFDEYVSEHHRRLMASVWEGDQAKARATFVFLAGIHDVGKVSPQFACQSAELAPFIRAQGLGIMRKADYPERKFLPHGLVSQFAFQEAIVRGGGDAARAVHWAVLVGIHHGRYPDAGAVNVARQQYRTQEGSEQDDPRWGQARAEILRWMARRSGFPLEAPGTALPELPIAVASAYASALVIADWLASNEDYFPLRPRPDKGDEECAIRFYPELDAGQQRKRAARGWKRAAFPAPMRLPATLEEPIADFYRHRFGWPASYRPTCAQREAVEIASTEDPDLMIVEAPPGSGKTELAFAAAEVLMRARGLQGVFVALPTQATTNAMFERVTAWLTSILGDEPQRLGIQLAHGKNSLNESFMKLLESGQSPLEVHDDEEDLGLHASRWMGQRWRSTLSPVVVGTIDQVLLAALKSRHVLVRHLGLMGKVVVIDEVHAADEYMETYLEAALTWLGMYEIPVVLLSATLPPARRRALLDAYRRGRGSSGEGAQLVEGMIGYPVISTVSATGVHVHEIDGEAEVAKRIIPTSVGSPQEIAELLDCELADGGCAVVIRNTVREAQETYDAVKVVFGREQTTLLHSRFLAAERAARDRRMLELFGKGATQRPQRHVVVATQVIEQSLDVDFDLMLTDPAPMDLILQRIGRLHRHERADRPVGLREARCLVLVEDLFAVPWAYSTGTDHVYPRHAVLRTLGILSDRGEITVREPVDYAQLTELAYSNVEAVGPAQWADAFDTALDERERSTAQSRMRASTWCLDGANLPRWQAPELEEKLQGNAATGEETKGPGVVAARAAVRDGEDQIPVLVVAIDPELGNTPVPPPLTGEATDDEELEVSEYNARGRVADICSWSVSLPPWALRARGQSVDQAVDAVAGAIWDDPITAEWACREHPFLAGELILAMYKTPGGERLTRDLCGHTFTYSTEKGMEVQGQ

SEQ ID NO: 12644 - protein, 814 aa, Lactobacillus coryniformis subsp. coryniformis CECT 5711
MEFIAHPGPLMDNDQRQPDQLLKDHLLDCQKIAESLGRQLNLGHMAGLAALLHDVGKYSSAFQEYIQSAKIDPNSVRRGSVDHSTAGGKLLYDMFHQSTSSPYEKMLAELVGNAIISHHSSSLRDYWDPQTTAESPFLNRVREKPVIEYAQIKSAFFTEVISPIHFKKCVQYAVQELQVLIKQLKDYSSLFLIGQFIYSCVIDADRTNTMLFEQGKAATWQADGDRTNLFAADYATVVAYLEAKNIDSPTTKINQLRAQMALECDQFADRPTGVYQLSIPTGGGKTFSSLRFALKHAAKQHKTRIIYVVPFTTVIEQNAAVTRKALGLPENDQSHVLEFHSNVVQSQTIAGDNENEEQGLELIKDTWDAPIIFTTMVQFLNTFYASGTRSIRRLHNLMNSVVIFDEVQSVPTKCISMFNEVVNFLSSVGQTTAVLCTATQPALDAVRNNLKLSENGEMIQNLPAITEAFKRVDIVDQSQGEAWSLDHLANFVQELAVNKQNILVILNTKSAVKKLYQTLAATNLSEEFKLVHLSTSMCAAHRLRLFSDITKVLKNGQRLICISSQLIEAGVDVSFECVIRSTAGLDSIAQAAGRCNRNGEKERQNVYVVKIADDDEKLTYLPEIADGQKITLRLLQDMVLDKKLYNGELLSPAALRKYFIDFFAKEAIEADYPVKHTNLKLMPLMSNQGQRGSIKRATNEDWPLMLLNSGQTIAKFFQVIDSVTQTVLVPYAAGAEFITQLNGELTTEELDSTLKAAQPYTVNLFTYQITELDKAGLLMPLYNDQILALRSEAYSEEYGVTMAGDGGIFEPPIM

SEQ ID NO: 12645 - protein, 765 aa, Leptospira kirschneri serovar Grippotyphosa str. RM52
MEKLLAKSRTQDGREISLQEHSFDTENAAISIFRKESRFLNNWLRFFKIRKEDEEKFLLNLRVTCLFHDIGKANDDFQKAVREKGFFHQGIRHEHLSAFVLHLPEIRKWLSQNKDLDIPIITSAVLCHHLKATDKNDHQYKWLTDPLRDFVILNLFHEEVKIILKKVNQFLKSDIDIPQLNYKTFSPEDENWKKTFQSGAKESGILGFRLDENRKQLHLAIKAALIVSDSASSGLVRENHLIEKWISKAIHSDEIKENEILKEIIQKRMDDKKILELHQFQKQVATKGDRVLLMAGCGMGKTLAAWNWANEVSKKQKISKVIFLYPTRGTATEGFKDYASWAPEADATLMHGTSDYELDSMFQNPDDEKSKRDFRISEADERLFAIAFWSKKFFSATADQFLSFLQNNYKGICLLPVLSECALIVDEVHSFDKAMFSSLLSFLKYFDLPILCMTATLTPKNKQSLLELDLEQYPKEEDRKELENLINLENHPRYNKTVLENAEQAKEIAIKSFREGKRVLWVLNTVDRCQKTYEELTEELQTEVHCYHSRFKLSDRKTVHENTVNAFQGSNLNSIAVTTQVCEMSLDLDANVLISEFAPVSSMVQRFGRANRHLKKGDEFRAELYLYEVVGSLKPYSSDEINAAKNFLNNLPEKDISQNLLATKLEECSAQEYKTLPSASFIDGGYFALPSDYRDIEEFTAQAILDEDFPEVSQLLQSKKPIDPYILPVPDKRELNLRNEEHSLLPKYLKIVSRKYYNNKRGFAL

SEQ ID NO: 12646 - protein, 745 aa, Leptospira kirschneri serovar Grippotyphosa str. RM52
MTKDKQSIFIAHVLRKDDGSFVEHLIDDHLYSVAEFAKKFCEKFGAETFGYLIGLWHDLGKFKLEFQERIRIRSGHIGEEAHLEGKTAKSVKHSVSGAIHCLNKFKQSDIIKKLICLPILCHHSGLKNFGIDVDIQLNDEKEISALSETITYIPQQILDGIELKQLGKSFKDHSLLIRMLFSTLIDADRLDTERFMDLVKFKERYSKTIILQDLNIKLDKHLNDIQKQADATKVNSIRKRILEEVQSKTNLKPGFYTLTVPTGGGKTLTSLSFALKHCIENKMDRVIYGVPYLSIIEQTADVFKKILGEDSVLEHHSGIDISKEKENSINRLLTENWDHPLIVTTNVQFFESLFSSKTTKVRKLHNIINSVIILDEAQMIPPQFLQPIVKTLKELVEYYNVTIILCTATQPTLSSIKSTDLNFDGIDTAIELAPEPEKLFQELKRVIIHKPEEKKLSFMEVATRILNYDQVLTIVNRKSDASGIFNQLTGNKYYLTTNLCAEHRRDILKKVKNHLNNGESVYLVSTQLIEAGVDIDFPIVFRAVAGLDSIAQAAGRCNREGKLLDENGQEKLGEVFLFKPEQNPPAGHLLQTEQASRDCIKNFEELIHPDTLKQYFNTLFWLKQDKGLDKEEIEKDKRSFQFETINKKFKLIDEDSRPVIVPYKEGKDLIVQLQNSVIQNNFLDYKLIRKSQRYTVNLKTNLYNKLLSEGIISEIEGIIGILTFDSYYHNDLGILESPNEQDLII

SEQ ID NO: 12647 - protein, 745 aa, Leptospira interrogans serovar Pomona str. Kennewicki LC82-25
MKRNKQSIFIAHVLRKDDGNFVEHLLDDHLYSVAELTEKFCEKFGAGTFGYLIGLWHDLGKFKLEFQERIRIRSGHIGEEAHLEGKTAKSVKHSVSGAIHCFNKFKQSDIIKKLICLPILCHHSGLKNFGIDVDIQLNEEREILALSETTPHIPQEILDGIDLKQLGKSFKDHSLLIRILFFALIDADRLDTERFMNPAKFKERYSKTIILQDLNIKLDKHLKNIQKQADTTKVNSIRKRILEEVQSKTNLKPGFYTLTVPTGGGKTLTSLSFALKHCITNKMDRVIYGVPYLSIIEQTTDVFKKILGEDSVLEHHSGIDISKEKENSINRLLTENWDHPLIVTTNVQLFESLFSSKTTKVRKLHNIINSVIILDEAQMIPPQFLQPIVKTLKELVEFYNVTIILCTATQPTLSSIKSIDLNFDGINTAIELAPEPEKLFQELKRVIIHKPEERKLSFIEIATKISNYDQVLTIVNRKSDSSGIFNQLTGNKYYLTTNLCAEHRRDILKKVKSHLSNGESVYLVSTQLIEAGVDIDFPIVFRAVAGLDSIAQAVGRCNREGKLVDENGQEKLGEVFLFHPEQDPPSGHLLQTKQASEDCIKNFEELIHPDTLKQYFNTLFWLKQDKGLDKEEIEKDKRSFQFETINKNFKLIDEDSRPVIVPYKEGKDLIVQLQNSVVQNNFVDYKLIRKSQRYTVNLKTNLYNKLLSEGIISEIEGIIGILNFDSYYHNDLGILESPNDQDLII

SEQ ID NO: 12648 - protein, 745 aa, Leptospira interrogans serovar Bulgarica str. Mallika
MKRNKQSIFIGHILRKDDGNFVEHLLDDHLYSVAELTEKFCEKFGAGTFGYLIGLWHDLGKFKLEFQERIRIRSGHIGEEAHLEGKTAKSVKHSASGAIHCFNKFKQSDIIKKLICLPMLCHHSGLKDFGIDVDIQLNEEREILALSETTPHIPQEILDGIDLKQLGKSFKDHSLLIRMLFSALIDADRLDTERFMDPAKFKERYSKTIILQDLNIKLDKHLKNIQKQADTTKVNSIRKRILGEVQSKTNLKPGFYTLTVPTGGGKTLTSLSFALKHCITNKMDRVIYGVPYLSIIEQTTDVFKKILGEDSVLEHHSGIDISKEKENSINRLLTENWDHPLIVTTNVQLFESLFSSKTTKVRKLHNIINSVIILDKSQMIPPQFLQPIVKTLKELVEFYNVTIILCTATQPTLSSIKSIDLNFDGINTAIELAPEPEKLFQELKRVIIHKPEERKLSFIEIATKISNYDQVLTIVNRKGDSSGIFNQLTRNKYYLTTNLCAEHRRDILKKVKSHLSNGESVYLVSTQLIEAGVDIDFPIVFRAVAGLDSIAQAVGRCNRESKLVDENGQEKLGEVFLFHPQQDPPSGHLLQTKQASEDCIKNFEELIHPDTLKQYFNTLFWLKQDKGLDKEEIEKDKRSFQFETINKNFKLIDKDSRPVIVPYKEGKDLIVQLQNSVVQNNFVDYKLIRKSQRYTVNLKTNLYNKLLSEGIISEIEGIIGILNFDSYYDNDLGILESPNDQDLII

SEQ ID NO: 12649 - protein, 752 aa, Leptospira interrogans serovar Bulgarica str. Mallika
MILLAKSYPGIEKQLKSGDPESWALLEHHSSATYQVAEVLLKILEPILRKWTRLSESEYNKFVLVVCLSAGLHDLGKANEDFQKMLQRRKYLQRFRHEIWSVLALTGSGPFSDWFRKTIGDETWVRIGQMGILSHHLKATRETLYADHETAEIKVFWKDQGVIKMFQSICRLAGISSPDFSSPSISSYTCLGEDADKSIRIWTREILNARIDPRYQHSIGAVRAMIIAADRLASAYKGADALKLWATEALNRVLSEQECSKIVKQGLGEKNLRPFQKQVGDSTSRVTLVRAGCGNGKTIAAFQWAKTHSAGRKLFFCYPTMGTATEGFRDYVSDIPGLDALLSHSRASLDLGELASTGEEDEGDSLNMHSRMLQEWTAQVTFCTVDQILGLLQNYRSSLTLSPAIFLGAFVFDEIHMYDSILFGNLLTFLKEFSHTSILLMTASLPETMLSAIQETVGADLGPVISGEAQIEERLRYRILHSSREDALQKAIQEFKNGGRVLWVCNKVEHCLKLYDELSEKYDIEALVYHSRFKYEDRKERHRAVIDSFQEGYKKSLPVFAITTQVCEVSLDISATLLISELCPFAALIQRLGRVNRPGQEMEGIAQVLIIPFQGKPYEKENEDDGESELERCKEILKPLLDRELSQKDLALALENAKGTEHQKIPSQWLSLGWEAKPDSIRESGYTLDVILESDAYKVLKNERPWEKSKLYTIPMPIQKQFSYGEPPLRIPVVPDSQIQYSSVRGGEWNLN

SEQ ID NO: 12650 - protein, 745 aa, Leptospira interrogans str. FPW2026
MKRNKQSIFIGHILRKDGGNFVEHLLDDHLYSVAELTEKFCEKFGAGTFGYLIGLWHDLGKFKLEFQERIRIRSGHIGEEAHLEGKTAKSVKHSVSGAIHCFNKFKQSDIIKKLICLPMLCHHSGLKNFGIDVDIQLNEEREILALSETTPHIPQEILDGIDLKQLGKSFKDHSLLIRMLFSALIDADRLDTERFMDPAKFKERYSKTIILQDLNIKLDKHLKNIQKQADTAKVNSIRKRILEEVQSKTNLKPGFYTLTVPTGGGKTLTSLSFALKHCITNKMDRVIYGVPYLSIIEQTTDVFKKILGEDSVLEHHSGIDISKEKENSINRLLTENWDHPLIVTTNVQLFESLFSSKTTKVRKLHNIINSVIILDEAQMIPPQFLQPIVKTLKEIVEFYNVTIILCTATQPTLSSIKSIDLNFDGINTAIELAPEPEKLFQELKRVIIHKSEERKLSFIEIATKISNYDQVLTIVNRKSDSSGIFNQLTGNKYYLTTNLCAEHRRDILKKVKSHLSNGESVYLASTQLIEAGVDIDFPIVFRAVAGLDSIAQTVGRCNREGKLVDENGQEKLGEVFLFHLQQDPPSGHLLQTKQASEDCIKNFEELIHPDTLKQYFNTLFWLKQDKGLDKEEIEKDKRSFQFETINKNFKLIDKDSRPVIVPYKEGKDLIVQLQNSVVQNNFVDYKLIRKSQRYTVNLKTNLYNKLLSEGIISEIEGIIGILNFDSYYHNDLGILESPNDQDLII

SEQ ID NO: 12651 - protein, 752 aa, Leptospira interrogans str. FPW2026
MILLAKSYPGIEKQLKSGDPESWALLEHHSSATYQVTEVLLKILEPILRKWTRLSESEYNKFVLVVCLSAGLHDLGKANEDFQKMLQRRKYLQRFRHEIWSVLALTGSGPFSDWFRKTIGDETWVRIGQMGILSHHLKATRETLYADHETAEIKVFWKDQGVIKMFQSICRLAGISSPDFSSSSISSYTCLGEDADKSIRIWTREILNARIDPRYQHSIGAVRAMIIAADRLASAYKGADALKLWATEALNRVLSEQECSKIVKQGLGEKNLRPFQKQVGDSTSRVTLVRAGCGNGKTIAAFQWAKTHSAGRKLFFCYPTMGTATEGFRDYVSDIPGLDALLSHSRASLDLGELASTGEEDEGDSLNMHSRMLQEWTTQVTFCTVDQILGLLQNYRSSLTLSPAIFLGAFVFDEIHMYDSILFGNLLTFLKEFSHTSILLMTASLPETMLSAIQETVGADLGPVISGEAQIEERLRYRILHSSREDALQKAIQEFKNGGRVLWVCNKVEHCLKLYDELSEKYDIEALVYHSRFKYEDRKERHRAVIDSFQEGYKKSLPVFAITTQVCEVSLDISATLLISELCPFAALIQRLGRVNRPGQEMEGIAQVLIIPFQGKPYEKENEDDGESELERCKEILKPLLDRELSQKDLALALENAKGTEHQKIPSQWLSLGWEAKPDSIRESGYTLDVILESDAYKVLKNERPWEKSKLYTIPMPIQKQFSYGEPPLRIPVVPDSQIQYSSVRGGEWNLN

SEQ ID NO: 12652 - protein, 925 aa, Lachnoanaerobaculum sp. ICM7
MIEALWAKKEEKDGLMYWLPLIVHLEDTGRIMGLLWEHWLSEGQKRIVSVDTDIGKQTAVFIGAIHDIGKASPAFQLKKGFSNSKDLDKELIEKLVRAGFIGIDSPDLLASPEKTPHGLAGEVILSVLSDRFKKENDIGSIVGGHHGRPIDNKSMISEVLKSYKKNLFQSENENSDIYKIWLSIHTDILNNALKNSGFKRCEDIPVLSQPAQAMLLGLLTMADWISSNTYFFPLIGIFDDADIDMNKRCEYGFKKWKKSNGSDIWLPEIYADCNELFKERFGFEPRNVQSIFAQTISDAKNPGLIILEAPMGLGKTEAALVGAEELAIKSGRGGLFFGLPTQATSNGIFPRIISWLGKLSADLGERRGLRLVHGKAFLNEEYNNLTNASNIDIDGDNEGKEGFVVNQWFCGKKTAIMDDFVVGTVDQLLMMALRQKHLALRHLGLSKKVVVIDEVHAYDAYMDQYLNMALEWLGAYNVPVILLSATLPKKSRVDFINHYLIGNGVKLNKDDIGHLEVDDYPLITYTDNDKALNVKDFAQIEDKRIEIKYTDTENLPKLLDSLLEGGGNAGVIVNTVKKAQDIANLLSLKFGDSNVMLLHSSFIATDRVKNEEKLMKYLGKDGDRPQKLIVVGTQVIEQSLDIDFDVMISDIAPVDLLIQRMGRLHRHTRDNRPRKHKKPVLYVLGNNKNLDFESGSKAVYGGYLLTRTGYFLGDNINLPSDISRLVQVVYDESIEPDLSDELREKYSEYKSEYKALVNSKESRAGTYRLSSPILKKRISKEPNLIGWLNNQSRASGEEDGNSQVRDTQDTIEVIALKKFKDGYTTFDGNEDISQNIENAEIAKKIASSTIKLPNKLSKPYNIDNTIKELEDFYIDKLQNWNNSVWLSGTLCVIFDENNECTINGVSMVYDKKYGLILKGEDDAKV

SEQ ID NO: 12653 - protein, 786 aa, Peptostreptococcaceae bacterium AS15
MEKYDKLPIFYKNYKAKENETLYEHTANLLENLEELSKIINLEYKDLIEEACIYHDLGKINPLFQKRLENKKKFDDSKEIGHNIISTYLAKKFLDNYDSNDRNIILYAILNHHNYVDNFETISEKKELLQENLKKIALEIFNDSQADFFKDIGARELSKIGDLRSRANKKSILVKGFLHKCDYAASAYSKVESPNVHLKNRLEILKERFKNNSKSKDWNDMQKFAKLNSCSNMILIGSTGLGKTEASLLWIGDSKGFYVLPLKTAINAMYKRIKYDLFPQDFESNLGLLHGELENIYLENSQSTNTSEETEESMKFWEYYSLTRNMSLPLTISTPDQIFRFAFRYSSYELQLATYSYSKIVLDEIQAYSPDILATLIYSLKMIDMVGGKFAITTATLPPFFKDLLQNGSENPIKYVEKVFLNDKIRHRVKLNHKAIDIDEIKNFIEEKYNQESMKILIVLNKVKVAQDTYRSLKSWMNENDLDVEINLLHSKFTVQDRNEKEDMILKDGDTSCQKNVIWISTQVVEASLDIDFDYLFTELSDVSALLQRLGRCNRKGLKSTNEFNCFVYTEINDGLFKVFTTKNANSSKGIIFKSLFELSKSALLEWENQNTDGLMSEKDKNDMIDKYFTMEKIKEYDELYGSNYIAYLSEYNKMYNHLENIMPDTKKQSDVIKEFRNIISVRVIPMSIYEDKQENIIEIIDEIEEKRKLIGKKVDREEKQKLRIDILRLKDKFKQFTLNISLYELGPYRGICVVDNEKIIISNLKYNKEYGLLREKEEDTGGKFI

SEQ ID NO: 12654 - protein, 782 aa, Haemophilus sputorum HK 2154
MHDFGKYSHKFQKYIHDETGLFNPDLDDEESTPNGSKVDHSTAGAQWVYRELRKIGAEQGIGELFGQMLGLCIASHHGEGLIDCLDGEGNPKWIERFNKTDELTHLAECEQNADEVVQQKAHELAGENLIRNLLKAVKLILSDSTTNDKIKEFYLGCLTRFLFSCLIDADRINSSDFEREAQKEVRRLTEKPDWQMVIDQVEAKLAGFQNRYPIDEIRRRISSDCLKRAVDPQGIYTLTVPTGGGKTLASLRYALHHAQKHNLDRIIYIIPYTSIIDQNAQVVREILGEDWVLEHHSNLEPEKQSWQDKLLCENWDKPIVFTTMVQFLDAWFGGGTRGARHIHPMTNSVLIFDEIQTLPVKCVHLFCNVLNWLTKFGKSTAVLCTATQPLLGELGLQNFPEDKRGAITARGLLRLPENAEIMGKYQDLDKLFADLSRVEIRFNEKSGGWNVEEAGTFLLEQFQTTPSCLFIVNTKKWAQELYQYCQKQNVPPEALFHLSTHQCAAHRKAIFDTIKARLENKEPVICISTKLIEAGVDISMACVIRALGGLDSIAQAAGRCNRHKEVDKGLVYVLNLQETDFSQILPDIAVGKEKAATIFREFEEKDILQPKAMSRYFELYFYNRSDEMVYLINEKDKNDGLLHWLSDNCFNAGAKFKGYFKNDILRKRDLYPLLMQSFKSAGRIFQVIDAPTRSVIVPYGKGKEYITTLCGAWDVKEMSEAKKKAQSYSVNVFPKVWNKLQEKKALHETIKGSGIYYLDECHYNNEFGLSLDKISEMTCYIS

SEQ ID NO: 12655 - protein, 731 aa, Bacillus cereus VD142
MEDFIYAKWDQQTGEFETLQEHTGLVLENLSLLQHSYGSLLSEEIWQLAHVAAQYHDAGKIYEGFQQIIKLNMGLSPLTKQEIEKKYPNVPHAFISLLCVPFLELHYSKSTERVVKEAIAHHHVRNVMFDAQILNTVLPDLKGKIDRLEQELCCSVNKDLDTTTIGWKPIKKKDKEYPLLMLVKGLLNRVDHAASAGELVEYHADKGVGTYVDKFLKKNGHKPRNLQLFSYENRNKNIVAVAQTGMGKTEASLFWIDEAKGFITLPIRVSLNALYERITNGMGYADEEGQAIAGLLHSGSVDFLQTLNNDYETNELIYEQSRLLSKKLTFSTIDQILKFPFLFRGYEKYLATMAYSKIVLDEIQGYSPKILAVLLKALEMIHQIGGKFMIITATLPTVFMETMERRGKIKVSDFVKEEFYNDLIRHHISLRKKMIDEDLEHIREAGRNKRVLIIANTVKEAKRIYGLFHNENVRLLHTQFIQKDRAVLEEEIKKFAPNDKNREKQSGIWIATQLVEASLDIDFDLLFTEISTLDSLFQRLGRCYRGRAYEGTEPNVFVYTEAQGIGFVYDEDIVHSGLKLLESFNGQKLHEKTKMELVKTLYKTENLSKKYLDEFYQALKVLDTLPLNDMRNTEAQRLLRDIDNYQVIPCSIYRENLDLFTTFKQEKDSKQRKLLQMQIEKLTTSISRKQVQRYGIETKEIDIPGFQYIHTLNCKYDFDKEKITGTGIVLP

SEQ ID NO: 12656 - protein, 743 aa, Bacillus mycoides
MITIFLAKSDPEETLREHTDELRLRYDILRESYGYYFDDRIWELLRYAVDYHDVGKAHKPFQLKIRRALGEDVVLKKYLEVPHNYLSPFLLPEVVFSFPKKDYQALIQAIAFHHERDIHPNDELITKALYEDLWPNLNKINSHLDIKGGNLHNRYNRIFSQLRKRIKYSDNKAHYVDYVILKGLLHRLDHAASAHADIEIDAKQNFKQLVDKGFAKIATEKSLPVEEVYRDLQKHAHEHRKKNLIIVAQTGMGKTEAALLWASDSKTFFTLPLKVSINALFSRVYDKMNYKNVGLLHSSSTDYLTESLEEDWEVISEQSHHFASKLLFTTIDQILKFPFLYRGYEKELATMAYSSLVIDEIQAYDPKIAAVLIRALEMIYLVGGRFLLMTATLPSIYLETLQESEIIPKDAFRVDTFIDDTVIRHCIDIKEKSIIDDVEQIINLGRSKKVLVIANTVKRAMELYSMIKKQTTHVHVFHSMYIQKHRAMIERELIHFDENREAIGIWVTTQLVEASIDIDFDVLFTEAATLDSLCQRFGRCYRRRQYEYEQPNVFIYTTNVSGAKYVYDEEILKRSIALLRPFNQKILLESKKIELVSQLYKRDYLKGTEFLKTFESALEQLKTFDDYTLSSNDAQKLLRDIQAELVIPRNVYDENVHLFEKLEQAEKQDRTEFHLEITKLTVSLRKTLTMRNTSRLPHKGVKKNGKKYDLLPWIQILDLDYEFNENSKTGSGVLLDKKTENFI

SEQ ID NO: 12657 - protein, 731 aa, Bacillus cereus VDM062
MGDLIYAKWDQQTGAFETLQEHTGQVLENLSLLKHSYGSLFSEEIWQLAHVVAKYHDAGKIYEGFQQFIKLNMGLSPLTKQEIEKKYPNVPHAFISLLCVPFLELHYSKSTERVIKEAIAHHHVRNVMFDAQILNAVLPDLKGKIDRLEQELCCSVNKDLDTTTIGWKPIKKKDKEYPLLVLVKGLLNRVDHAASAGELVEYHADKGVGTYVGEFLKQNGHKPRNLQLFSYENRNKNIVAVAQTGMGKTEASLFWIDEAKGFITLPIRVSLNALYERITNGMGYVDEEGQAIAGLLHSGSVDFLQTLNNDYETNEIIYEQSRLLSKKLTFSTIDQILKFPFLFRGYEKYLATMAYSKIVLDEVQGYSPKILAVLLKALEMIHQIGGKFMIMTATLPTVFMETMEKRGKIKVSDFVKEEFYNDLIRHRISIRKTMIDEDLEHIREAGRNKRVLIIANTVKEAKRIYGLFNNEKVRLLHTQFIQQDRAVLEEEIKKFAPNDKNREEQSGIWVATQLVEASLDIDFDLLFTEISTLDSLFQRLGRCYRGRAYEGTEPNVFVYTEAQGIGFVYDEDIVHNGLKILESFNGQILHEKTKMELVETLYKTENLSKKYLDEFYQALKVLDTLPLNDMRNTEAQRLLRDIDNYQVIPWSIYRENRELFTTFKQEKDSKQRKVLRMQIEKLTTSISRKQVQRYGIEIKEIDIPGLQYIHTLNCKYDFDKEKTTGTGIVLP

SEQ ID NO: 12658 - protein, 731 aa, Bacillus toyonensis
MEDFIYAKWDQQTGEFETLQEHTGRVLENLSLLKHSYESLFSEEIWQLAHVAAQYHDAGKIYEGFQQIIKLNMGLSPLTKQEIEKKYPNVPHAFISLLCVPFLELHYSKRTERVVKEAIAHHHVRNVMFDAQILNTVLPDLKGKIDRLEQELCCSINKDFDTTTIGWKPIKKKDKEYPLLVLVKGLLNRVDHAASAGELVEYHADNGIGTYVDKFLKKNGHKPRNLQLFSYENRNKNIVAVAQTGMGKTEASLFWIDEAKGFITLPIRVSLNALYERITNGMRYVDEEGQAIAGLLHSGSVDFLQTLNNDHKTNELIYEQSRLLSKKLTFSTIDQILKFPFLFRGYEKYLATMAYSKIVLDEIQGYSPKILAVLLKALEMIHQIGGKFMIMTATLPTVFMETMEKRGKIKVSDFVKKEFYNDLIRHRISVRKTIIDEDLEHIREAGRNKRVLIIANTVKEAKRIYALFNNENVRLLHTQFIQKDRVVLEEEIKNFAPNDKNREEQSGIWIATQLVEASLDIDFDLLFTEISTLDSLFQRLGRCYRGRAYEGIEPNVFVYTEAQGIGFVYDEDIVHYSLKLLESFNGQKLREKTKMELVETLYKTENLSKKYLDEFYQALKVLDTLPLNNMGNTEAQRLLRDIDNYQVIPWSIYVENRELFTTFKQEKDSKQRKVLRMQIEKLTTSISRKQVQRYGIEIKEIDIPGLQYIHTLNCKYDFDKEKITGIGIVLP

SEQ ID NO: 12659 - protein, 734 aa, Dacryopinax primogenitus
MSGVKEEVKKVNAEDRKRFGLRVEDEQNEDEEEEEEGAGAVEDELDATDLKPEDILALAAKKAKKKDVGVVDHAKIAYESFRKEFYHEPPEIADMDEEGVGLLRLSLDGIKIRGQDCPKPITRWAHCGLPSVCLDVIKRLGYTAPTAIQAQAIPAIMSGRDVIGVAKTGSGKTIAFLLPLFRHIKDQRPIEIMEGPMAIIMTPTRELAVQIHRECKPFLKVMNLRAVCAYGGSPIKDQIAEMKKGAEIIVCTPGRMIDLLTANSGRVTNLKRVTYLVLDEADRMFDMGFEPQVMKIVNNIRPDRQTVLFSATFPKQMDSLARKILHRPLEITVGGRSVVAPEIEQIVEVRPEDTKFNRLLEILGQTYNEDPECRTLIFVDRQEAADNLLRELMRKGYLVMSLHGGKDQVDRDSTIADFKSGVVPVVVATSVAARGLDVKQLKLVINYDAPNHMEDYVHRAGRTGRAGNKGTCVTFITPEQERYSVDIYRALEASKAKIPEELSSMANGFLEKVRTGKAHVAGSGFGGKGLDKLDKDRDTKMKAERNAYGEGEEPKPATSFEEEEGVKPAGSSAAAPAAKATKDADLTFGDFKVEIKRGPAPDTSHGLLTTSSAQAKLAHLGKSKNPDATDFHAIIPINDYPQKARWKVTNKETMSQLIDMTGASVTNKGVYYDPGKEPPLEGPPKLHLLIESNEEYRVEAAVREIKRLLVEASTAAIQAESRGPGAPVGRYSVV

SEQ ID NO: 12660 - protein, 778 aa, Porphyromonas sp. oral taxon 279 str. F0450
MLHTTTIIAHRTEGGEEQSLYDHVEGVALQIRRNLTEAGLKQLIPIGDLLGRLHDVGKAQSAFQSYIRGETTAKAPHSAAGALLATSLIYELSKELQLKKLPRTSQLLAYAISGHHRGLYDYAELRNKLEEVDCKDRCKKTAEALTKLRSEIQCWAKEHAEATETSLKELAKQVGATEQAQALIRLLFSCLVDADFLDTEAFMDEERKGRRHEATCRYAPLETLRDRLTKHMEGFSTEGKINEARRAFLNQCRAHGQSCPKGYYSLFLPTGGGKTLSSMAWALETALNHKAQRIIYVIPYTSIITQTAGIFREIFGEENVLEHHSDISFSGDEASQEAERYERTRLLAENWDAPIIVTTNVQFFESLFSHKVSRSRKVHSIANSVVVFDEVQMFPTEFLHPMLRLLEDLRRIYGTQLLFCSATLPPFDKEHTSYFKKVNDFHQLSDAIHPIVPEDPELFKVFDRVIYHLEEKEYTTKELAEELAQHDSALCIVNSRREASQLYHALLEEGKEAQDVIHLSRNMCSAHLKERIAEIRQRLKAGTPTIVISTQLIEAGVDIDLPIVYRAMSGLDSIVQAGGRCNREGKRPAPGEVYVFSLSDGGKAFGAIAQGQNATRFLLDNDKEHTRPSIPLELIKVYYDRYYASIESFDTKDIAESLYDEDEAKRWRFDFQQASEDFQLIDNVDRDLFVPYGRGKELIEGLQKHTLYLNHRTLRELQQYHVSISKWRYEELKEARLLSEIIVDRETGKSILVLEPQGYDEALGVCTTNPLLNEPLFG

SEQ ID NO: 12661 - protein, 792 aa, Peptoanaerobacter stomatis
MIDDKLYDKLKNCYAKEDESIEVHVNNVLEQMGILKRLGYIDDEKAKILGDAIKCHDVGKANKYFQNRILSAKEGKKKYFDKENELGHNILSPFLCRFGDDERDYITAYAIINHHYYVKNNFNEIKEKEDILNKNIEEIYKSCNLEFDKNNILDLYKFISILQTELEENPKILKKALLILGLLNKCDYAASAHMEVEYSADFLQNALENMMDEWKNKNSSASWNDIQKFCMNNKDKNLIVVAPTGMGKTEAALSWIGDNKGFFILPLKTAINSIYDRVKKDIVKDNISKRVALLHGDTFNIYNDEKINDNNKNKEDIWAYYEKSKLLSIPLNISTPDQIFDFIFKAIGFEPKYAMLSYSKVVIDEIQAYDSNLLACIIIGIQNIIDIGGKVSIFTATLPPFVEDLLSLKKAGSSKIERYKFVKNIADIKGYKKRHNIKILEEEMNADLIYEHYKNSYSKKYLVVCNTVKKSQEIYQELKDKGIDNINLLHSKFVKLERKEKENHIMSVGKTYKEDNETINEIDEVWVCTQIVEASLDIDFDYIFTELSDLNGLFQRLGRINRKGAKNINDHNCFIFTEINQKLLIKKEDSIRGFIDEAIYKLSKKAILSHGDGILTEEDKLNLIDEYLTTENMKESVFLKRYWISYDYYSKLYMHELSAKDAEKYLRNIISFDVFPKDINNGLLNEEEINLIFERIKAVKEHLNDKNKSREEKKKYLFELSELKSEIMKYTVSVGLYDLGGEKVKYLENIEISKNTSIPILLCHYDELGFRRLTEEESKNENFDNKDDENFI

SEQ ID NO: 12662 - protein, 782 aa, Mogibacterium sp. CM50
MAEKEFLAKSYTEETIQEHTDKVLQEYERLKKFYKNCNVNWTLLEQACLYHDLGKMNSKFQRKIRNAEKVEDEVPHGILSTLFLDAKRLKEDFQGADDFKNFDDLDDAMYLLFSAIFYHHDRESFEKSDFTDNLEKNINREKDSLQYIVKNFKYDKVRIPEKLHFRDKYINRFSNSDKSNLLGEYVLLKGCLNRVDYAASAHVPVEIENDFLENKLNSFMEKLQKSAIGKNIDKPEWNDLQNFMKDNRDENLVVIAQTGMGKTEAGLWWIGNNKGFFTLPVRTAINAIYMRIKEEILDNKFIEERLGLLHSETRGIYLQLQSESDENLDIENYFTVTKQLSLPLTVCTVDQLFTTVFRYRGYEAKLATLSYSKIVIDEIQMYGPEIIGFLICGLKMVTELGGRFAIMTATFPGFLRDIMESCGLKFIMPEPFVDEKRIRHSVEWHEEGITADFIFEKYNNNRVLVVCNTVNKCKEVYKELSNKMDLQENSSDSKSIDESELNMLHGKYIYKDRIEKEKAILSFGKIDEGGTKDNRKGIWIASSIAEASLDVDFDILITELSDVNGLFQRMGRCYRKRSWNGDGANCYVFDGGEKKCSGAGYNIDENIFELSKEKLREYFKTAPRELREIDKMNLVRDIYSTENMKGSKCRKYYDKIKKCIEQPTLYLPAENTKPDAQKLFRDITTETVIPLVVFENNIGEIEILEKSLSDRNLSMEEKIENREKLKAFTLGIERYQLENVRPKATIKLGKYEEIKIIDAEYNPEMGLISITKESKEIESNII

SEQ ID NO: 12663 - protein, 783 aa, Selenomonas sp. CM52
MFVEITCTAFGRGAEIFIFSEFRRDFLEVFEMTKSSAYLGHLDEEMGREQLLCDHLTGVADLAGRFAAAFGEEAMGRLLGLYHDIGKYSREFQAYLRAGEEEKKRRRGRIDHSTAGTQEVVKLRQSADDEQSRRLGRGMTQVMAFCIAGHHGGIPNRGTTANTAEEGTLLGRLKRQNLPDYHAYHEADLPQTLPPSSLLLAQVVRAPLSAMLYTRMLFSCLVDADFLDTEDFMSAGNVEREGFASVETLLERLQESLEEKFSKPKTEKEKQKLQLPINEKRSALLAESIAAGKEAKGNLYRLTVPTGGGKTISSLAFALHYAVHAKRKRRRIIYVIPYTSIIEQNAAVFRDLLGSDSVVEHHQNVDYDDVQDTDMNRKRLATENWDAPVIVTTNVQFFESLFSNRPSKCRKLHNLAESIVIFDEAQMIPIDYLRPSLAAIEALVRHYACTAVLCTATQPPLGQFFSDDMQPLEICPALMENAAFFRRTKIELREEVMMEEELAEELAAREQVLCIVNVKKTAQSVFDLLREDEGTYHLSTNLYPVHREQVLEEIRARLKDGKPCRVISTSLVEAGVDLDFPCVYREINGLDSIVQAAGRCNREGRRTAEESVVHVFSLEKLAKNAQLAAEITKNVARSFAEDLASPEAIRRYFEELYDLSGKNRLDKKDIMGQSGKFAFADIADDVRLIEDRTKPIFIPQTEEGQALLARLEQGERSRSLMRKVGRYIVTVYTGYAEAPFEQLAAQGKIRMLDENLAVLVDMEAYDSQKGLSSNVGEGEGMFL

SEQ ID NO: 12664 - protein, 996 aa, Slackia sp. CM382
MLDEDDLCERRCFFPEEFERVSERLSPQARSLWAKTGRGEQSHLWEPLYVHMGDSGEIARLLWSKWLPRTVKKLIAQDLSDSAAESLVVWMASVHDIGKATPAFQYKVTDRAESVRETGLEIPAGIDSKSHAFMGQVILEDWLLERAWSHPNVFSCVVGGHHGAPPDSSTILDNLRDSLFPKEVLGESTWTTVQIELLDYAFVLSGAFRHEEELKELELPQHTQVLLTALVIMSDWIASNADLLPLVSGIASTADFRARAREAWERLALPAAWVPSLRGEPAEARFHARFDNIPEAARLRPAQILAVEAAESLEDPGLIIIEAPMGNGKTEASLLCAEILAEKFGSGGIAYLLPTMATSNAMFSRVENWLSHMADADGSSHQSMQLLHSKSALNKDFASLRTWNHTWMGDERNQQRSKNPNDENIIAHQWFGGRKRGLLASFVVGTVDQLLMAALKAKHVQLRHLGLAGKVVVIDEVHAYDAYMSVYLDRVMTWLGAYRVPTVLLSATLPPQRRKQLIRAYRGKDARSTGRPSKRRLIDPPRRATGKPAYPLVTVSGRDLDSERYCDCEVASRGTDVEISFLLDGDDDLLATLRDRLSDGGCACVLRDTVSRAQETYEFLKTAMDAEVRLVHSRFIAADRLSNDAELLKLLGPNASRRPRSLVVVGTQVIEQSLDIDFDFMITDIAPIDLLLQRMGRLHRHQRGEGQSERSAKLRTAQCFITGSKDWSVEPPEFDKGIIAVYHPALLLRTILALKVRCDGMGGSRVNLPHDIAGLVEAVYEGLEPGSNDFLLDGLKDDAWRDALLEAQDDLRQYRMSQESKASNWLLGKERTKPGKAFDLVGWLGNRFSISDEETGRAAVRDSQESLEVVALHCDAGNLSVFPWVALQEEVEEKYTALGDGTTAPDDRAARLAATCTVPLPPLLTKPWRIAGIVSALESATNVSGWQESRWLKGQLPLVFDRNGVAVVDCERARYHLGYSRELGLRLLEIEHKEVE

SEQ ID NO: 12665 - protein, 731 aa, Bacillus cereus HuA2-1
MEDFIYAKWDQQTGEFETLQEHTGRVLENLSLLKHSYGSLLSEEIWQLAHVAAQYHDAGKIYEGFQQIIKLNMGLSPLTKPEIEKKYPNVPHAFISLLCVPFLELHYSKSTERVVKEAIAHHHVRNVMFDAQILNTVLPDLKGKIDRLEQELCCSVNKDLDTTTIGWKPIKKKDKEYPLLMLVKGLLNRVDHAASAGELVEYHADKGVGTYVDKFLKKNGHKPRNLQLFSYENRNKNIVAVAQTGMGKTEASLFWIDEAKGFITLPIRVSLNALYERITNGMGYADEEGQAIAGLLHSGSVDFLQTLNNDYETNELIYEQSRLLSKKLTFSTIDQILKFPFLFRGYEKYLATMAYSKIVLDEIQGYSPKILAVLLKALEMIHQIGGKFMIMTATLPTVFMETMERRGKIKVSDFVKEEFYNDLIRHRISIRKTMIDEDLEHIREAGRNKRVLIIANTVKEAKRIYGLFHNENVRLLHTQFIQKDRAVLEEEIKKFAPNDKNREKQSGIWIATQLVEASLDIDFDLLFTEISTLDSLFQRLGRCYRGRAYEGTEPNVFVYTEAQGIGFVYDEDIVHNSLKLLEPFNGQKLHEKTKMELVETLYKTENLSKKYLDEFYQALKVLDTLPLNDMRNTEAQRLLRDIDNYQVIPCSIYRENLDLFTTFKQEKDSRQRKVLRMQIEKLTTSISRKQVQRYGIETKEIDIPGLQYIHTLNCKYDFDKEKRTGTGIILP

SEQ ID NO: 12666 - protein, 717 aa, Rhodovulum sp. PH10
MSSCRHFAHSAEGLDRDRWQGLADHLRAVAGLAAERAAVFGGGSLAELTGWLHDLGKYAPAFQAYIAGTRAKGPDHATAGAREIIGRSWSPADRWAAELAAFCIAGHHTGLPDRGSGGASLDARLTGELHALDPAWRQDVPPLDGSPSPRGFEAHESKDSRVRAFQLALLGRMVFSCLVDADYRDTEAFYAGLEGRTVDRTWPRLPEIVDALLARFDAHMAALAAGADDTPLDRLRAEILAHVRAKAALAPGVFTLTVPTGGGKTLASLGFALDHARRHGLRRIVYAIPFTSIVDQTADVFRRVLGDEIVLEHHSAIDAADDETGAASVQGKMRRAMEDWAAPVVVTTNVQLLESLFAAKPSRCRKIASLAGAVIVLDEAQAIPLHVLRPSVVALDELARNYGATIVLCTATRPALAAPRFEHGFRLTDERELAPEPDRLRRALRRTTLRRATEPLADHDLVAELAGVERGLVIVNSRRHALDLYRAAKTAGLDGLVHLTTRQTAADRRRILADVRATLAARRPCRVVATSLIEAGVDIDFPRVWRAEAGLDQILQAAGRCNREGRSPAEDGIVTVFAPAEAKPPREIAAFAAAMARTAAKHPDPTSLAAIDHYFREVYWQTGDGLDRMRIGGEASSETRAVLDCFKADRLGLDFAYRTVGDNFRLIESGMAPVIVAVAEEARTALDGLRGGWLGPARRRAGCRATSCRCRRPTAPG

SEQ ID NO: 12667 - protein, 815 aa, Paenibacillus alvei DSM 29
MFSIAHIRENDQQVQTVEAHLLEVRTLAEGYGSKLGVPHVTGLAGMLHDMGKYSQEFCEYILAAVSSTNVLVKRGSVDHSTAGGKLLYELFHITNITKYKGLLAEVVGNAIISHHSYLHDYLNQDLESPYLRRVRDKQMEEYEASKHSFFTHVINEREFHQYVDWAAIELEQFMAQNTIGSSEQKLMFLTKFVFSALIDADRTNTRCFEANVHEEPKVNVANLFEDYYAKLMEKVCSFAEHEDANKPINRLRSEMSAQSEQFAAKPSGIYTLSIPTGGGKTLASLRYALRHAMTFHKQRIIYVVPYTTIIEQNAATVRSILEDELNILEHHSNVIEHEHDNDEELDGFALTQQQKAKLAKDNWDAPIIFTTMVQFLNVFFAHGSRNIRRLHNLCEGVIIFDEVQKVPTPCISLFNQALNFLKHYGQSSIVLCTATQPALDFVEQKLDINPDAEIIGKIDHVIEAFKRVDIVDRATGETFNTDKLADFVQATIEDMRSVLVILNTKSVVKSLYQQLMERFKEAQYEMIPLYHLSTSMCAAHRFHILQKVKEHLEREEKVICISTQLIEAGVDVSFDCVIRSLAGLDSIAQAAGRCNRHGKDAIRKVYIIDHAEENLDKLKEIRVGKEAAKKMLIDMKRDSSAHGGDILSRRAMEWYFQTYYSEFKLNLNYPIPTLRKNMTELLYAGRGGEDTYYQAYCQTKNAQLPLFIANSYGTAAKHFEVIDSHTSSVIVPYGEGREVIAELNGACTIDDLTRLLRRAQQFTVNLYKHELNQLDHNSGLDCCLDGSVLVLKEGAYSEDYGVDLENDSEIEFLNF

SEQ ID NO: 12668 - protein, 552 aa, Wuchereria bancrofti
MPEISIYLKEQVIERLLKFQDVIVQAPTGSGKTLAYILPLFTILWKKKKVWPENEIGAVMIVPSRELAKQVGAICKLFADALSLSMRVMIGGKKGKSSSKADQCLSAAVIIATPGRLQSLISSNSDFKKALKALEILIIDEADRYTDSSFKAGMTEILESLPKQRRTGLFSATQAKEMEEIVKFGLRNPTQITITNCGAMLDSVDSVEAISPNTLNNFYMVVKADQKLHLLAEFIRSHPKSKILIFFSTCQCVEYMQIVLKELIQKRQIFALHGKKRKKAENQLQSFRKIGKSLMLCTDVLSRGIDVDNIDWVVQFDVPKQTSWFVHRAGRSARCGKVGNNVLFLTPEETAYIEFIEKYEKVSLTEMKVDLKEDDGAEQIRQQIIKMASKEREILECGTRAFMSFVESYVRHDCNVVCSSKDLDVVGYGHAYGLLRLPRMKEFHHSDLSDFKRSDLNTSEIPYKNAEKEKRRQEKLLLLKTENKELKKASRPQKRKLGARQNPQKDSAKKRRHSETKENMDDFVSDFSLLKKLKKGRLKKKEYDELMADSSC

SEQ ID NO: 12669 - protein, 925 aa, Lachnoanaerobaculum sp. OBRC5-5
MLEALWAKKEEKDGLMCWLPLTVHLEDTGRIMGLLWEHWMSEGQKRTIADDTDIGKQIAIFIGAIHDIGKASPAFQLKKGFANSKDLDKELTEKLVRAGFIDIDSPDLLSSPEKTPHGLAGEVILSVLSDRFKKENDIGSIVGGHHGRPIDNKSMISEVLSSYKKNLFQSENEDSDIYKKWVSVHTEILNNALKSSSFKRCENIPVLSQPAQAMLLGLLTMADWIASNTYFFPLIGIFDDADIDMNKRCEYGFKKWKKSNGSDMWLPEVYADCKNLFKERFGFEPRDVQSKFAQTISDAKNPGLVILEAPMGLGKTEAALVGAEELAAKSGRSGLFFGLPTQATSNGIFPRIISWLKSQSVELGEKRGLRLVHGKAFLNEEYNNLTSASNIDIDGDNEGREGFVVNQWFCGKKTAIMDDFVVGTVDQLLMMALRQKHLALRHLGLSKKVVVIDEVHAYDAYMDQYLNMALEWLGAYNVPVILLSATLPKKSRVDFIKYYLKGKGVKFSKEDMSSLMVENYPLITYTDNDKALNVKHFAPIEDKRIEIKYTSTENLHKLLDSLLDGGGNAGVIVNTVKKAQDIAKELSEKFGDENVMLLHSSFIATDRVKNEEKLMKYLGRDGDRPQKLIVVGTQVIEQSLDIDFDVMISDIAPVDLLIQRMGRLHRHTRDNRPRKHKKPVLYVLGNDKNLEFETGSKAVYGGYLLARTGYFLGDSIRLPSDISRLVQEVYDENIEPDLSDELKKKYYEYKVEYEALVNSKESRAGTYRLSSPVLKKRISKEPSLIGWLNNQSRNFGEEEGNSQVRDTQDTIEVIALKKIKGGYTTFDSDEDMSENIEDTKIAKRIASCTIKLPNKLLKSYNIDKTIRELEDFYINNLQKWDNSAWLKGTLCAMFDENNECSINGVNMIYDKKYGLISKGENDAKV

SEQ ID NO: 12670 - protein, 866 aa, Winkia neuii BV029A5
MDIHQRIWAKEIGLDRPYPLLAHLLDTAAIAKQLYMGWLRPGLREQIAEDLADGDQTETVKIIAYIAGTHDIGKANPYFQAQPRNSNEAFERIRAAILQEEQCTFLDEDEIPVPPSAKPYLTRHERVGAIALSPKPLEAGTNLRRAWWGIPALGHHGRFTEPAEEERQEQELERILVTRNWEPIQRDLLEAMKTACGISELPRLASGVTTVLLAGLVILADRIASGTDWVQARANLAADGQISLEKPKHWIDKAATSALERIKNTLGIYKGWENQQAAIAEILGGNQPRPLQEEAMRVGGGIWNVMAPTGGGKTEAAILRHSTRDERLIFLLPTQATSNALMRRIHKIYEHTPNVAALAHGLASVEDLYAQPVTVASDKKEGGLYYTDFVKSGSSRLLAPICVGTVDQGLLATLPAKWTHLRLLALANAHVVIDEAHTLDPYQTKLVENLLEWLRATNTRVTLLTATLPSQQRTDFLNAYCGKPPTGKTHFPASENLQVGECEGKLSIPTVREYKIAFTTENIAYDALVSNHVTWVKKMRAKYPKARIGIICNTVERAQKVAKEIGEHTIILHSRMTAEHRRQNAELLEKTIGPDKKGEGLTVVGTQAIEASLDIDLDVMRTELCPAPSLIQRAGRVWRREDINRSLRIPGAVHLPMTVVKIDNDAGFQVRPYFDAELSRTWKWLNGHHMMKMPDDCQDFIDYSKVTLDTIVEDFEGATEQLADEVLKAQEGLAVANKLGDLTKKGVTLGTLIAMTAPKESSENEASTRFIKRNTIQCILGDPTGVIPGGWGGSAERLLAARGSDQELIKAAMRGSIPIPEGSKYAAILAEKVALTQSKSLLARYYFIPNALQFYDPNVGLTVGDN

SEQ ID NO: 12671 - protein, 926 aa, Streptococcus sp. GMD6S
MSKKKSDTLWAKKKEENGRFFWLPLSQHLEDTKNIIGLLWEHWLSEGQKKLIEDSLDSVTHDGGLGKRLAQFLAAVHDIGKATPAFQTQRGFANSDDLDIQLLEKLEQSGFTKISSLQLSSPKKSHHSLAGQYLLSSYGVQEDISTIIGGHHGRPIDTIEDVKNQGSYLSNYFQNESKESAIHKNWDLVQKEIFNGALDELGFDSVRELPRIKQPAQVILSGLLIMADWIASNEYYFPLLSVNEKEEVDKLRRLQDGFERWKKTSLWQPKYISKPDSLYKERFGFEPNNVQSTLSHVITQISKPGIVVLEAPMGLGKTEASLITAEQLATKTGRSGLFFGLPTQATSNGIFNRIEKWVESLKDDSEDILSIQLVHGKAALNEDFLKLKANTFNFDDIENGSVIINEWFSGRKTSALDDFVVGTVDQFLMLALKQKHLALRHLGFSKKVVIIDEVHAYDAYMSQYLMEAIKWMGAYGVPVVILSATLPSQQRENILKSYMSGMGIKWRDIENTDQLKTDVYPLITYNDGSEIYQVTTFNKQNIKDIHIIRLQEEQLLGTVKDALEGGGVVGIIVNTVRRSQELARNFSEIFGDDMVELLHSSFIATERIQKEKELLQQIGKNVDRPHKKVIIGTQVIEQSLDIDFDVMISDLAPMDLLIQRIGRLHRHQIERPQKHEIARFYVLGTSQELDFEEGSSFVYGDYLLARTQHFLPDIMRLPDDISPLVQKVYSPDFTIEFSSQEFQQKYLDAKTEHDVTIKNKETKARTYRINDPVLKISRHRNNSLIGWLKNLHPNDSEEKSNAQVRDVEDTIEVIALKKMSDGYSLFIENQDISQNIDNPLVAKKVAQNTLRLPMSLSKGYNIDQTIEELERYNNSYLSQWRNSSWLKGALGIIFDENNEFILNGFKLLYDKKYGITTERLNKNESI

SEQ ID NO: 12672 - protein, 926 aa, Streptococcus sp. GMD1S; identical to SEQ ID NO: 12671

SEQ ID NO: 12673 - protein, 719 aa, Bacteroides fragilis HMW 610
MGSRYDYILAKSESNGGTPLKSHLESVAFFAQIAARYAGMDENVVKIGALLHDIGKASPLFQARLKGEKTPYEKVFRHEVASLFFLKLIERSLWPEVIDMIIAHHKSVYKDRSSSGLLDLKDYYGEENTFSDHVAGFPSWNVDAIGILRELNFPGLSADSLLSEEDALEAYRYAIEHCRRKPKGWSKWKGLLMGVDHLASATEEFKERIPTLFSIPDVGFYNRQHPLYPLSQVLSEANKKHTFVKAPTGAGKTDFLLKRCQGRIFYTLPFQASINAMYERIHRDLNGMVEDVRLLHSMSRLVIEGEKAWEEKVIQDKIGASIKVLTPHQLASVSLGTKGYETLLFDLCGCDIILDEIHTYSDIMQSIILTMIEVLVHIGCRIHVGTATMPSELEQKILDILGRDKTQQVELLPSVLDSFNRHIVHKVTDFDSVLPVLREAIENDQKILIVCNRVRNAQILFERIDELYPEVDKMLIHSRFKRKDRNRLEKELQDTYNKMPRACIVVSTQVVEVSLDISFDMMITETAPIDALIQRFGRINRKRKPKEERTLKHIYVIAPPDKKEDCLPYSQEILQRSYDALPQDSLLEESSLQRLIDQVYPQVNVIDLSLDAAFADGKWRLKELFHLPKSAFIEKLDIDSVSCITQEDADTGKYREATAEERILMEIPMRYSSLRWKKLETFPYGSHPFVIPDIAYSSDRGLDVTKMGAENYDTNYQML

SEQ ID NO: 12674 - protein, 811 aa, Cecembia lonarensis LW9
MSVFSHSKQINGSKIGSKQLIEHAKGVHNKAVFGYYNQLSFSDKYSIMDILKNICWLHDFGKYTKYFQDYLIYPEKADNLLKSHSNLGAVVTYNLMQSISQEIALIGYYLIKLHHSNLRDFELTIDPVGYREKIELEKFKLQIKALQDYSELLEFIKIDDSHLNFRSTSDFYRCFKNYFRKDAKIERYFLINYLFSLLIESDKIDASDSKIYIRKTSNPNAVDERKGFGKPDCPNKHLSEFDQKDLRNYVRKRVVEKTEITDILFYRIFTLAAPTGIGKTMTALDFVLKLKNKIVLREKRVPQIIYALPFINIIEQALREYELTVSNDLKILGHYQYADIFGDDKFEENGSNYNQKKMEWDTWQCDIVITSFVQLFETLIGYKNKLLKKFHHLAGSIIILDEVQTLSIEKLPLIGASLHFLSKFLDARIIIMTATQPKIFELMERELSITPETDSLKPFDLLPESNQIFECFNRTKIIPINISTESNCSTIDNENFIGTFQKYWTESKSCLIVLNKVQRSIDIFDLIQEFISSNLFENPIFYLSTNITPIEREKRIADIKSSIRKGNKPILIATQVVEAGVDLDFDMGFRDLGPIDSIVQVAGRINRENDPDRFGSPLYILNFGDCRQIYGSVTDSKARGALSNREMIEEKDYKYLVESYFEAVSETNQTDFSFSRDIFKAMKELRYDKPEKSKNEPKCISDFKIIEDSNNGMSVYVEDPNDSISELARKSFQDLLHQKISKEEFDSLHKRNFNQRIISVPNYFETSLELRKEPQLGENIYWIRAEDFNYYYNENTGFIRKPGNKSVIVSF

SEQ ID NO: 12675 - protein, 818 aa, bacterium
MFKDKELIARLDQSLQEHLEEVSKLSSEFASKIGLKKYGEIIGLLHDIGKASSDFQQYIKSAVGLIDSDEEDYINSSELKGKIDHSTAGAQLVYKTLMKNPGEKFIAQILSLCIASHHSGLIDCISPDGVDLFSKRMNKSDERTHLNEVLNINDEQIINSISFLQSEEFKSDLLIYFKSLKIEKQDSVQTLTFKWGLLIRFLFSCLLDADRLNTADSEHPQKAKFRLNGVYVKWIDLCKRFNKKLSELENVSGINIIRQKISNTCYEFSNQPKGLYQLTVPTGGGKTFASLRFALNHADKYHMDRIIYVLPFTTIIEQNAEEIRKILEDVDENGNYLGDVVLEHHSNLLPENETAKQKLLSENWDAPVVLTTSVQILEALFGAGTRGARRMHQLANAVIIFDEVQAIPVRCVHMFNSAVSFLVNNCGSTVILCTATQPLLDRIEPKSRALQINEKQQIILNARQLFSDLKRVQLCDDRKIGGWSTEEISELAIKQVTDSGNVLIVVNTKKSAQEIYKKCKLMSNIELYHLSTYMCPAHRLYALNKIKSCLQDKKKVVCISTQLIEAGVDISFASVIRFMTGFDSILQAAGRCNRHNDYFPKLGKVSIINPSEEKIDSLEDIKIGGEKTERLLDEFKKDPDKFDNDLLSPKTIEQYYQYYFFQRKDEMNYPVKSSSGVDRNDNLYELLSTNQNSVQEYQRINNSHPNIAIRQAFMTASKAFQAIETFSKGIVIPYGKDGKEIINDLCSKFELNKQYKLLHKAQRYSVNVYPNIFNKLLENGIIREVQKGSEIYYLDEKYYSDEYGLSLIAIKDDEFLNG

SEQ ID NO: 12676 - protein, 713 aa, bacterium
MNTAEKYLKNLFAQCSNELNLRNFNQLQNDSIIPVLNGRSILLSAPTGCGKTEAVIVPLLEKIIENDICRGVVKTRVIYICPTKALINDLYNRFKWVKERLGIKLAIKTGDIDDTATGEIPRIIFTTPESLDVMISARIDERSDTYSRNMECLRSVRTVVIDEIHQFASEVRGEHLRWLLFRLKRLTARPLQVIGMSATIPEIEKVGRYIGQFGESPELISFSSQKRDLYFGLRTIKTVDELYDIVVKLRRNIEARKILIFAGTRNECDIIHEKLIKRDPELNCFVHYSTISVEERERTEAEYKFSAHHSICIATSTLELGIDIGDIDAVILYGAPGNISSFIQKIGRGNRRKKTIFALGIVRDFRDDIVNTDLVKFIGILELFYNNEFEHITQTVFYSVVVQQIFSYSKSRGFFLPEEFRELASELKHDKWTITEIIRHLSFINIISKPLSHIDKYCMSDWMFGKIARREIYGNMASGGIGKIMIVGSDNRKIAEVPLEGNEKKIKPGALIRIGGKKYAVISSRRIMQNISAKVEPTVSSREPVNISYNSQGVPTSFSVCNNSLKTSLELIYAKTDIDHPTKESIEHILNTFKPRKNLVVKYRLLRDENYIYYTFAGTIGNYIIACSQDEVEGYDPIRILMNKKIEPVEFDELFIKRLIAANLENFSVIAGKSEFFEFLPASMQVDEIYSGIEPELIEFLGKFHLNKFVKIL

SEQ ID NO: 12677 - protein, 795 aa, Salimicrobium jeotgali
MNFIAHVREEDGREQMLRDHLVEVKELGEKFGEPLHLSYTIGLAGLLHDIGKYTVEFQTYLNEAVNNPDCPPKKGSVVHSRAGGKLLYDLLHNGKPGSLAKGLVAEIVGNAIISHHAYINDFIRPSDLDTPYRNSVVEKEVNEYHDLKQRFFRDVMKEEELTEYIKKAIIEIDEIINDTPQEEVYSTMSYVTKMVYSSLIDADRTNTRDFEQNLKKTAPPSMNVYYNRLTTHLQQFENPHNPINKLRNEMSEICDEFAEKPSGIYTLSIPTGGGKTLASLRYALKHASLYSKERIFFIVPFTTIIEQNAEEVRSILQEYSYILEHHSNVVTHDSEEEDEGALDAHQKLKIAEENWDTPIVFTTMVQYLNAIYHRKSSSARRLHNLSNSVLIFDEVQKVPSDCVSLFNLSVNYLCHYANSSAILCTATQPSLEYVHNKLKIQEDAEIIPHIEKISRKFERVDVVDCATDGQMNNDDLKNFILDKKDKEASVLIILNTKQVVKDLYHKMKESTSYDIYHLSTAMCAEHRRNFIDKINEKVKSGQDMICISTQLVEAGVDLDFDCVIRSAAGLDSIAQAAGRCNRNGKAEKKNVYVINHSEESLSKLKEMKIGKNISLRLMKDIKKDPAKNILEPYVMKRYFREFYQEVQNRLDYPIPNTTDETMINWLSDNRITVTNYVQRNDSPDFILRNSIRSAAEKFQVIPDLTTSVIVPYCKEGKDVIATLNDGQTIEELSDFLKKAQKFSVNVFPHELQTLQKKNGVRGYIDGSVKVLVEGFYDDEFGLAISGEVGSGGLIY

SEQ ID NO: 12678 - protein, 726 aa, Oceaniovalibus guishaninsula JLT2003
MIYAHSVTDRPLAEWETLEAHALRVAEAAQARAEAFGGGDVARMLGLLHDLGKAKPAFQRKLEGQRIEVAHSAEGARVLAGMGGFGRALAGIVAGHHGRLPDPDRLKARLATAEDMPLPDWCAIPTPVPPARLGEDSELALYRLQFLVRMLYGVLCDADDRETAAFYAEAEGRTVPERPTILTPPMRASFDAHMDGLGGGGAVNDLRRRVLAHARGVAAEAPGLFTLTVPTGGGKTLTSLGFGLDHALAHGLRRLIFVVPYTSIIEQTADVFRRVLGEDAVLEHHSNADWDGEDETEAEQRRVMGASWDVPVVVTTAVQFFESLHAARKKRCRKLPSLARAVIVLDEAQTMPLPLLRPCLAALRELMEGYGASVVLSTATQPALTKDGGFPGCEALEGAREIAPDPTRLFAALKRVEVRDAGPLDDAALADQIRKADRILTIVDNRRQARALFDAVRGAEGAAHLSTLMVPAHRRAVLANVRARLKDGAPVRLVSTSLIEAGVDVDFPVVLRAAAGIDSVAQAAGRCNREGRLDGPGLVEVFRSEHPAPPAVEQFAAIGRDVLAEGHDDPIGEAAVASYFRRLWDAYGKDALDAAEVGPMRIRGILNAIRKAGPCCPFEQIEAAFRIIPGGERSVIVWDRMWGVTWGASSDTQKTLRFGSAGAVARLVAPHSVNVPWGLWKALRDSGQVAWWMPERFEEQFAVLRTSDLYNADAGLGESGDVGGVF

SEQ ID NO: 12679 - protein, 1122 aa, Vibrio cholerae HC-50A1; identical to SEQ ID NO: 12513

SEQ ID NO: 12680 - protein, 1122 aa, Vibrio cholerae HC-52A1
MMVTFVSQCEKNALKKPRRVLDAFANRIGDNTWQTLITEEGLLTVKKMLRQTASRSTAVSCHWIRSRSRSQFLWVVGNKKKFNAEGYVPVNSTEKNLLNSEFENDWKYLPLIKAITGMAALLHDWGKASLLFQEKLNPEIKNKHKGDPLRHEWISCLLFQQWISNQTHERLDEVWLNSLIDKGIDETCFNTNVLQKEKALAELPTAAALIAWLIVSHHRLPLPKEKDLCDRQREADNSSLADLLARITPAWGYENRFDEYNALLPKCFEFPLGLLSNSSIWLAELKRRAKDLLHHLPLLVQAINDGSWRGILHHARLCLMLGDHYYSSQPNDHQWKTSIELYANTDPSTKARKQKLDEHLVNVAKVAVNTVKLLPFFETEPLKATELYELAPKANTPKAFRWQDKAVRKINEWREHTEDKSQGYFVVNMASTGCGKTIANAKIMQALSEEGESLRFILALGLRTLTLQTGDEYKERLKLQESDLAVLIGSKAISELHKSGKAVEKDDIEPEQADAGSESLESLQDENDVLDWQGVLPEEELTTVLTKEKDRKLLYAPVLVCTIDHIMAATETKRGGRYILPCLRLMSSDLVIDEIDDFTGDDLIAIGRLVHLAAMLGRKVMISSATIPPDLALGLYNAYRQGWAVFAASRDRVSTVNCVYVDEFSADVQMVGCNDSDLAAYQEFQQSFVSKRVDKLKQQVAKRKADIIPCIKQNDQPLEQQYFEIVKQAVLAKHQHHNTLEPESQTRVSFGVVRVANIQPCVELTQYLLSCDWPADTEVRCMAYHSQQVLLLRHTQEKHLDEVLKRKEKTGELPEAFAHPVIRDHLTTCQAKNLIFILVATPVEEVGRDHDFDWAVIEPSSFRSIIQMAGRVRRHRDGEIKEPNIGLLQYNVKGFRGGAERVFNHPGYETDSTTQLATHDLCELVDEKSLLQAVNAIVRIQKRVVLESHNNLADLEHFATAKTLGIDQIGKPQQVNISRQERYSRNRRNSAPQSCWHEHLHGHIHGYWWLTALPQYFKRFRKSEPTVQIYLVKKARSIEFCLREEGMPSIDEVLNIKHLPLPPMQQQKLWLQRDYSELVSIYSPSAEQEFDTSVRYGEISFIYREGNQQYSYNDQLGLVKVK

SEQ ID NO: 12681 - protein, 1122 aa, Vibrio cholerae HC-56A1; identical to SEQ ID NO: 12513

SEQ ID NO: 12682 - protein, 1122 aa, Vibrio cholerae HC-55A1; identical to SEQ ID NO: 12513

SEQ ID NO: 12683 - protein, 1122 aa, Vibrio cholerae HC-57A1; identical to SEQ ID NO: 12513

SEQ ID NO: 12684 - protein, 1122 aa, Vibrio cholerae HC-51A1; identical to SEQ ID NO: 12513

SEQ ID NO: 12685 - protein, 730 aa, Escherichia coli 3006
MDELDNFLPEDKAAARDFLLAIKPLFPLIEIPAFWDDDEGIELIKHLSWYISATVVLADWTGSSTRFFPRVAHPMDIKGYWQKTLVQAQNALTVFPLKAKVAPFNGINTLFPFIENPTPLQQKVLDLDISQQGPQLFILEDVTGAGKTEAALILAHRLIAAGKAQGLFFGLPTMATANAMYDRLVKTWLAFYSPESRPSLVLAHSARTLMDRFNESLWSGDLVGSEEPDEQTFSQGCAAWFADSNKKALLAEIGVGTLDQAMMAVMPFKHNNLRLLGLSNKILLADEIHACDAYMSCILEGLIERQARGGNSVILLSATLSQQQRDKLVAAFARGTEGQQEAPFLEKDDYPWLTHVTKSDVNSHRVATRKDVERSVSVGWLHSEQECIARIESAVSQGKCIAWIRNSVDDAIKVHRQLLARGVIPASSLSLFHSRFAFSDRQRIETETLARFGKYCSLQRASQVIVCTQVIEQSVDIDLDEMISDLAPIDLLIQRAGRLQRHIRDINGQLKRDGKDERSPPELLILAPVWDDSPGDEWFGSAMRNSAFVYPDHGRIWLTQRVLREQGAIQMPHSARLLIESVYGEDVVMPEGFARSEQEQVGKYYCDRAMANKFVLNFRPGYAANINDYLPEKLSTRLAEESVSLWLATCIDGVVKPYATGAHAWEMSVVRVRRSWWKKHRDEFSLLEGEAFRLWCIEQRQDPEMANVILVNDDESCGYSATEGLIGKVG

SEQ ID NO: 12686 - protein, 1122 aa, Vibrio cholerae HC-1A2; identical to SEQ ID NO: 12513

SEQ ID NO: 12687 - protein, 1122 aa, Vibrio cholerae HC-55C2; identical to SEQ ID NO: 12513

SEQ ID NO: 12688 - protein, 1121 aa, Vibrio cholerae HC-60A1
MVTFVSQCEKNALKKTRRVLDAFANRIGDNTWQTLITEEGLLTVKKMLRQTASRSTAVSCHWIRSRSRSQFLWVVGNKKKFNAEGYVPVNSTEKNLLNSEFENDWKYLPLIKAITGMAALLHDWGKASLLFQEKLNPEIKNKHKGDPLRHEWISCLLFQQWISNQTHERLDEVWLNSLIDKGIDETCFNTNVLQKEKALAELPTAAALIAWLIVSHHRLPLPKEKDLCDRQREADNSSLADLLARITPAWGYENRFDEYNALLPKCFEFPLGLLSNSSIWLAELKRRAKDLLHHLPLLVQAINDGSWRGILHHARLCLMLGDHYYSSQPNDHQWKTSIELYANTDPSTKARKQKLDEHLVNVAKVAVNTVKLLPFFETEPLKATELYELAPKANTPKAFRWQDKAVRKINEWREHTEDKSQGYFVVNMASTGCGKTIANAKIMQALSEEGESLRFILALGLRTLTLQTGDEYKERLKLQESDLAVLIGSKAISELHKSGKAVEKDDIEPEQADAGSESLESLQDENDVLDWQGVLPEEELTTVLTKEKDRKLLYAPVLVCTIDHIMAATETKRGGRYILPCLRLMSSDLVIDEIDDFTGDDLIAIGRLVHLAAMLGRKVMISSATIPPDLALGLYNAYRQGWAVFAASRDRVSTVNCVYVDEFSADVQMVGCNDSDLAAYQEFQQSFVSKRVDKLKQQVAKRKADIIPCIKQNDQPLEQQYFEIVKQAVLAKHQHHNTLEPESQTRVSFGVVRVANIQPCVELTQYLLSCDWPADTEVRCMAYHSQQVLLLRHTQEKHLDEVLKRKEKTGELPEAFAHPVIRDHLTTCQAKNLIFILVATPVEEVGRDHDFDWAVIEPSSFRSIIQMAGRVRRHRDGEIKEPNIGLLQYNVKGFRGGAERVFNHPGYETDSTTQLATHDLCELVDEKSLLQAVNAIVRIQKRVVLESHNNLADLEHFATAKTLGIDQIGKPQQVNISRQERYSRNRRNSAPQSCWHEHLHGHIHGYWWLTALPQYFKRFRKSEPTVQIYLVKKARSIEFCLREEGMPSIDEVLNIKHLPLPPMQQQKLWLQRDYSELVSIYSPSAEQEFDTSVRYGEISFIYREGNQQYSYNDQLGLVKVK

SEQ ID NO: 12689 - protein, 1122 aa, Vibrio cholerae HC-59A1; identical to SEQ ID NO: 12513

SEQ ID NO: 12690 - protein, 1122 aa, Vibrio cholerae HC-61A2; identical to SEQ ID NO: 12513

SEQ ID NO: 12691 - protein, 1122 aa, Vibrio cholerae HC-02C1; identical to SEQ ID NO: 12513

SEQ ID NO: 12692 - protein, 1122 aa, Vibrio cholerae HC-55B2; identical to SEQ ID NO: 12513

SEQ ID NO: 12693 - protein, 1122 aa, Vibrio cholerae HC-59B1; identical to SEQ ID NO: 12513

SEQ ID NO: 12694 - protein, 735 aa, Acidocella sp. MX-AZ02
MKRFAHSVPNLSDETLWEPLSDHLRDVAGMAGKFGDPLGLGVWAHVAGLLHDIGKASDAYQSYIRGKGSSPDHSTAGAREAVQQFGLPGRFLAFAIAGHHAGLADGKMLNERLCKKLEKYTGWEAYTGALPALTSLADKRRNPEKNFSQAFFVRMLFSCLVDADFLATEAFYSPGATLKRDGFSAISTLQTRLARFMAGITKDQALGLNGLRHQILTHAVARAELPPGLFTMTVPTGGGKTLASLSFALRHAVKHGLCRVIYVAPYTSIIDQTAQVFKNALGDEDVLEHHSGLDWEEAEKEGDPDGVQKLRNATENWVSPIIVTTAVQFFESLFAAKPSACRKLHNMARSVIVLDEAQTLPLPVLRPCLAALEELTLNYGASVVLCTATQPAWRRQDGALPSIKGSRQLGLDIPQSRELAPDPVGLFAALKRVRVEVLPSPVTDADIAARFAEQERMLCIVNSRAHAKSLFDEIAALPGARHLTTLMCAAHRSEVLTQIREDLADQRPVRLVATSLIEAGVDIDFAEVWRARTGLDSIAQAAGRCNREGKQAGLGRVVVFTPAARQAPKAFRAFAQAAEGALNMPDPLGLDAVHRYFRELYFNRGAERLDALMIDGLPGVLKAISDADLPFASIAEAFKLIDETMRGVIVNWQGRVTEALAALRAAPVPPRNVMRKLQLFTVPVPEAMWKVLRASGGIQPIRPEDYGERFMLVENSRLYDDTTGLLTSDEGVLIF

SEQ ID NO: 12695 - protein, 739 aa, Parabacteroides goldsteinii CL02T12C30
MKNEQDFIAHVKVEDDAFQIQTVKEHAVGTAGLSESFASVFGAAVWGKQNGWWHDMGKYTKDSFQPYIRSASGMTAEQKVVNKPDHSSAGAMLAKEKLPGYYQPLAYCIAGHHSGLLDWTSSGEANLNKRLSKTDCYQEMLNDAPEEMREAVVSLNAPMISDFQKEMHQWIRMLFSCLVDADYLDTERFMQPEQAVRRGQYDSMELLKDRFDTYMESLTAGAPASFINEKRAAILSRCREMAEKLPGFFSLTVPTGGGKTLASMAWALIHAVRYKKDRIIIVIPYTSIIVQTAAVLRNIFGAENVVEHHSNLQPDSNDERSPSQLATENWDAPIIVTTNVQFFESLYACRTSRCRKLHNICNSVVILDEAQMLPVEFLQPILDILQSLQSSFKTSILFTTATLPVFAGHIGTGQKAFSGLKSPVTEITSMHDHLFEAFKRVELHWPESTTNFDDLADELSGYDCVLCIVNTRKEARELYQRMPEGTLHLSRMMCSVHIMEVIKLIKQKLKDNEPVRVISTQLVEAGVDIDFPVVYRAFAGLDSIIQAAGRCNREGKLNKKGELGQVFVFKPENSTLRGLMGKGAAALREMLSISDGSDLFSPDCMAQYFRLFYSNCNTFDKAEIKDSLYKGAGEMNFLFATAADQFRLIDDKDSVSILVGYGDGATLLEELKRIGPEFWLLRKLQQYSVSVRKWDFEQFRKQGTVGEYAGIFILEDGRCYDEHAGLVLDGAWVEELLLV

SEQ ID NO: 12696 - protein, 714 aa, Parabacteroides distasonis CL03T12C09
MKQSKYKYIAHSENSNGAEQSMKQHSESVAELMRSFALADDFAEIYSYCGLLHDIGKYSKGFQNYIRSREEKEPHAKWGAYIALMNKLVNIAFPVIGHHAGLPNRDAMVETLGLCAKDENRWKNIQQAMEEDYFIISMCDNSSFNKIGNVFQKELFVRLLYSALVDADSLDTERHFQKEQYDARSCKILDVDALLAALNKRFDSFKQVTPLNELRTNVRLYAQSLANADQGCFSMTLPTGMGKTLTSLNWALYHAEAHPNIKRIVIVLPFISIIDQTANELKTIFKDYDVILEHHSNVNYEEADEEESYCKDSKYLATENWDYPIVITTAVQFFESLFSNQRSKCRKLHNLQDSIVIFDEIQTLPVNLAECTMKMLNDLLHLCRCSFLFCTATQPNFQTRKDFCGIDHITPLVENPASVFASTKRVKYISIDDYKAQSFESIADCVVEQNGSVLIVCNTKKKAMALFECLKTRSEIPVLHLSTNMCQAHRIEIIKRVRIKLKEGEKLILCSTQLIEVGVDMDFPVVFRELAPLESIIQSAGRCNREGNLKEGQVYLFQLEDQGQPSRQYIAFAQFAQLCYRGNEDRLSDADFYTDYYTNIIKNYSLKDNVTPKREKLMFQDVADMYHIINSNTTTLFIYQYDNESKHLYNEIKDKEYLSRKDYQKIAQYCVQVYEWFTKANANKISEISNGVKIWFGAYSKEIGLSNEDEIYYI

SEQ ID NO: 12697 - protein, 741 aa, Parabacteroides merdae CL09T00C40
MMKEQDFIAHVRVEEDAFRIQTVKEHSVGTATLSESFASVFGAAAWGKQNGWWHDMGKYTKNSFQPYIRNASGMAVEQKVVDKPDHSSAGAILAREKLPGYYPPLAYCIAGHHSGLLDWTSSGEANLNRRLSKTDCYQEMLKDAPEEMQEVVASLDQPLIDDFEKDIHQWIRMLFSCLVDADYLDTERFMHPEQAARRGQYDSMETLKDRFDVYMESLTANAPASFINEKRAAILSRCRKMAESLPGFFSLTVPTGGGKTLASMAWALLHAVRYKKKRIIIVIPYTSIIVQTAAVLRDIFGAENVVEHHSNLQQDSNDERSPSLLATENWDAPIIVTTNVQFFESLYACRTSRCRKLHNICNSVVILDEAQMLPVEFLHPILDVLQSLQASFKASILFTTATLPVFSGRIGTGPGAFDGLKTPVTEITSVHDNLFEAFKRVELHWPEPGTTTNFDELADELSGYDCVLCIVNTRKDARELYRRMPEGTLHLSRMMCSAHIMEVIKLIKQKLKDNEPVRVISTQLVEAGVDIDFPVVYRAFAGLDSIIQAAGRCNREGKLNHVGKLGQVFVFNLENTLLRGLMGKGAAALREILSVSDGSDLFSPECMAQYFSLFYSNCNTFDKANIKGLLYKGFAEMHFMFATAAEKFRLIDDKDSVSILVGYGDGATLLEELKRIGPEFWLLRKLQQYSVSIRKWDFEQLCKQGTVGVYAGIFILEDGRCYDERAGLVLDGAWVEELLLM

SEQ ID NO: 12698 - protein, 779 aa, Bacillus azotoformans LMG 9581
MVIETLFKELTGYNPYPFQLQASQEIFKNEKFVITAPTGSGKTWMSVIPFVYAKENNILFADRMFYVLPQRTLVTAVANTIKPILEKRNLKVTVQMGGQNEDPYFEGDVIVTTIDQILAAYLGLSYGTSKNASNIAPGALMGSYIVLDEFHLLEADKSLATYVDMMNFLSPFVRTCMMTATATEKYLDAISSKIKGKYQVVSGQDIVQLQTSMNEVRKREVIWCDIPIDAEVILKQHKDRTLVVVNTVKKVQALYNELTEKIKRSGFDIEVVCLHARFLKEDRDTLELKIKDCLKRSSKKEIIVIANQVVEVGLDISASVLISDLCPANALIQRIGRCERYGEFIGKVFVYAINNHLPYDEDLVNRTGDYLKEQTPLFMTAIEELEMVETVHANREEKLLNSLSFSKVRELVEKTQSEGNRSSIKNLIRDIDNIQVLIHPKPWELDLYKKPEYFSIPYSTLLNYLRNIEQPSKYVFYPEFPNDYQSKYSKEVHWNLVEDIKNIYNYLFVALSPKIASYSKEIGFSLDKGEFISKETLSEIEKRQRFSYKKETYVEHALDVRKKIRSSDDKYNVVTSQFAQILNCNSNFVGELAELVGALHDAGKLIEKNVLVSQKWQKKIIGDETKEYLAHTDFDPSNPYHLQKEKEKEFKRAHHAAEGACAVLPILELQTKNLQLEKEIAGQIILSMYSTIKRHHGAYTKKMEEYCLIEDASKVIRKSLQGLFENETPLNREVGPSKAMLYEKFVLNAAEKQKLGWLLYWFFSRRLRLADQLSQQEKL

SEQ ID NO: 12699 - protein, 752 aa, Leptospira interrogans str. 2002000624
MILLAKSYPGIEKQLKSGDPESWALLEHHSSATYQVAEVLLKILEPILRKWTRLSESEYNKFVLVVCLSAGLHDLGKANEDFQKMLQRRKYLQRFRHEIWSVLALTGSSPFSDWFRKTIGDETWVRIGQMGILSHHLKATRETLYADHETAEIKVFWKDQGVIKMFQSICRLAGISSPDFSSSSISSYTCLGEDADKSIRIWTREILNARIDPRYQHSIGAVRAMIIAADRLASAYKGADALKLWAEEALNRVLSEQECSNIVKQGLGEKNLRPFQKQVGDSTSRVTLVRAGCGNGKTIAAFQWAKTHSAGRKLFFCYPTMGTATEGFRDYVSDIPGLDALLSHSRASLDLGELASTGEEDEGDSPNMHSRMLQEWTAQVTFCTVDQILGLLQNYRSSLTLSPAIFLGAFVFDEIHMYDSILFGNLLTFLKEFSHTSILLMTASLPETMLSAIQETVGADLGPVISGEAQIEERLRYRILHSSREDALQKAIQEFKNGGRVLWVCNKVEHCLKLYDELSEKYDIEALVYHSRFKYEDRKERHRAVIDSFQEGYKKSLPVFAITTQVCEVSLDISATLLISELCPFAALIQRLGRVNRPGQEMEGIAQALIIPFQGKPYEKENENDGESELERCKEILKPLLDRELSQKDLALALENAKGTEHQKIPSQWLSLGWEAKPDSIRESGYTLDVILESDAYKVLKNERPWEKSKLYTIPMPIQKQFSYGEPPLRIPVVPDSQIQYSSVRGGEWNLN

SEQ ID NO: 12700 - protein, 757 aa, Leptospira interrogans str. 2002000624
MKRNKQSIFIGHILRKDDGNFVEHLLDDHLYSVAELTEKFCEKFGAGTFGYLIGLWHDLGKFKLEFQERIRIRSGHIGEKAHLEGKTAKSVKHSASGAIHCFNKFKQSDIIKKLICLPMLCHHSGLKNFGIDVDIQLNEEREILALSETTPHIPQEILDGIDLKQLGKSFKDHSLLIRMLFSALIDADRLDTERFMDPAKFKERYSKTIILQDLNIKLDKHLKNIQKQADTTKVNSIRKRILKEVQSKTNLKPGFYTLTVPTGGGKTLTSLSFALKHCITNKMDRVIYGVPYLSIIEQTTDVFKKILGEDSVLEHHSGIDISKEKENSINRLLTENWDHPLIVTTNVQLFESLFSSKTTKVRKLHNIINSVIILDEAQMIPPQFLQPIVKTLKEIVKFYNVTIILCTATQPTLSSIKSIDLNFDGINTAIELAPEPEKLFQELKRVIIHKSEERKLSFIEIATKISNYDQVLTIVNRKSDSSGIFNQLTGNKYYLTTNLCAEHRRDILKKVKSHLSNGESVYLVSTQLIEAGVDIDFPIVFRAVAGLDSIAQAAGRCNREGKLVDENGQEKLGEVFLFHLQQDPPSGHLLQTKQASEDCIKNFEELIHPDTLKQYFNTLFWLKQDKGLDKEEIEKDKRSFQFETINKNFKLIDKDSRPVIVPYKEGKDLIVQLQNSVVQNNFVDYKLIRKSQRYTVNLKTNLYNKLLSEGIISEIEGIIGIIGIIGIIGIIGILNFDSYYHNDLGILESPNDQDLII

SEQ ID NO: 12701 - protein, 745 aa, Leptospira interrogans serovar Pomona str. Pomona; identical to SEQ ID NO: 12647

SEQ ID NO: 12702 - protein, 752 aa, Leptospira interrogans str. C10069
MILLAKSYPGIEKQLKSGDPESWALLEHHSSATYQVAEVLLKILEPILRKWTRLSESEYNKFVLVVCLSAGLHDLGKANEDFQKMLQRRKYLQRFRHEIWSVLALTGSGPFSDWFRKTIGDETWVRIGQMGILSHHLKATRETLYADHETAEIKVFWKDQGVIKMFQSICRLAGISSPDFSSPSISSYTCLGEDADKSIRIWTREILNARIDPRYQHSIGAVRAMIIAADRLASAYKGADALKLWAEEALNRVLSEQECSKIVKQGLGEKNLRPFQKQVGDSTSRVTLVRAGCGNGKTIAAFQWAKTHSAGRKLFFCYPTMGTATEGFRDYVSDIPGLDALLSHSRASLDLGELASTGEEDEGDSLNMHSRMLQEWTAQVTFCTVDQILGLLQNYRSSLTLSPAIFLGAFVFDEIHMYDSILFGNLLTFLKEFSHTSILLMTASLPETMLSAIQETVGADLGPVISGEAQIEERLRYRILHSSREDALQKAIQEFKNGGRVLWVCNKVEHCLKLYDELSEKYDIEALVYHSRFKYEDRKERHRAVIDSFQEGYKKSLPVFAITTQVCEVSLDISATLLISELCPFAALIQRLGRVNRPGQEMEGIAQVLIIPFQGKPYEKENEDDGESELERCKEILKPLLDRELSQKDLALALENAKGTEHQKIPSQWLSLGWEAKPDSIRESGYTLDVILESDAYKVLKNERPWEKSKLYTIPMPIQKQFSYGEPPLRIPVVPDSQIQYSSVRGGEWNLN

SEQ ID NO: 12703 - protein, 745 aa, Leptospira kirschneri str. H1
MTKDKQSIFIAHVLRKDDGSFVEHLIDDHLYSVAEFAKKFCEKFGAENFGYLIGLWHDLGKFKLEFQERIRIRSGHIGEEAHLEGKTAKSVKHSVSGAIHCLNKFKQSDIIKKLICLPILCHHSGLKNFGIDVDIQLNDEKEISALSETITYIPQQILDGIELKQLGKSFKDHSLLIRMLFSSLIDADRLDTERFMDLVKFKERYSKTIILQDLNIKLDKHLNDIQKQADATKVNSIRKRILEEVQSKTNLKPGFYTLTVPTGGGKTLTSLSFALKHCITNKMDRVIYGVPYLSIIEQTADVFKKILGEDSVLEHHSGIDISKEKENSINRLLTENWDHPLIVTTNVQFFESLFSSKTTKVRKLHNIINSVIILDEAQMIPPQFLQPIVKTLKELVEYYNVTIILCTATQPTLSSIKSTDLNFDGIDTAIELAPEPEKLFQELKRVIIHKPEEKKLSFMEVATRILNYDQVLTIVNRKSDASGIFNQLTGNKYYLTTNLCAEHRRDILKKVKNHLNNGESVYLVSTQLIEAGVDIDFPIVFRAVAGLDSIAQAAGRCNREGKLLDENGQEKLGEVFLFKPEQDPPAGHLLQTEQASRDCIKNFEELIHPDTLKQYFNTLFWLKQDKGLDKEEIEKDKRSFQFETINKNFKLIDEDSRPVIVPYKEGKDLIVQLQNSVIQNNFLDYKLIRKSQRYTVNLKTNLYNKLLSERIISEIEGIIGILTFDSYYHNDLGILESPNEQDLII

SEQ ID NO: 12704 - protein, 745 aa, Leptospira interrogans str. UI 12621
MKRNKQSIFIGHILRKDDGNFVEHLLDDHLYSVAELTEKFCEKFGAGTFGYLIGLWHDLGKFKLEFQERIRIRSGHIGEEAHLEGKTAKSVKHSASGAIHCFNKFKQSDIIKKLICLPMLCHHSGLKNFGIDVDIQLNEEREILALSETTPHIPQEILDGIDLKQLGKSFKDHSLLIRMLFSALIDADRLDTERFMDPAKFKERYSKTIILQDLNIKLDKHLKNIQKQADTTKVNSIRKRILEEVQSKTNLKPGFYTLTVPTGGGKTLTSLSFALKHCITNKMDRVIYGVPYLSIIEQTTDVFKKILGEDSVLEHHSGIDISKEKENSINRLLTENWDHPLIVTTNVQLFESLFSSKTTKVRKLHNIINSVIILDEAQMIPPQFLQPIVKTLKELVEFYNVTIILCTTTQPTLSSIKSIDLNFDGINTAIELAPEPEKLFQELKRVIIHKPEKRKLSFIEIATKISNYDQVLTIVNRKSDSSGIFNQLTGNKYYLTTNLCAEHRRDILKKVKSHLSNGESVYLVSTQLIEAGVDIDFPIVFRAVAGLDSIAQAVGRCNRESKLVDENGQEKLGEVFLFHPQQDPPSGHLLQTKQASEDCIKNFEELIHPDTLKQYFNTLFWLKQDKGLDKEEIEKDKRSFQFETINKNFKLIDKDSRPVIVPYKEGKDLIVQLQNSVVQNNFVDYKLIRKSQRYTVNLKTNLYNKLLSEGIISEIEGIIGILNFDSYYHNDLGILESPNDQDLII

SEQ ID NO: 12705 - protein, 752 aa, Leptospira interrogans str. UI 12621; identical to SEQ ID NO: 12649

SEQ ID NO: 12706 - protein, 932 aa, Leptospira santarosai str. MOR084
MEAEEKSYYKYWGKADQEGNYHLLVYHCLDVAAVGEVYLSQNETLCVHLSQKLGIDPPTFKNLFVFFLVLHDLGKFSDCFQSLIPNIKRILGNSNSPIGPYSVRHDSLGYIFWGEWILKDKRFGNYDGLLTEQNWLGWNGLRSSKEKSYFTEFLDVLIRCVTGHHGRPPSKNGYSGQTAVSPDSHFTEADRSAALAFCKEVNRIFSPNFEGDFKSLFDSTLPISFWLAGLSVLCDWIGSNSEIFKYHWTPIDLEEYYTTISLINAQKTVLKSGLSSAKIAFNENHFRIFEYLREPTPLQKFCSEVVLPDSPSLFILEDVTGSGKTEAALILTHRLMQKNAYSGFYVGLPTMATANGMYRRMSGVYRNLYTKESLPSLILAHGARNLSDSFQSSVISDNAILADRNYQSDKDPEESATAICNIWLSDNQKKSLLADAGVGTIDQALLSVLSAKFQSLRMFGLSRKVLILDEVHSYDPYMVELICCLLKAQAKIGASVILLSATLPKILRKRFSDSFALGLDTELQDIKSGEYPLVSLVSNRFEVEETPISTRKEVGRKLNVEFLFDQETVFQKILEMSNQGRCVCWIRNTVSEASQAFFFLHSKLGDRVILFHSRFAMGDRLNIESQILENFGVRSDQKSRKGKVVVATQVVEQSLDLDFDCIFTDLAPIDLILQRAGRLHRHSRDIFGNVKQGLDERGEPLLWIFSPEPIDDPTSNWFSQFSRGGGMVYSDHGKLWLTAKLLHERKGWKMPEDARNLIESVYGVDVKVPHSFRENRSKVENDRKKQESAAVLSTIRLELGYDSTSNETSWDDSKFSTRYGIGNSTKVVLAKFVSDRLVPWISGTSRDWQNSELPVPNYLVEKEFIFENSNISEVISDCKKNLPDKGKHCVLLPLFYANDFWRGKAFNKKNEVVSFTYDERFGFRKEQLRGIV

SEQ ID NO: 12707 - protein, 745 aa, Leptospira kirschneri str. 200802841
MTKDKQSIFIAHVLRKDDGSFVEHLIDDHLYSVAEFAKKFCEKFGAETFGYLIGLWHDLGKFKLEFQERIRIRSGHIGEEAHLEGKTAKSVKHSVSGAIHCLNKFKQSDIIKKLICLPILCHHSGLKNFGIDVDIQLNDEKEISALSETITCIPQQILDGIELKQLGKSFKDHSLLIRMLFSTLIDADRLDTERFMDLVKFKERYSKTIILQDLNIKLDKHLNDIQKQADATKVNSIRKRILEEVQSKTNLKPGFYTLTAPTGGGKTLTSLSFALKHCIENKMDRVIYGVPYLSIIEQTADVFKKILGEDSVLEHHSGIDISKEKENSINRLLTENWDHPLIVTTNVQFFESLFSSKTTKVRKLHNIINSVIILDEAQMIPPQFLQPIVKTLKELVEYYNVTIILCTATQPTLSSIKSTDLNFDGIDTAIELAPEPEKLFQELKRVIIHKPEEKKLSFMEVATRILNYDQVLTIVNRKSDASGIFNQLTGNKYYLTTNLCAEHRRDILKKVKNHLNNGESVYLVSTQLIEAGVDIDFPIVFRAVAGLDSIAQAAGRCNREGKLLDENGQEKLGEVFLFKPEQNPPAGHLLQTEQASRDCIKNFEELIHPDTLKQYFNTLFWLKQDKGLDKEEIEKDKRSFQFETINKKFKLIDEDSRPVIVPYKEGKDLIVQLQNSVIQNNFLDYKLIRKSQRYTVNLKTNLYNKLLSEGIISEIEGIIGILTFGSYYHNDLGILESPNEQDLII

SEQ ID NO: 12708 - protein, 758 aa, Leptospira kirschneri str. 200802841
MEKLLAKSLSKHPSDKEQELYLVPHLKAAEKAGSVIYDSIGERILKSVGLSSEIWGNRLKILLPLSCLLHDLGKANNWFQELVRGNKIFQPIRHEFLSVIMILRSKNKLQNYIKTKISEIISLENLTPFINSIYSGILAHHLKIDIDLKRACPGLGINGGTPTEIIVYADSPDFDLLFGVNKPSNTFYFTFLPSHSDQKYKSIHEWIDEFYTINNEWEEFLRENEDWHIFSTILKPLVISADVLASALVPKGIEYKDWVIESLQNYVELNDINLIIKERLKDKLPRTFQKQIANSKERITLVEAGCGSGKTIGAYLWAANNISDSKIFFCYPTTGTATEGYLGYVSDSGYEAKLIHSRSEVDLKGIQTTGEEDGNELTDRIDALHSYHPKLIICTVDTVLSLMRNGRKAILSFPSIAMGIFVFDEIHSYNDEMFLVLIRFMQFFKNTKFLLMSASLQPERKEILKREFSSLQDIESPTDLMGLPRYKFNPIRQSKSLLEDIKRHAGNSKILVVVNTVKRAQTIYRDISSSGLNVKIYHSRYKYKDRVIRHREFIDAFQDKSPPVIGIATQVAEMSLDIDSDVLFTELASISSIIQRLGRLNRRTTPENKLPSRNVCFFKPEKTLPYSSDELELAEQWIKNLLNINNEISQNDLQEYFFKLSPKNENLYPPIYYDFNKPTFFFLPATEGLRGPNNTINCILESDMPSVMQKPKDISNFTIPMTINSGFDFQTANFYKYVVVIPDENIHYDKIEGAAWRN

SEQ ID NO: 12709 - protein, 745 aa, Leptospira kirschneri str. H2
MTKDKQSIFIAHVLRKDDGSFVEHLIDDHLYSVAEFAKKFCEKFGAETFGYLIGLWHDLGKFKLEFQERIRIRSGHIGEEAHLEGKTAKSVKHSVSGAIHCLNKFKQSDIIKKLICLPILCHHSGLKNFGIDVDIQLNDEKEISALSETITYIPQQILDGIELKQLGKSFKDHSLLIRMLFSSLIDADRLDTERFMDLVKFKERYSKTIILQDLNIKLDKHLNDIQKQADATKVNSIRKRILEEVQSKTNLKPGFYTLTVPTGGGKTLTSLSFALKHCITNKMDRVIYGVPYLSIIEQTADVFKKILGEDSVLEHHSGIDISKEKENSINRLLTENWDHPLIVTTNVQFFESLFSSKTTKVRKLHNIINSVIILDEAQMIPPQFLQPIVKTLKELVEYYNVKIILCTATQPTLSSIKSTDLNFDGIDTAIELAPEPEKLFQELKRVIIHKPEEKKLSFMEVATRILNYDQVLTIVNRKSDASGIFNQLTGNKYYLTTNLCAEHRRDILKKVKNHLNNGESVYLVSTQLIEAGVDIDFPIVFRAVAGLDSIAQAAGRCNREGKLLDENGQEKLGEVFLFKPEQDPPAGHLLQTEQASRDCIKNFEELIHPDTLKQYFNTLFWLKQDKGLDKEEIEKDKRSFQFETINKNFKLIDEDSRPVIVPYKEGKDLIVQLQNSVIQNNFLDYKLIRKSQRYTVNLKTNLYNKLLSERIISEIEGIIGILTFDSYYHNDLGILESPNEQDLII

SEQ ID NO: 12710 - protein, 765 aa, Leptospira kirschneri str. H2
MEKLLAKSRTQDGREISLQEHSFDTENAAISIFRKESRFLNNWLRFFKIKKEEKEKFLLNLRVTCLFHDIGKANDDFQKAVREKGLFHQGIRHEHLSAFVLHLPEIRKWLSQNKDLDIPIITSAVLCHHLKATDKNDHQYKWLTDPLRDFVILNLFHEEVKIILKKVNQFLKSDIDIPQLNYKTFSPEDENWKKTFQSGAKESGILGFRLDENRKQLHLAIKAALIVADSASSGLVRENHLIEKWISKAIHSDEIKENEILKEIIQKRMDDKKIPELHQFQKQVATKGDRVLLMAGCGMGKTLAAWNWANEVSKKQKISKVIFLYPTRGTATEGFKDYASWAPEADATLMHGTSDYELDSMFQNPDDEKSKRYFRISEADERLFAIAFWSKKFFSATADQFLSFLQNNYKGICLLPVLSECALIVDEVHSFDKAMFSSLLSFLKYFDLPILCMTATLTPKNKQSLLELDLEQYPKEEDRKELEDLINLENHPRYNKTVLENAEQAKEIAIKSFREGKRVLWVLNTVDRCQKTYEELTEELQTEVHCYHSRFKLSDRKTVHENTVNAFQGSNLNSIAVTTQVCEMSLDLDADVLISEFAPVSSMVQRFGRANRHLKKGDEFRAELYLYEVVGSLKPYSSEEINAAKNFLNNLPEKDISQNLLATKLEECSAQEYKTLPSASFIDGGYFALPSDYRDIEEFTAQAILDEDFPEVSQLLQSKKPIDPYILPVPDKRELNLRNEEHSLLPKYLKIVSRKYYNNKRGFAL

SEQ ID NO: 12711 - protein, 745 aa, Leptospira interrogans serovar Canicola str. Fiocruz LV133
MKRNKQSIFIGHILRKDDGNFVEHLLDDHLYSVAELTEKFCDKFGAGTFGYLIGLWHDLGKFKLEFQERIRIRSGHIGEEAHLEGKTAKSVKHSVSGAIHCFNKFKQSDIIKKLICLPMLCHHSCLKNFGIDVDIQLNEEREILALSETTPRIPQEILDGIDLKQLGKSFKDHSLLIRMLFFALIDADRLDTERFMNPAKFKERYSKTIILQDLNIKLDKHLKNIQKQADTTKVNSIRKRILEEVQSKTNLKPGFYTLTVPTGGGKTLTSLSFALKHCITNKMDRVIYGVPYLSIIEQTTDVFKKILGEDSVLEHHSGIDISKEKENSINRLLTENWDHPLIVTTNVQLFESLFSSKTTKVRKLHNIINSVIILDEAQMIPPQFLQPIVKTLKELVEFYNVTIILCTATQPTLSSIKSIDLNFDGINTAIELAPEPEKLFQELKRVIIHKPEERKLSFIEIATKISNYDQVLTIVNRKSDSSGIFNQLTGNKYYLTTNLCAEHRRDILKKVKSHLSNGESVYLVSTQLIEAGVDIDFPIVFRAVAGLDSIAQAAGRCNREGKLVDENGQEKLGEVFLFHPEQDPPSGHLLQTKQASEDCIKNFEELIHPDTLKQYFNTLFWLKQDKGLDKEEIKKDKRSFQFETINKNFKLIDEDSRPVIVPYKEGKDLIVQLQNSVVQNNFVDYKLIRKSQRYTVNLKTNLYNKLLSEGIISEIEGIIGILNFDSYYHNDLGILESPNDQDLII

SEQ ID NO: 12712 - protein, 750 aa, Leptospira interrogans serovar Canicola str. Fiocruz LV133
MILLAKSYPGIEKQLKSGDPESWALLEHHSSATYQVAEVLLKILEPILRKWIRLSESEYNKFVLVVCLSAGLHDLGKANEDFQKMLQRRKYLQRFRHEIWSVLALTGSGPFSDWFRKTIGDETWVRIGQMGILSHHLKATRETLYADHETAEIKVFWKDQGVIKMFQSICRLAGISSPDFSSPSISSYTCLGEDADKSIRIWTREILNAKIDPRYQHSIGAVRAMIIAADRLASAYKGADALKLWAEEALNRVLSEQECSNIVKQGLGEKNLRPFQKQVGDSTSRVTLVRAGCGNGKTIAAFQWAKTHSAGRKLFFCYPTMGTATEGFRDYVSDIPGLDALLSHSRASLDLGELASTGEEDEGDSPNMHSRMLQEWTAQVTFCTVDQILGLLQNYRSSLTLSPAIFLGTFVFDEIHMYDSILFGNLLTFLKEFSHTSILLMTASLPETMLSAIQETVGADLGPVISGEAQIEERLRYRILHSSREDALQKAIQEFKNGGRVLWVCNKVEHCLKLYDELSEKYDIEALVYHSRFKYEDRKERHRAVIDSFQEGYKKSLPVFAITTQVCEVSLDISATLLISELCPFAALIQRLGRVNRPGQEMEDIAQALIIPFQGKPYEKENEDDGESELERCKEILKPLLDRELSQKDLALALENAKGTEHQKIPSQWLSLGWEAKPDSIRESGYTLDVILESDAYKVLKNERPWEKSKLYTIPMPIQKQFSYGEPPLRIPVVPDSQIQYSSVRGGEWN

SEQ ID NO: 12713 - protein, 758 aa, Leptospira sp. Fiocruz LV3954
MEKLLAKSLSGDPRDNEQELYLVPHLRAAEEAGSAIYESIGERILKAVGLPSIIWSKRLKILLPLACLLHDLGKANNWFQELLRGMKIYQPIRHEFLSVIMILRSTKNIQNYLKEKIHVLETSEDKTPFINSIYSGILAHHMKMDIDLKRACPALFANGGTPTEIIAYTNASDFDSLFGPDKPTNDFCFTFLSSHANDKYKPIHRWIDEFQKISCEWEEFLKENNDWHIFSTILKPLVISADVIASALVPKGIEYKDWVIKSLQNYIEQNDINQIVKERLHGKSPREFQRQIANSEERITLVEAGCGSGKTIGAYLWAANNALNSKLFFCYPTTGTATEGYLGYVSDSNYESKLIHSKSQVDLEGIHKTGDEDSTELTDKIHALHSYHPKIIICTADTILSLIKNGRKSILSFPSIATGIFVFDEIHSYNDEMFLVMVRFIQFFKNTKFLLMSASLQPERKNVLKREFINFQEIESPTDLMDIPRYKFEEIRDSKTLSEDIKRHAGHSKILVVVNTVKRAQSIYRDLKSSGLNVKIYHSRYKYKDRVIRHREFIAAFKDEAPPVVGIATQVAEMSLDIDSDILFCELAPIPSIIQRLGRLNRRTAPDNQLPARSVYFSRPEKPLPYDKEELELAEQWIEILRNSKDEISQNDLQEFFLNIKTETADLFPPVYYDFNKPTFYFTPATEGLRGASSTVNCILRSDLLEIDQSPYTIANYIIPMTMNRKVDFTILDQYKYAFVIPDEKIFYDSLEGAQWLN

SEQ ID NO: 12714 - protein, 932 aa, Leptospira sp. Fiocruz LV3954
MEAEEKSYYKYWGKADQEGNYHLLVYHCLDVAAVGEVYLSQNETLCVHLSQKLGIDPPTFKNLFVFFLVLHDLGKFSDCFQSLIPNIKRILGNSNSPIGPYSVRHDSLGYIFWGEWILKDKRFGNYDGLLTEQNWLGWNGLRSSKEKSYFTEFLDVLIRCVTGHHGRPPSKNGYSGQTAVSPDSHFTEADRSAALAFCKEVNRIFSPNFEGDFKSLFDSTLPISFWLAGLSVLCDWIGSNSEIFKYRRTPIDLEEYYTTISLINAQKTVLKSGLSSAKIAFNENHFRIFEYLREPTPLQKFCSEVVLPDSPSLFILEDVTGSGKTEAALILTHRLMQKNAYSGFYVGLPTMATANGMYRRMSGVYRNLYTKESLPSLILAHGARNLSDSFQSSVISDNAILADRNYQSDKDPEESATAICNIWLSDNQKKSLLADAGVGTIDQALLSVLSAKFQSLRMFGLSRKVLILDEVHSYDPYMVELICCLLKAQAKIGASVILLSATLPKILRKRFSDSFALGLDTELQDIKSGEYPLVSLVSNRFEVEETPISTRKEVGRKLNVEFLFDQETVFQKILEMSNQGRCVCWIRNTVSEASQAFFFLHSKLGDRVILFHSRFAMGDRLNIESQILENFGVRSDQKSRKGKVVVATQVVEQSLDLDFDCIFTDLAPIDLILQRAGRLHRHSRDIFGNVKQGLDERGEPLLWIFSPEPIDDPTSNWFSQFSRGGGMVYSDHGKLWLTAKLLHERKGWKMPEDARNLIESVYGVDVKVPHSFRENRSKVENDRKKQESAAVLSTIRLELGYDSTSNETSWDDSKFSTRYGIGNSTKVVLAKFVSDRLVPWISGTSRDWQNSELPVPNYLVEKEFIFENSNVSEVISDCKKNLPDKGKHCVLLPLFYANDFWRGKAFNKKNEVVSFTYDERFGFRKEQSRGIV

SEQ ID NO: 12715 - protein, 745 aa, Leptospira interrogans str. Brem 329
MKRNKQSIFIGHILRKDDGNFVEHLLDDHLYSVAELTEKFCEKFGAGTFGYLIGLWHDLGKFKLEFQERIRIRSGHIGEEAHLEGKTAKSVKHSVSGAIHCFNKFKQSDIIKKLICLPMLCHHSGLKNFGIDVDIQLNEEREILALSETTPHIPQEILDGIDLKQLGKSFKDHSLLIRMLFSALIDADRLDTERFMDPAKFKERYSKTIILQDLNIKLDKHLKNIQKQADTTKVNSIRKRILEEVQSKTNLKPGFYTLTVPTGGGKTLTSLSFALKHCITNKMDRVIYGVPYLSIIEQTTDVFKKILGEDSVLEHHSGIDISKEKENSINRLLTENWDHPLIVTTNVQLFESLFSSKTTKVRKLHNIINSVIILDEAQMIPPQFLQPIVKTLKEIVEFYNVTIILCTATQPTLSSIKSIDLNFDGINTAIELAPEPEKLFQELKRVIIHKSEERKLSFIEIATKISNYDQVLTIVNRKSDSSGIFNQLTGNKYYLTTNLCAEHRRDILKKVKSHLSNGESVYLVSTQLIEAGVDIDFPIVFRAVAGLDSIAQTVGRCNREGKLVDENGQEKLGEVFLFHPQQDPPSGHLLQTKQASEDCIKNFEELIHPDTLKQYFNTLFWLKQDKGLDKEEIEKDKRSFQFETINKNFKLIDKDSRPVIVPYKEGKDLIVQLQNSVVQNNFVDYKLIRKSQRYTVNLKTNLYNKLLSEGIISEIEGIIGILNFDSYYHNDLGILESPNNQDLII

SEQ ID NO: 12716 - protein, 752 aa, Leptospira interrogans str. Brem 329; identical to SEQ ID NO: 12702

SEQ ID NO: 12717 - protein, 758 aa, Leptospira kirschneri str. 2008720114
MEKLLAKSLSKHPSDKEQELYLVPHLKAAEKAGSVIYDSIGERILKSVGLSSEIWGNRLKILLPLSCLLHDLGKANNWFQELVRGNKIFQPIRHEFLSVIMILRSKNKLQNYIKTKISEIISLENLTPFINSIYSGILAHHLKIDIDLKRACPGLGINGGTPTEIIVYADSPDFDLLFGVNKPSNTFYFTFLPSHSDQKYKSIHEWIDEFYTINNEWEEFLRENEDWHIFSTILKPLVISADVLASALVPKGIEYKDWVIESLQNYVELNDINLIIKERLKDKLPRTFQKQIANSKERITLVEAGCGSGKTIGAYLWAANNISDSKIFFCYPTTGTATEGYLGYVSDSGYEAKLIHSRSEVDLKGIQTTGEEDGNELTDRIDALHSYHPKLIICTVDTVLSLMRNGRKAILSFPSIAMGIFVFDEIHSYNDEMFLVLIRFMQFFKNTKFLLMSASLQPERKEILKREFSSLQDIESPTDLMGLPRYKFNPIHQPESLLEDIKRHAGNSKILVVVNTVKRAQTIYRDISSSGLNVKIYHSRYKYKDRVVRHREFIDAFQDKSPPVIGIATQVAEMSLDIDSDVLFTELASISSLIQRLGRLNRRTTPENKLPSRNVCFFKPEKTLPYSSDELELAEQWIKNLLNINNEISQNDLQEYFFKLSPKNENLYPPIYYDFNKPTFFFLPATEGLRGPNNTINCILESDMPSVMQKPKDISNFTIPMTINSGFDFQTANFYKYVVVIPDENIHYDKIEGAAWRN

SEQ ID NO: 12718 - protein, 745 aa, Leptospira kirschneri str. 2008720114
MTKDKQSIFIAHVLRKDDGSFVEHLIDDHLYSVAELAKKFCEKFGAETFGYLIGLWHDLGKFKLEFQERIRIRSGHIGEEAHLEGKTAKSVKHSVSGAIHCLNKFKQSDIIKKLICLPILCHHSGLKNFGIDVDIQLNDEKEISALSETITCIPQQILDGIELKQLGKSFKDHSLLIRMLFSTLIDADRLDTERFMDLVKFKERYSKTIILQDLNIKLDKHLNDIQKQADATKVNSIRKRILEEVQSKTNLKPGFYTLTVPTGGGKTLTSLSFALKHCIENKMDRVIYGVPYLSIIEQTADVFKKILGEDSVLEHHSGIDISKEKENSINRLLTENWDHPLIVTTNVQFFESLFSSKTTKVRKLHNIINSVIILDEAQMIPPQFLQPIVKTLKELVEYYNVTIILCTATQPTLSSIKSTDLNFDGIDTAIELAPEPEKLFQELKRVIIHKPEEKKLSFMEVATRILNYDQVLTIVNRKSDASGIFNQLTGNKYYLTTNLCAEHRRDILKKVKNHLNNGESVYLVSTQLIEAGVDIDFPIVFRAVAGLDSIAQAAGRCNREGKLLDENGQEKLGEVFLFKPEQDPPAGHLLQTEQASRDCIKNFEELIHPDTLKQYFNTLFWLKQDKGLDKEEIEKDKRSFQFETINKKFKLIDEDSRPVIVPYKEGKDLIVQLQNSVIQNNFLDYKLIRKSQRYTVNLKTNLYNKLLSEGIISEIEGIIGILTFDSYYHNDLGILESPNEQDLII

SEQ ID NO: 12719 - protein, 931 aa, Leptospira borgpetersenii str. 200801926
MKTEVKSYYKYWGKADKEGNYHLLAYHCFDVAAVGEVYLSQNETLCTHFSRKLGIDPITFKNLFVFFLVLHDLGKFSDCFQSLIPNVKSALDNSNPPIGSYSIRHDSLGYIFWGKWILKDERFGNYDGLLTEQNWLSWNGLRSSKDKSYFTEFLDVLIRCVTGHHGRPPSKNGYSGQTAVSLDSHFTEADRSAALDFSKEVNRILSPNLNFDGDFKTLYNSALRISFWLAGLSVLCDWIGSNAEIFKYHQTPIDLEEYYTKISLKRALEAINRSGLLPSKITFNKDHFRIFEYLREPTPLQKFCSEVAIPDSPSLFILEDVTGSGKTEAALILTHRLMQKSAYSGFYVGLPTMATANGMYQRMSGVYRNLYTKESIPSLVLAHGARNLSDSFQSSVISDNAILADRNYSLQLDKDPEESASAICNIWLSDNQKKSLLADAGVGTIDQALLSILSTKFQSLRMFGLSRKVLILDEVHSYDPYMVELICCLLKAQAKIGASVILLSATLPKILRKTFSESFALGLDTELQDLKSVEYPLISLISDRSEVEEIPISTRKEVSRKLNVKFLFNQEQVLQKILEMSNQGRCVCWIRNTVSDASQAFSFLHSKLGDQVILFHSRFVMGDRLNIESQILENFGVRSDQNSRKGKVVVATQVVEQSLDLDFDCIITDLAPIDLILQRAGRLHRHCRDIFGNAKQGLDERGEPILWIFSPEPIEDPTSNWFSQFSRGGSMVYSDHGRLWLTARLLQERKGWRMPEDARNLIESVYGIDVEIPQSFRENQFKVKNDKKKLESAAALSTIHLELGYDSTLNETSWDDSKFSTRYGIDNSSKAVLAKFVSDRLVPWISGTTRDWQNSELPVPNYLVEKEFIFENLNFSEVISNCKKNLPDKGKHCVLLPLFYTNNSWRGKALNKKNEVVSFTYDERFGFRKEK

SEQ ID NO: 12720 - protein, 750 aa, Leptospira interrogans serovar Icterohaemorrhagiae str. Verdun LP; identical to SEQ ID NO: 11551

SEQ ID NO: 12721 - protein, 750 aa, Leptospira interrogans str. HAI1594; identical to SEQ ID NO: 11551

SEQ ID NO: 12722 - protein, 752 aa, Leptospira interrogans serovar Grippotyphosa str. 2006006986; identical to SEQ ID NO: 12649

SEQ ID NO: 12723 - protein, 727 aa, Thermaerobacter subterraneus DSM 13965
MEESLAFYAHSPGATGQWHQLVEHLRSVSKMARAFADAFGMGDIAYLLGLLHDLGKFNPEFQHYLRATHEGRATSSVPHAVWGAALLYGLARIRGGTDVWKELALPILGHHAGLEDAGVAATKLDAFWQERGPEVVEAQKRLAAAGLRLPVPRVPAFTTSTQREFAIRMVFSALVDADYLDTERHFEPEQASLRGRGPSLETLWHRLEAAQRKILDDSTVVNRIRREVYEACVRAASGPPGVYRLTVPTGGGKTRSGLAFALRHALIHDLRRVVVAIPYTSIIDQTARVYREILGDEAVLEHHSALQVPEEDERQDESVVRHRLATENWDAPIVVTTTVQMLESLFSNRPSKVRKIHRLSGAVIVLDEVQALPPELLRPTLDVLGWLATPVEEGGFGSTVVLSTATQPALEAVCGSEHPHLARAIEIVPDFPKHFALLKRVEYEWRPDAITWDTLAGEVEQLHQVLVVLNSRRDAFALLSALEDVPDVFHLSTLLCGAHRKRVLEEVKRRLRQGEPVRLVSTQVVEAGVDLDFPVVYRAVGPLDRIVQAAGRCNREGRLPSGPGRVIVFEPAGGRTPSGPYKVGLEKARLLLRHHPVSHLHDPDLYREYFRRLFADVDLDKKRIQEYRQALNYPEVAQRYRLIESDTVPVVVPYMDAAAQLEEFLARPGYVAWRRLQPYIVNLFAYEVATRGEWLERVADSLYLWKGAYDERLGMVEGYADPADLIV

SEQ ID NO: 12724 - protein, 752 aa, Leptospira interrogans str. 2002000621; identical to SEQ ID NO: 12699

SEQ ID NO: 12725 - protein, 757 aa, Leptospira interrogans str. 2002000621; identical to SEQ ID NO: 12700

SEQ ID NO: 12726 - protein, 752 aa, Leptospira interrogans str. 2002000623; identical to SEQ ID NO: 12699

SEQ ID NO: 12727 - protein, 757 aa, Leptospira interrogans str. 2002000623; identical to SEQ ID NO: 12700

SEQ ID NO: 12728 - protein, 405 aa, Enterococcus sp. GMD5E
MERLGNWILCHRCGMRTSVIDGQLADYGYFCTHCLYLGRCDTQQDLYLFDQPEAKPREVVFFWTGQLTEKQTEISKRILCHSEKRHHLIWAVTGAGKTEMLYPILVETLKAGGRVAICTPRVDVCNELFLRYRYVFPEEKITLLHGNTATAYTFTSFVICTIHQLYRFYRSFDLIVIDEIDAFPYNGDAGLAHAVQTAIKPDGRFIYLSATPDKKLLKEIKQTFDIHKLALRFHRRLLPEPVLVFMNNWRQKCKNKKKIKSLVRIIHQLIKENHILLFCPSITMMHRLKATLQEALPRYEITDVSSRDNQRAEKVQKMREAKYDILLTTMILERGVTFERISVIVLGADHPVFTKSSLVQIAGRADRKGPYTNSQVYFFYEEKTAAIRKACQEIKEMNEEGKKML

SEQ ID NO: 12729 - protein, 765 aa, Leptospira kirschneri serovar Grippotyphosa str. Moskva
MEKLLAKSRTQDGREISLQEHSFDTENAAISIFRKESRFLNNWLRFFKIRKEDEEKFLLNLRVTCLFHDIGKANDDFQKAVREKGFFHQGIRHEHLSAFVLHLPEIRKWLSQNKDLDIPIITSAVLCHHLKATDKNDHQYKWLTDPLRDFVILNLFHEEVKIILKKVNQFLKSDIDIPQLNYKTFSPEDENWKKTFQSGAKESGILGFRLDENRKQLHLAIKAALIVSDSASSGLVRENHLIEKWISKAIHSDEIKENEILKEIIQKRMDDKKILELHQFQKQVATKGDRVLLMAGCGMGKTLAAWNWANEVSKKQKISKVIFLYPTRGTATEGFKDYASWAPEADATLMHGTSDYELDSMFQNPDDEKSKRDFRISEADERLFAIAFWSKKFFSATADQFLSFLQNNYKGICLLPVLSECALIVDEVHSFDKAMFSSLLSFLKYFDLPILCMTATLTPKNKQSLLELDLEQYPKEEDRKELENLINLENHPRYNKTVLENAEQAKEIAIKSFREGKRVLWVLNTVDRCQKTYEELTEELQTEVHCYHSRFKLSDRKTVHENTVNAFQGSNLNSIAVTTQVCEMSLDLDADVLISEFAPVSSMVQRFGRANRHLKKGDEFRAELYLYEVVGSLKPYSSDEINAAKNFLNNLPEKDISQNLLATKLEECSAQEYKTLPSASFIDGGYFALPSDYRDIEEFTAQAILDEDFPEVSQLLQSKKPIDPYILPVPDKRELNLRNEEHSLLPKYLKIVSRKYYNNKRGFAL

SEQ ID NO: 12730 - protein, 745 aa, Leptospira kirschneri serovar Grippotyphosa str. Moskva; identical to SEQ ID NO: 12646

SEQ ID NO: 12731 - protein, 931 aa, Leptospira borgpetersenii str. UI 09149; identical to SEQ ID NO: 12719

SEQ ID NO: 12732 - protein, 931 aa, Leptospira borgpetersenii serovar Castellonis str. 200801910
MKTEVKSYYKYWGKADKEGNYHLLAYHCFDVAAVGEVYLSQNETLCTHFSRKLGIDPITFKNLFVFFLVLHDLGKFSDCFQSLIPNVKSALDNSNPPIGSYSIRHDSLGYIFWGKWILKDERFGNYDGLLTEQNWLSWNGLRSSKDKSYFTEFLDVLIRCVTGHHGRPPSKNGYSGQTAVSLDSHFTEADRSAALDFSKEVNRILSPNLNFDGDFKTLYNSALRISFWLAGLSVLCDWIGSNAEIFKYHQTPIDLEEYYTKISLKRALEAINRSGLLPSKITFNKDHFRIFEYLREPTPLQKFCSEVAIPDSPSLFILEDVTGSGKTEAALILTHRLMQKSAYSGFYVGLPTMATANGMYQRMSGVYRNLYTKESIPSLVLAHGARNLSDSFQSSVISDNAILADRNYSLQLDKDPEESASAICNIWLSDNQKKSLLADAGVGTIDQALLSILSTKFQSLRMFGLSRKVLILDEVHSYDPYMVELICCLLKAQAKIGASVILLSATLPKILRKTFSESFALGLDTELQDLKSVEYPLVSLISDRSEVEEIPISTRKEVSRKLNVKFLFNQEQVLQKILEMSNQGRCVCWIRNTVSDASQAFSFLHSKLGDQVILFHSRFVMGDRLNIESQILENFGVRSDQNSRKGKVVVATQVVEQSLDLDFDCIITDLAPIDLILQRAGRLHRHCRDIFGNAKQGLDERGEPILWIFSPEPIEDPTSNWFSQFSRGGSMVYSDHGRLWLTARLLQERKGWRMPEDARNLIESVYGIDVEIPQSFRENQFKVKNDKKKLESAAALSTIHLELGYDSTLNETSWDDSKFSTRYGIDNSSKAVLAKFVSDRLVPWISGTTRDWQNSELPVPNYLVEKEFIFENLNFSEVISNCKKNLPDKGKHCVLLPLFYTNNSWRGKALNKKNEVVSFTYDERFGFRKEK

SEQ ID NO: 12733 - protein, 745 aa, Leptospira kirschneri serovar Valbuzzi str. 200702274; identical to SEQ ID NO: 12646

SEQ ID NO: 12734 - protein, 765 aa, Leptospira kirschneri serovar Valbuzzi str. 200702274; identical to SEQ ID NO: 12729

SEQ ID NO: 12735 - protein, 752 aa, Leptospira interrogans serovar Pyrogenes str. 2006006960
MILLAKSYPGIEKQLKSGDPESWALLEHHSSATYQVAEVLLKILEPILRKWTRLSESEYNKFVLVVCLSAGLHDLGKANEDFQKMLQRRKYLQRFRHEIWSILALTGSGPFSDWFRKTIGDETWVRIGQMGILSHHLKATRETLYADHETAEIKVFWKDQGVIKTFQSICRLAGISSPDFSSSSISSYTCLGEDADKSIRIWTREILNARIDPRYQHSIGAVRAMIIAADRLASAYKGADALKLWATEALNRVLSEQECSKIVKQGLGEKNLRPFQKQVGDSTSRVTLVRAGCGNGKTIAAFQWAKTHSAGRKLFFCYPTMGTATEGFRDYVSDIPGLDALLSHSRASLDLGELASTGEEDEGDSLNMHSRMLQEWTAQVTFCTVDQILGLLQNYRSSLTLSPAIFLGAFVFDEIHMYDSILFGNLLTFLKEFSHTSILLMTASLPETMLSAIQETVGADLGPVISGEAQIEERLRYRILHSSREDALQKAIQEFKNGGRVLWVCNKVEHCLKLYDELSEKYDIEALVYHSRFKYEDRKERHRAVIDSFQEGYKKSLPVFAITTQVCEVSLDISATLLISELCPFAALIQRLGRVNRPGQEMEGIAQVLIIPFQGKPYEKENEDDGESELERCKEILKPLLDRELSQKDLALALENAKGTEHQKIPSQWLSLGWEAKPDSIRESGYTLDVILESDAYKVLKNERPWEKSKLYTIPMPIQKQFSYGEPPLRIPVVPDSQIQYSSVRGGEWNLN

SEQ ID NO: 12736 - protein, 745 aa, Leptospira interrogans serovar Bataviae str. L1111
MKRNKQSIFIGHILRKDDGNFVEHLLDDHLYSVAELTEKFCEKFGAGTFGYLIGLWHDLGKFKLEFQERIRIRSGHIGEEAHLEGKTAKSVKHSASRAIHCFNKFKQSDIIKKLICLPMLCHHSGLKDFGIDVDIQLNEEREILALSETTPHIPQEILDGIDLKQLGKSFKDHSLLIRMLFSALIDADRLDTERFMDPAKFKERYSKTIILQDLNIKLDKHLKNIQKQADTTKVNSIRKRILEEVQSKTNLKPGFYTLTVPTGGGKTLTSLSFALKHCITNKMDRVIYGVPYLSIIEQTTDVFKKILGEDSVLEHHSSIDISKEKENSINRLLTENWDHPLIVTTNIQLFESLFSSKTTKVRKLHNIINSVIILDEAQMIPPQFLQPIVKTLKELVEFYNVTIILCTATQPTLSSIKSIDLNFDGINTAIELAPEPEKLFQELKRVIIHKPEERKLSFIEIATKISNYDQVLTIVNRKSDSSGIFNQLTGNKYYLTTNLCAEHRRDILKKVKSHLSNGESVYLVSTQLIEAGVDIDFPIVFRAVAGLDSIAQTVGRCNREGKLVDENGQEKLGEVFLFHLQQDPPSGHLLQTKQASEDCIKNFEELIHPDTLKQYFNTLFWLKQDKGLDKEEIEKDKRSFQFETINKNFKLIDKDSRPVIVPYKEGKDLIVQLQNSVVQNNFVDYKLIRKSQRYTVNLKTNLYNKLLSEGIISEIEGIIGILNFDSYYHNDLGILESPNDQDLII

SEQ ID NO: 12737 - protein, 754 aa, Leptospira interrogans serovar Bataviae str. L1111
MILLAKSYPGIEKQLKSGDPESWALLEHHSSATYQVAEVLLKILEPILRKWTRLSESEYNKFVLVVCLSAGLHDLGKANEDFQKMLQRRKYLQRFRHEIWSVLALTGSGPFSDWFRKTIGDETWVRIGQMGILSHHLKATRETLYADHETAEIKVFWKDQGVIKTFQSICRLAGISSPDFSSSSISSYTCLGEDADKSIRIWTREILNARIDPRYQHSIGAVRAMIIAADRLASAYKGADALKLWAEEALNRVLSEQECSKIVKQGLGEKNLRPFQKQVGDSTSRVTLVRAGCGNGKTIAAFQWAKTHSAGRKLFFCYPTMGTATEGFRDYVSDIPGLDALLSHSRASLDLGELASTGEEDEGDSPNMHSRMLQEWTAQVTFCTVDQILGLLQNYRSSLTLSPAIFLGAFVFDEIHMYDSILFGNLLTFLKEFSHTSILLMTASLPETMLSAIQETVGADLGPVISGEAQIEERLRYRILHSSREDALQKAIQEFKNGGRVLWVCNKVEHCLKLYDELSEKYDIEALVYHSRFKYEDRKERHRAVIDSFQEGYKKSLPVFAITTQVCEVSLDISATLLISELCPFAALIQRLGRVNRPGQEMEGIAQALIIPFQGKPYEKEKENEDDGESELERCKEILKPLLDRELSQKDLALALENAKGTEHQKIPSQWLSLGWEAKPDSIRESGYTLDVILESDAYKVLKNERPWEKSKLYTIPMPIQKQFSYGEPPLRIPVVPDSQIQYSSVRGGEWNLN

SEQ ID NO: 12738 - protein, 745 aa, Leptospira interrogans serovar Hebdomadis str. R499; identical to SEQ ID NO: 12647

SEQ ID NO: 12739 - protein, 752 aa, Leptospira interrogans serovar Grippotyphosa str. UI 08368
MILLAKSYPGIEKQLKSGDPESWALLEHHSSATYQVAEVLLKILEPILRKWTRLSESEYNKFVLVVCLSAGLHDLGKANEDFQKMLQRRKYLQRFRHEIWSILALTGSGPFSDWFRKTIGDETWVCIGQMGILSHHLKATRETLYADHETAEIKVFWKDQGVIKTFQSICRLAGISSPDFSSSSISSYTCLGEDADKSIRIWTREILNARIDPRYQHSIGAVRAMIIAADRLASAYKGADALKLWATEALNRVLSEQECSKIVKQGLGEKNLRPFQKQVGDSTSRVTLVRAGCGNGKTIAAFQWAKTHSAGRKLFFCYPTMGTATEGFRDYVSDIPGLDALLSHSRASLDLGELASTGEEDEGDSLNMHSRMLQEWTAQVTFCTVDQILGLLQNYRSSLTLSPAIFLGAFVFDEIHMYDSILFGNLLTFLKEFSHTSILLMTASLPETMLSAIQETVGADLGPVISGEAQIEERLRYRILHSSREDALQKAIQEFKNGGRVLWVCNKVEHCLKLYDELSEKYDIEALVYHSRFKYEDRKERHRAVIDSFQEGYKKSLPVFAITTQVCEVSLDISATLLISELCPFAALIQRLGRVNRPGQEMEGIAQVLIIPFQGKPYEKENEDDGESELERCKEILKPLLDRELSQKDLALALENAKGTEHQKIPSQWLSLGWEAKPDSIRESGYTLDVILESDAYKVLKNERPWEKSKLYTIPMPIQKQFSYGEPPLRIPVVPDSQIQYSSVRGGEWNLN

SEQ ID NO: 12740 - protein, 747 aa, Leptospira interrogans str. UI 12758
MILLAKSYPGIEKQLKSGDPESWALLEHHSSATYQVAEVLLKILEPILRKWTRLSESEYNKFVLVVCLSAGLHDLGKANEDFQKMLQRRKYLQRFRHEIWSVLALTGSGPFSDWFRKTIGDETWVRIGQMGILSHHLKATRETLYADHETAEIKVFWKDQGVIKMFQSICRLAGISSPSISSYTCLGEDADKSIRIWTREILNARIDPRYQHSIGAVRAMIIAADRLASAYKGADALKLWATEALNRVLSEQECSKIVKQGLGEKNLRPFQKQVGDSTSRVTLVRAGCGNGKTIAAFQWAKTHSAGRKLFFCYPTMGTATEGFRDYVSDIPGLDALLSHSRASLDLGELASTGEEDEGDSLNMHSRMLQEWTAQVTFCTVDQILGLLQNYRSSLTLSPAIFLGAFVFDEIHMYDSILFGNLLTFLKEFSHTSILLMTASLPETMLSAIQETVGADLGPVISGEAQIEERLRYRILHSSREDALQKAIQEFKNGGRVLWVCNKVEHCLKLYDELSEKYDIEALVYHSRFKYEDRKERHRAVIDSFQEGYKKSLPVFAITTQVCEVSLDISATLLISELCPFAALIQRLGRVNRPGQEMEGIAQVLIIPFQGKPYEKENEDDGESELERCKEILKPLLDRELSQKDLALALENAKGTEHQKIPSQWLSLGWEAKPDSIRESGYTLDVILESDAYKVLKNERPWEKSKLYTIPMPIQKQFSYGEPPLRIPVVPDSQIQYSSVRGGEWNLN

SEQ ID NO: 12741 - protein, 931 aa, Leptospira weilii str. 2006001853
MKSEEKSYYKYWGKANKEGNYHLLVYHCFDVAAVGEVYLSQNETLCVHFSQKLGIDPLTFKNLFVFFLILHDLGKFSDCFQSLIPDIKSAFGNSNSPIGPYSIRHDSLGYIFWGKWILKDERFGNYNGLLTEQNWLGWNGLQSSKDKSYFTEFTDVLIRCVTGHHGRPPSKNGYSGQTAVSPDSHFTEADRLAALDFSKEANRILSPNLYFKGNFKTLYDSTLQISFWLAGLSVLCDWIGSNAEIFKYRTTPIDLEEYYTTISLNNASKAVKKSGILPSKIALNGNHFGIFEYLQEPTPLQKFCSEVVLPDSPSLFILEDVTGSGKTEAALILTHRLMQKNTYSGFYVGLPTMATANGMYRRMSSVYRNLYTKESLPSLVLAHGARNLSDSFQSSVISDNAILSDRNYSFQSEKNQEESASAICNIWLSDNQKKSLLADAGVGTIDQALLSVLSAKFQSLRMFGLSRKVLILDEVHSYDPYMVELICCLLKAQAKIGASVILLSATLPKILRKTFSESFALGLDTELQDIKSEEYPLVSLISDRPVVEETPISTRKEVSRKLNVKFFFNQEQVLQKILEISNQGRCVCWIRNTVSDASQAFSFLHSKLGDRVTLFHSRFAMGDRLNIESQILENFGIQSDQISRKGKVVVATQVVEQSLDLDFDCIITDLAPIDLILQRAGRLYRHSRDISGNIKQGLDERGVPILWIFSPEPIDDPKSDWFSRFSRGGSMVYSDHGKLWLTARLLQERKGWRMPEDARNLIESVYGTNVMVPQSFQENQSKVENDKKKRESAAALSTIRLELGYDSTLNETSWDDSKFSTRYGIDNSTKVVLAKFVSDRLVPWISDTNRDWQNSELPVPNYLVEKEFIFENSNLSEVISHCKKNLPDKGKHCVLLPLFYANNSWRGKALNKKNEVVSLTYDERFGFRKEK

SEQ ID NO: 12742 - protein, 745 aa, Leptospira noguchii str. 2006001870
MIKEKQSIFLAHVLRKDDGSFVEHLIDDHLYSVAEFTKKFCEKFEAGTVGYLIGFWHDLGKFKLEFQERIRIRSGHIGEEAHLEGKTAKSVKHSVSGAIHCFNKFKKSDIIKKLICLPILCHHSGLKNFGIDVDIQLNDEKEISAWSKTISHIPQQILDGIDLKQLGRSFKDFSLLIRMLFSALIDADRLDTERFMDLSKFKERYSKTIILQDLNIKLDKHLNEIQKQTDVTKVNSTRKRILEEVQSKTNLKPGFYTLTVPTGGGKTLTSLSFALKHCIANKMDRVIYGVPYLSIIEQTADIFKKILGEDSVLEHHSGIDISKEKENSINRLLTENWDHPLIVTTNVQLFESLFSSKTTKVRKLHNIINSVIILDEAQMIPPQFLQPIVKNLKELVEYYNVTIILCTATQPTLSSIKSTDLNFDGIDTTIELAPEPEKLFQKLKRVIIHKPEEKKLSFIEVATRILNYDQVLTIVNRKSDASGIFNELTGNKYYLTTNLCAEHRRDILKKVKSHLDNKESVYLVSTQLIEAGVDIDFPIVFRAVAGLDSIAQAAGRCNREGKLLDKNGQEKLGEVFLFYPEQDPPSGHLLQTKQASEDCIKNFEELIHPDALKQYFNTLFWLKQNKGLDKEEIEELKINLQFETINEKFKLVDEDSRPVIVPYKEGKDIIIQLQNSATKNNFLDYKLIRKSQRYTVNLKTNLYNKLLSEGIISEIEGIIGILNFDSYYYNDLGILESPNEQDLII

SEQ ID NO: 12743 - protein, 745 aa, Leptospira interrogans str. UI 08452; identical to SEQ ID NO: 12647

SEQ ID NO: 12744 - protein, 750 aa, Leptospira interrogans str. UI 08452
MILLAKSYPGIEKQLKSGDPESWALLEHHSSATYQVAEVLLKILEPILRKWTRLSESEYNKFVLVVCLSAGLHDLGKANEDFQKMLQRRKYLQRFRHEIWSVLALTGSGPFSDWFRKTIGDETWVRIGQMGILSHHLKATRETLYADHETAEIKVFWKDQGVIKMFQSICRLAGISSPDFSSPSISSYTCLGEDADKSIRIWTREILNAKIDPRYQHSIGAVRAMIIAADRLASAYKGADALKLWAEEALNRVLSEQECSNIVKQGLGEKNLRPFQKQVGDSTSRVTLVRAGCGNGKTIAAFQWAKTHSAGRKLFFCYPTMGTATEGFRDYVSDIPGLDALLSHSRASLDLGELASTGEEDEGDSPNMHSRMLQEWTAQVTFCTVDQILGLLQNYRSSLTLSPAIFLGTFVFDEIHMYDSILFGNLLTFLKEFSHTSILLMTASLPETMLSAIQETVGADLGPVISGEAQIEERLRYRILHSSREDALQKAIQEFKNGGRVLWVCNKVEHCLKLYDELSEKYDIEALVYHSRFKYEDRKERHRAVIDSFQEGYKKSLPVFAITTQVCEVSLDISATLLISELCPFAALIQRLGRVNRPGQEMEDIAQALIIPFQGKPYEKENEDDGESELERCKEILKPLLDRELSQKDLALALENAKGTEHQKIPSQWLSLGWEAEPDSIRESGYTLDVILESDAYKVLKNERPWEKSKLYTIPMPIQKQFSYGEPPLRIPVVPDSQIQYSSVRGGEWN

SEQ ID NO: 12745 - protein, 932 aa, Leptospira santarosai str. CBC379; identical to SEQ ID NO: 12706

SEQ ID NO: 12746 - protein, 945 aa, Leptospira mayottensis 200901122
MQKEKSIRHSKHRESMKAEEKSYYKYWGKANKKGDYHLLVYHCFDVAAVGEVYLSQNETLCVHFSQKLGIDPLTFKNIFVFFLILHDLGKFSDCFQSLIPNIKNALGNSNSPIGPYSIRHDSLGYIFWGRCILKDERFGNYSGFLTEQNWLGWNELQSPKDKSYFTEFTDVLIRCVTGHHGRPPSKNGYSGQTAVSLDSHFTEADRLAALDFSKEANRILSPNLNFKGDLKTLYDSMFQISFWLAGLSVLCDWIGSNAEIFKYHTTPIDLEEYYTKISLNNALKAVNKSGILPSKIAFNENHFGIFEYLQEPTPLQKFCSEVVLPDSPSLFILEDVTGSGKTEAALILTHRLMQKNAYSGFYVGLPTMATANGMYQRMSGVYRNLYTKESLPSLVLAHGARNLSDSFQSSVISDNAILADRNYSLQSDKNPEESASAICNIWLSDNQKKSLLADSGVGTIDQALLSVLSTKFQSLRMFGLSRKVLILDEVHSYDPYMVELICCLLKTQAKIGASVILLSATLPKILRKTFSESFALGLDTELQNIKSGEYPLVSLISDRSEVEETPIPTRKEVSRKLNVKFLFKQEPVLQKILEMSNQGRCVCWIRNTVSDASQAFSFLHSKLGDQVVLFHSRFAMGDRLNIESQILENFGIRSDQKSRKGKIVVATQVVEQSLDLDFDYIITDLAPIDLILQRAGRLHRHCRDISGNVKQGLDERGEPLLWIFSPEPIDDPKSDWFSQFSRGGGMVYSDHGKLWLTARLLQERKGWKMPEDARNLIESVYGIDVEVPQSFQENQSKVKNDKKKQESSAVLSTIRLELGYSALNETSWDDSKFSTRYGIDNSSKVVLAKFVSDRLVPWISGTNRNWQNSELPVPNYLVEKEFIFENSNIAEVISNCKINLPDKGKHCVLLPLFYTNNSWRGKALNKNNEVVSFIYDERFGFRKEK

SEQ ID NO: 12747 - protein, 932 aa, Leptospira santarosai str. JET
MEAEEKSYYKYWGKADQEGNYHLLVYHCLDVAAVGEVYLSQNETLCVHLSQKLGIDPPTFKNLFVFFLVLHDLGKFSDCFQSLIPNIKRILGNSNSPIGPYSVRHDSLGYIFWGEWILKDKRFGNYDGLLTEQNWLGWNGLRSSKEKSYFTEFLDVLIRCVTGHHGRPPSKNGYSGQTAVSPDSHFTEADRSAALAFCKEVNRIFSPNFEEDFKSLFDSTLPISFWLAGLSVLCDWIGSNSEIFKYRRTPIDLEEYYTTISLINAQKAVLKSGLSSAKIAFNENHFRIFEYLREPTPLQKFCSEVVLPDSPSLFILEDVTGSGKTEAALILTHRLMQKNAYSGFYVGLPTMATANGMYRRMSGVYRNLYTKESLPSLILAHGARNLSDSFQSSVISDNAILADRNYQSDKDPEESATAICNIWLSDNQKKSLLADAGVGTIDQALLSVLSAKFQSLRMFGLSRKVLILDEVHSYDPYMVELICCLLKAQAKIGASVILLSATLPKILRKRFSDSFALGLDTELQDIKSGEYPLVSLVSNRFEVEETPIPTRKEVGRKLNVEFLFDQETVFQKILEMSNQGRCVCWIRNTVSEASQAFFFLHSKLGDRVILFHSRFAMGDRLNIESQILENFGVRSDQKSRKGKVVVATQVVEQSLDLDFDCIFTDLAPIDLILQRAGRLHRHSRDIFGNVKQGLDERGEPLLWIFSPEPIDDPTSNWFSQFSRGGGMVYSDHGKLWLTAKLLHERKGWKMPEDARNLIESVYGVDVKVPHSFRENRSKVENDRKKQESAAVLSTIRLELGYDSTSNETSWDDSKFSTRYGIGNSTKVVLAKFVSDRLVPWISGTSRDWQNSELPVPNYLVEKEFIFENSNISEVISDCKKNLPDKGKHCVLLPLFYANDFWRGKAFNKKNEVVSFTYDERFGFRKEQLRGIV

SEQ ID NO: 12748 - protein, 758 aa, Leptospira santarosai str. JET
MEKLLAKSLSGDPRDNEQELYLVPHLRAAEEAGSAIYESIGERILKAVGLPSIIWSKRLKILLPLACLLHDLGKANNWFQELLRGMKIYQPIRHEFLSVIMILRSTKKIQNYLKEKIHVLETSEDKTPFINSIYSGILAHHMKMDIDLKRACPALFANGGTPTEIIAYTNASDFDSLFGQDKPTNDFCFTFLSSHANDKYKPIHRWIDEFQKISCEWEEFLKENNDWHIFSTILKPLVISADVIASALVPKGIEYKDWVIKSLQNYIEQNDINQIVKERLHGKSPREFQRQIANSEERITLVEAGCGSGKTIGAYLWAANNALNSKLFFCYPTTGTATEGYLGYVSDSNYESKLIHSKSQVDLEGIHKTGDEDSTELTDKIHALHSYHPKIIICTADTVLSLIKNGRKSILSFPSIATGIFVFDEIHSYNDEMFLVMVRFIQFFKNTKFLLMSASLQPERKNVLKREFINFQEIESPTDLMDIPRYKFEEIRDSKTLSEDIKRHAGHNKILVVVNTVKRAQSIYRDLKSSGLNVKIYHSRYKYKDRVIRHREFIVAFKDEAPPVVGIATQVAEMSLDIDSDILFCELAPIPSIIQRLGRLNRRTAPDNQLPARSVYFSRPEKPLPYDKEELELAEQWIEILRNSKDEISQNDLQEFFLNIKTETADLFPPVYYDFNKPTFYFTPATEGLRGASSTVNCILRSDLLEIDQSPYNIANYIIPMTMNRKVDFTILDQYKYAFVIPDEKILYDSLEGAQWLN

SEQ ID NO: 12749 - protein, 932 aa, Leptospira santarosai serovar Shermani str. LT 821
MEAEEKSYYKYWGKADQEGNYHLLVYHCLDVAAVGEVYLSQNETLCVHLSQKLGIDPPTFKNLFVFFLVLHDLGKFSDCFQSLIPNIKRILGNSNSPIGPYSVRHDSLGYIFWGEWILKDKRFGNYDGLLTEQNWLGWNGLRSSKEKSYFTEFLDVLIRCVTGHHGRPPSKNGYSGQTAVSPDSHFIEADRSAALAFCKEVNRIFSPNFEGDFKSLFDSTLPISFWLAGLSVLCDWIGSNSEIFKYRRTPIDLEEYYTTISLINAQKAVLKSGLSSAKIAFNENHFRIFEYLREPTPLQKFCSEVVLPDSPSLFILEDVTGSGKTEAALILTHRLMQKNAYSGFYVGLPTMATANGMYRRMSGVYRNLYTKESLPSLILAHGARNLSDSFQSSVISDNAILADRNYQSDKDPEESATAICNIWLSDNQKKSLLADAGVGTIDQALLSVLSAKFQSLRMFGLSRKVLILDEVHSYDPYMVELICCLLKAQAKIGASVILLSATLPKILRKRFSDSFALGLDTELQDIKSGEYPLVSLVSNRFEVEETPIPTRKEVGRKLNVEFLFDQETVFQKILEMSNQGRCVCWIRNTVSEASQAFFFLHSKLGDRVILFHSRFAMGDRLNIESQILENFGVRSDQKSRKGKVVVATQVVEQSLDLDFDCIFTDLAPIDLILQRAGRLHRHSRDIFGNVKQGLDERGEPLLWIFSPEPIDDPTSNWFSQFSRGGGMVYSDHGKLWLTAKLLHERKGWKMPEDARNLIESVYGVDVKVPHSFRENRSKVENDRKKQESAAVLSTIRLELGYDSTSNETSWDDSKFSTRYGIGNSTKVVLAKFVSDRLVPWISGTSRDWQNSELPVPNYLVEKEFIFENSNVSEVISDCKKNLPDKGKHCVLLPLFYANDFWRGKAFNKKNEVVSFTYDERFGFRKEQLRGIV

SEQ ID NO: 12750 - protein, 764 aa, Xanthomonas translucens pv. graminis ART-Xtg29
MKFYAHSAKRQDRGDWQPLAEHLIQVGDFAAEYAAPFGGQILARAAGRLHDLGKYTEKFQARLDGDPARVDHATWGARIARERYSTTGALIAYGIAGHHAGLADGRAGHEAQSRPSLQERLSDDYRKHELPPLLPDWERELALPDKLALPAGFAGHSHLERRPFQLSLLARMLFSCLVDADFTDTDDFYRRLEGRPSRAEEAGTRPTLAQLRERLNTHMAGFPREGGINPLRTQILHEVRAKADMRPGLFSLTVPTGGGKTLASLAFALDHAIAHAQSHGLRRVIYVIPFTSIVEQTVQVFRHALGVQDRDDVVLEHHSAFFDDPSAAPQAIAKRRLAMENWDAPIVVTTAVQFFESLFADRPARCRKLHNIAGSVVVLDEAQTLPHNLLRPCVALLDELARNYRVSPVLCTATQPALRLEQGFKGGLEHVQELVDDPPALYAQLQRVHVRHVGTLDDDALADHLRRREQVLCIVNNRRHARHLFDAIAGQPGVRHLTTLMHARHRSAVLAELREDLKAGRPCRLVATSLIEAGVDVDFPAVLRAEAGLDSIAQAAGRCNREGRRPLDASEVLVFAPANRDWAPPKELELFAEVFRGVERAHRNDLLAMEAVADYFGALYRRLGDGRLDREDLLGLLRNADIDGLPLDTLARKFKLIRTTMRPLIVPYAAGSDTEAPEIADTLHQLEHAEQVGVAGAARRLQPWLVQVPEQAYEALWQARAIAPIAQARYGEQFVRLVNPSLYDARFGLHWENPQFLDAGKNVW

SEQ ID NO: 12751 - protein, 742 aa, Lysinibacillus fusiformis ZB2
MFEKLLAKSATKTSAAQTIIEHTNHLIKKWEIFRKIYPNALSKKDWDILLQAVKYHDLGKANTKFQNKVRTIEERIEDLFPEIDEIPHNYLSCAFMPIKNLITHYGKEDATLLILAVYYHHERAEQNMYESGDEIKKDLQKYVSLLKDDFNIREEPKFDYRKFTDRTFLKNREQLYRFVRIKGFLNKLDYAASGDYEVEIPPEDLPQKMKKYFDNKKRTRNELQDYLYTLQQENHIVIASTGIGKTEAALWWLGNDKGIFTLPLKVSINAIYDRLINEIGCSKKNTGLLHSGMHAEYVKRADEQDLDLKTITHAKNLSMPLTVTTIDQIIDFVGLYPGFEMKLATLAYSKIIIDEIQMYSARLAAFIVLGLKYVTDIGGKFLIMTATLPPLFIEALKRLEVPFEKREDPFLKFAANNQPIKRHFMQIVEKDLTIEEILKHPMEKKVLIIVNTVTKAQQLYKEFEETGVKASLLHSRFITKHRQEKEDAILALGNKDCLNTGIWITTQLVEASVDIDFDILFTELSEASGLFQRMGRIYRTRDYVKNIPNIYVFTGEPLPSGIANNKKSVVDFTIFSKSKEVLLQYNNQLMDEKIKMEIVEQVYSREALGAECEYIQTFDETLAWYEDLLPYQEENKPTLRDIQNQLVIPYGVYRENELEIENIKNELSKRLAWQAKINLLIELQKFTVPIATWAYDNARKRKNGEVTSTIRVDRYTEYPVVTYQYTEELGLIFVNDVDAFFQ

SEQ ID NO: 12752 - protein, 938 aa, Veillonella seminalis ACS-216-V-Col6b
MGELIAHIADFSNINLKKEQSLFEHLKNCAIHSQELASDIGIPTMCFLVGLLHDAGKSSVAFQEYIRGNNKGHVIHSSTGARYLQKLFKELWAGNPEYRVKVDQNERRKRKLYTELMQYAILAHHGLFDILEKDQYKFGQRLLLNPNMGESKANETIFFKELNDWCAEEFNQTLSEMFIQGYEEFSVWNDKKLKLLESYNDSNNKNDKVIARTFYEGAMARLILAILKDADIFDSSNFGREIIDKRYNTDEMNVVWSQLSERIQHFYSQFKEPTNRLNKVRGLLADEVLDKANQCAKGNFKLDMPVGSGKTYASLRFAIENAKVFQKNRIYYTTAFLSVLEQNAQEIQEVLTDKGRYPAYDAYILEHHSNVISDNIEQNNFSNNGDIADYTESEDYDYVNYLRESWEVPVILTTLVQLSNTLFAGRAASIRRFSKLINSTIIIDEIQSLPPEIIYNFNLMMNFLTHMMKVTLVHCTATPPSYDQKTVLAYPCIYGLCPIKKDLVGHKNEQVLTELTSKENSKDEVFSRVVYKSLLGENCQKIFDTEELASHIISRLNTEKSILVVLNTKKAVITLYDALKNCLADEDIALYNMTTNQCAAHRLDYIKAIKTQLKALRKGEEGTPVICISTKLIEAGVDVDFDIVYRSLIGIDSIMQSAGRCNREGKRTKKGIVYIMRYGVEDLSRLPLFNVAQKVILNMLSTNVDRTNWKFDEEDSSYLMANSISELLEQYYKSLYQTLILQNVAFLQYPIKLKNWKPELNTTLLDLLSKNKKIQEAADQGIDTMKATIENTLRRSGIPVGIVNSGSNNRGTNKPDNSKRKGKGALMQSFKTAGENFHLIDNDNVTVIVPYQNEECSQLMELLYDLIEKIKVERAIADYGRLKHLLKRLQRYTVSIRKDLIKDYKISLELDKQICILQSEDYDIEKGLIHGDMNELIF

SEQ ID NO: 12753 - protein, 423 aa, Bacteroides oleiciplenus YIT 12058
MQEATREAYRENKDLVLLSPTGSGKTLAFLLPLVQSLKAEVQGVQAVVLVPSRELALQIETVFKSMGTLFKAMSCYGGRPAMEEHRTMKGINPSVIIGTPGRMNDHLRKENFNANTVTTLVIDEFDKCLEFGFHDEMAEVIGQLPSLQKRILLSATDAEEIPQFAGVGDDSPLIKLDFLDPEALAPRLRLHKVLSPEKDKLETLYKLLCTLGHHSTLVFCNYRESVERVTEYLQTKKFPCDMFHGGMEQPDRERALYKFRNGSCAVLISTDLAARGLDIPGIENVVHYHLPVNEEAYTHRNGRTARWEADGNSYIILHAEERIPEYIPEDIAAFEFPEVLPKPAKPRWATLYIGKGKKDKLNKIDIVGFLYKKGGMAREDVGQVDVKEHYAFVAVRRSKMKQLLTLIRGEKIKGMKTIIEEAK

SEQ ID NO: 12754 - protein, 983 aa, Actinobaculum massiliense ACS-171-V-Col2
MQENSRTEKSNTTWSRQAIALWAKTSKEFPEAEYMTLPEHLMDSAYVAGGLWDTWVSPNLKNGLASDLGFSPAETRDFIRWLAGTHDVGKATKAFQSQLEKRGPEFGNYAQRVRDAGLPLGRAYTKDDWYPHSAASQVIITRYLENAFGDTRAKRAVIRGIAEVSGAHHGLPAFSQKITNAKSDICDRQESAWADVQHELVSTLTHRLKAERILDQLICVGKRITYRVRMIATGIVIMADWIASNVDYFPLVSSPTADIEERFQVGMSRAHLAAPWRPGTFEGEASSSYAARFGWADDRVPFAVQEQVFEVARRMEGPGLLCIEAPMGQGKTEAALMAAEILAQKNGQTGIIFAAPTMATSDSLFKRVRDWAELSGGGQVLSMYLGHSKNQLNREYVQTPKNSATQLFDNTDSKGRSVGTGADAQKRSTAVVDDWMRGRKKGMLSSIVVSTVDQILMLALQSKHAMLRHLGLAGKVVVVDETHAYDAYMTAYMARTLTWLGYYGVPVILLSATLPQAIKGVLLGAYQEGLLRGDRAGDDNSVPPSGSAYPAITVADTGGVSVVDVPAQSREIAYSLEVIPDELDDLRQQMRPVAEAGGCLLVLCNTVSRAQDAYTVAKELVGADARLLHARFISSDRVVAEEELSRELGPDAHAGDGRPRRRIVVATQVVEQSLDVDFDGIISDIAPIDLLLQRLGRVFRHRRDAEERPAWGKVPTLTIRGLNAEFDELHLPVFEESQELIYERAVLLGTCAQLLPYLAERRSLVIPTEIPSLVHAVYDDQSGIPTNWVGDFAQACEEMENRRAAARKKACRFQFSVPFRDGNFTALWDQQDRDVEKNAVSEAQGLAQVRDVDPTLEVIVTQRVPGGYRPLPWVGDGYEDEVLSEGMEVSWNVARDLATSTVRLPYAFSNPKRGLFEDALNELERSTDEGWARTPILSDQLQLLLDENFRATIAGRVVRYDRELGLIDESAEQWRASKKTVSE

SEQ ID NO: 12755 - protein, 789 aa, Prevotella sp. oral taxon 473 str. F0040
MATTMKFPAYHDSSIMAHVAADGRIQSLNEHAAGVAKRCAKFLIDVGHPVLAPLGELLGLLHDLGKTQPDFQYYLKKVAIEKTMALKAPHSMVGAAYAGYDKLTQNFPAIFGILSYVISGHHRGLYDYDQLDDNLHSQELRKRTMDCAEEFKIGFGILMDFLQLHGKTIKEYLQDNTSHSNAQAMVRLCFSCLIDADFLDTEEFMDAARQETRQQTTAAYECMAVLQKKLLDHTGSFSANTPVNMARAQFLSTCRQHGSQCELGYYSLFLPTGGGKTLSSMAWALETALHHGLQRIIYVIPYTSIITQTAQVFKQIFGEHNVLEHHSEFQESVSSARETNILTSSSTDDEAYSPYRLICENWDAPIIVTTNVRFFESTFSHKVSATRKMHNVARSVVVFDEVQQFPNAFLNPMLHGLDNLREVFQCQCLFCSATLPSFDRNHNSPFKHVKDFYALQHRLSPIVDITAEMVAPFERVHYHLKPISLTYAEIAMRLKQHTSGLCVVNTRKEAAMLYLELLEQGCPPEQLLHLSRNMCSSHLKTAITAIRERMAQEIPTLVVSTPLIEAGVDLDFPVVYRTKTGLDGIIQAGGRCNREGKRAERGEVFVVDLIEGGQLQGDRKEAVYATQDLIHATGATYSESHLDYIQQYYERFFKRIKTFDAHGIAARLWRADYAESWQFDFESASKDFKIIDEQDQVEIILKDESLLPLIDSLQHHRAFLSRHVLRQLQPYRIGVSHRQYNTLLAAGWVEKIVLDPGTQRELCMLDLDGYDAALGVRWDNPYADAPLIS

SEQ ID NO: 12756 - protein, 838 aa, Aggregatibacter actinomycetemcomitans Y4
MLLLKKLGRFFDLKEIAMSRNAIAHVRQSDGLRQLLIDHLFETSSIAGQLASKLNLSLAGELLGLLHDFGKYSLSFQDYIKAATGIDPNADDYVLPGGRKIDHSTAGAQWVYRALRKYGVAQGIGELFGQMLGLCIASHHGEGLIDCLDESGNAVWKKRFEKEDELTHLAECSRNADAQVLQRAQTLAGEELVRELLNAVKPILSDKTIPQKKQEFYLGCLTRFLFSCLIDADRINSSDFEKAHQKDVRRLVEKPDWQDAIEKLENHLAQFAIRYPIDQIRRNISDDCLKRAVDFQGVYTLTVPTGGGKTLASLRYALHHAKKHDLDRIIYIIPYTSIIDQNAAAVREILGEDWVLEHHSNLEPEQQSWQDKLLSENWDKPIVFTTMVQFLDAWFGGGTRGARHIHPMTNSVLIFDEIQTLPVKCVHLFCNVLNWLTQFGKSTAILCTATQPLLGEAGLNHFPENEREKIIRRGLIKLPENAEIMGDHQDLDNLFNALSRVEIQFKEKAGGWTAEDAGEFLLEQFQTTQSCLFIVNTKKWAQQLYQYCEQQNVPPEALFHLSTHQCAAHRKAIFERIKGRLKNGEPVICISTQLIEAGVDISMKCVIRALGGLDSIAQAAGRCNRHGEKDSKGQVYVLNLQEPDFQKVLPDIQEGKSNAGHVFRDFAGQDILQPAAMQRYFQYYFYNRSGEMIYPVKNSATGSLFDWLSDNQNNPYGNKNNKKTKAFPLLMQSFKSAGRAFHVIDAPTRAVIVPYGEGKALIGKLCGEWNPAEMRRALQKSQRYSVNVFPNVWDKLQKDQAVHETIEGSGIYYLNERYYNDAFGLSLDETSNMTFYDL

SEQ ID NO: 12757 - protein, 804 aa, Selenomonas sp. oral taxon 138 str. F0429
MKEYLAHIRRDESAEQPIRAHLLRVGELMAAYAAEIGLSATARLIGVLHDLGKCTAEFAGYLDWCRKHPGNYTRKGEVDHSTAGGQLLMKKYGRLGEDECLVVQMAALVIFSHHTGLMNYLGENGTSDFLRRMEKIDLPNVDLSCYYDTVISESELDLLFEHAVHEFTVLDAKITALDPERGEKYHFYWGMVHKMLLSMLVDADRLDSAEFELDKPLTDEWDTAEIWADFSDKLEQKLTGFSIPPEPKAEKIARLRQKISDDCLESGDEPPGIFRLCVPTGGGKTLASMRFALRHAQKYNKKRIIVVIPYTSIIDQNVKEIREIFCMDEAILEHHSNVITEDDGEDTERMDFRRILTERWDVPVIFTTQVQFLNTVFAGGNSPLRRLHALEDSIIIFDEIQTLPIRCTYLFNAAMNFLKDFCRVTALLCTATQPPLEQLDVPIEMRENADLTSDLAEVFEGFQRVQIENICEDGGVSISEITGEIVHSAEEIGDVLCIVNLTEQARNLYEKVSELAQISERDIHVVHLSTKMCPAHRKEILRTVREELDVRHEYPEQRLICISTQLIEAGVDVSFPVVYRALAGFSSIAQAAGRCNRHGEMERGIVRLFTLENEDLSRLEDIWQGKKIASDMLYKTSADEILTPQAMEKYFRRFYKGRTARDMRFPMKDSNTIFDLLSANEAGLQEATENGAQPDLWFTHAFCDAGRTFAVIDSHTEPVLVPYAGGKELIVKFNDMQFDKQRISKKMNAAQQHMVNLFSYELQKLAKLGGIWRTESGVMALREEYYNEAFGIQTEEQGNAYCMI

SEQ ID NO: 12758 - protein, 827 aa, Neisseria sp. oral taxon 020 str. F0370
MSDNQFIAHVRKADGEQQLLETHLAETAEIAGLLAAKLGLGMAGKLLGLMHDFGKYSEKFQSYIRHATGLLDPDADEEENTPTDSKVDHSTAGAQWVYGRLKVFWAQYGIGELFGQMLGLCIASHHGAGLIDCLDPDNGEAVWRKRFNKDDALTHLAQCEQVADKSVLQQAQSLAGEALLKEMLTALDAIIRPMSESFNKERKHGEIRTPHKIEEFYLGCFTRFLFSCLIDADRINSADFEREAQKDVRRFAEMPDWQAAIDKLEAHLAQFPVRYPIDKIRRDISDTCLRRSGDLQGIYTLTVPTGGGKTLASLRYALHHAQKHRLDRIIYIIPYTSIIDQNARAVRDILGADWVLEHHSNLEPEQQSWQDKLLSENWDKPIVFTTMVQFLDAWFGGGTRGVRHVHAMTRSVLVFDEIQTLPVKCVRLFCNVLNWLAQYGCSSAGLCTATQPLLGQVPNPELGSLKLAKDAEIMGGGQDLDILFAGLSRVEIIPKLKAGGWSVDEAGAFLLERFQTASSCLFVVNTKRWAQELYQYCRRQNVPSDALFHLSTNQCAAHRRAIFDVIKQRLQDGKPVLCISTQLIEAGVDISMACVIRALGGLDSIAQAAGRCNRNGENTDKGQVYVLNLQEPDFSKVLPDITAGQANADRVFREFDGQDILQPDAMNRYFEYYFHQRGSEMSYTLANSVSGCLLDWLSDNSRNPYMPKNNKRGKAIPLLMQSFKSAGRAFAAIDAPTRAVIVPYGKGQELIAELCGAWDAKEMRRTLAQAQRYSVNVFPNVWERLQKAQAVRETLAGSGIYYLDERHYHEAYGLCVDEAGEMTFYDL

SEQ ID NO: 12759 - protein, 406 aa, Weissella ceti NC36
MKRENNDVGREYVVAFNGMSAISKQRCNRCQAKVLRWMVGPQGKYCWTCSSMGTVTDHKSLEVIATNKRIDVPKSLMRWEGTLTSQQAKLAEYLCRETKENQLVHAVTGAGKTEMLYPVLEKYLSAYARVAFVAPRVDVVHEIAARLKPIFNVTQTTMTGEQKDTHQYGQLVFATIHQLFKFKDAFDLVIVDECDAFPVYRNSWLQGAITKALKRNGRLICLTATLPNDLHQQYGITKEHTLQLYCRFHGYPLPNLIIRYCRNWRRKFPKDALQVLKNQKSPILIFVPEIKDCVYVKNILESVLGQSVGIVYAGIENRSETIKHFKRGQTHYLVTTILLERGVTFPGIDVMIIGAESAIFSTASLIQIAGRCGRSIDRPTGYVYVYSEWKMRKITRAYSEIKRMNK

SEQ ID NO: 12760 - protein, 698 aa, Escherichia coli KTE196
MRKYPLSLLKDKNIVTFFDFWGKTRRGEKDGGDDYHLLCWHSLDVAAMGYLMVKRNCFGLADYFRQLGISDKEQAAQFFAWLLCWHDIGKFARSFQQLYLPPELKIQESARKNYEKISHSTLGYWLWNHYLSECQELLPSSSLSPRKLRRVIEMWMPVTTGHHGRPPDRMDELDNFLPEDKAAARDFLLEIKPLFPLIEIPAFWDDDEGIELIKHLSWYISATVVLADWTGSSTRFFPRVAHPMDIKGYWQKTLIQAQNALTVFPLKAKVAPFNGINTLFPFIENPTPLQQKVLDLDISQQGPQLFILEDVTGAGKTEAALILAHRLIAAGKAQGLFFGLPTMATANAMYDRLVKTWLAFYSPESRPSLVLAHSARTLMDRFNESLWSGDLVGSEEPDEQTFSQGCAAWFADSNKKALLAEIGVGTLDQAIMAVMPFKHNNLRLLGLSNKILLADEIHACDAYMSCILEGLIERQARGGNSVILLSATLSQQQRDKLVAAFARGTEGQQEAPFLEKDDYPWLTHVTKSDVNSHRVATRKDVERSVSVGWLHSEQECIARIESAVSQGKCIAWIRNSVDDAIKVHRQLLARGVIPASSLSLFHSRFAFSDRQRIETETLARFGKYCSLQRASQVIVCTQVIEQSVDIDLDEMISDLAPVDLLIQRAGRLQRHIRDINGQLKRDVFPAPAGINRVHGYSV

SEQ ID NO: 12761 - protein, 768 aa, Escherichia coli KTE203
MRKYPLSLLKDKNIVTFFDFWGKTRRGEKDGGDDYHLLCWHSLDVAAMGYLMVKRNCFGLADYFRQLGISDKEQAAQFFAWLLCWHDIGKFARSFQQLYLPPELKIQEGARKNYEKISHSTLGYWLWNHYLSECQELLPSSSLSPRKLRRVIEMWMPVTTGHHGRPPDRMDELDNFLPEDKAAARDFLLEIKPLFPLIEIPAFWDDDEGIELIKHLSWYISATVVLADWTGSSTRFFPRVAHPMDIKGYWQKTLIQAQNALTVFPLKAKVAPFNGINTLFPFIENPTPLQQKVLDLDISQQGPQLFILEDVTGAGKTEAALILAHRLIAAGKAQGLFFGLPTMATANAMYDRLVKTWLAFYSPESRPSLVLAHSARTLMDRFNESLWSGDLVGSEEPDEQTFSQGCAAWFADSNKKALLAEIGVGTLDQAMMAVMPFKHNNLRLLGLSNKILLADEIHACDAYMSCILEGLIERQARGGNSVILLSATLSQQQRDKLVAAFARGTEGLQEAPFLEKDDYPWLTHVTKSDVNSHRVATRKDVERSVSVGWLHSEQECIARIESAVSQGKCIAWIRNSVDDAIKVHRQLLARGVIPASSLSLFHSRFAFSDRQRIETETLARFGKYCSLQRASQVIVCTQVIEQSVDIDLDEMISDLAPVDLLIQRAGRLQRHIRDINGQLKRDGKDERSPPELLILAPVWDDSPGDEWFGSAMRNSAFVYPDHGRIWLTQRVLREQGAIQMPHAARLLIESVYGEDVVMPEGLQRFAKT

SEQ ID NO: 12762 - protein, 698 aa, Escherichia coli KTE117; identical to SEQ ID NO: 12760

SEQ ID NO: 12763 - protein, 730 aa, Anoxybacillus flavithermus TNO-09.006
MDNVYAHTPRKNDQEWHYLKDHLLSVAELARSFAEPFQGGRVAYLCGLLHDLGKFHPLFQTYLKRKEDGENARSVPHAIWGAAFMYQLYYEKLKHPHIWKWFALPIAGHHAGLNSSFYLSLTLKENLKKNFAHFSEILQQAELFLKEFVFPSMRSGIDTLPCSETEREMWIRLVFSALVDADYLDTERHFQPELSQSRQPLVSIESLWNGFVANQTRLTKEADDTVVNRVRREVYEECIYAATKPQGMFRLTVPTGGGKTRSSLAFALKHAMEHRLDRVIVAIPYTSIIEQTANVYRDIFGNDAVLEHHSQVEVDDQRETGEEQIIQQRLSAENWDVPLIVTTTVQLFDSLFSNRPSKVRKLHNLANSVIILDEIQSLPAELLKPTLDALTMLVKHCKTTVVLSSATQPFFEESKFLNVFSRIEVSEIVPSLLVDKHLQQMKRVEYDVWKTPISMQELVHFIRQQKQLLVVFNTRKEARECVELLREDEGVFHLSTLLCGAHRRRILDEVRERLRKNESIRLISTQVVEAGVDLDFPIVMRQMGSLDRIVQAAGRCNREGKIDKGKVIIFETKEMPSPKGPYKTAMETARFLLAQRQPEDLYNPNIFREYFRRLFAAVDVDSKNIQKDRETLDYPLVAEKYRLIDQDTVSVIVPYAEALKCLRMWESSPSRYSFRRLQPYMIQLYRFEAEKKEKDGWLREVADNVYEWLGDYDERLGIIEEVHDPFSLIG

SEQ ID NO: 12764 - protein, 779 aa, Anoxybacillus flavithermus TNO-09.006
MSYLIPFSECIARPDDQNRKYTLESHLTNVCEWMKNWADDPHIKVLLILAGLCHDMTKAHIDWQTYIRGIGTKGPAHAPSSAFLFSYLAYQYLEKEKVWEKYCREWLWLLRDIADHHSDLHTLSYINWVKQYEWEKIDVDGYVAFLNKYIPHLYVQKEQLSEWVWRVDEIVEEVLQQLDTSYQESHYRYWMSEIQRWRHYTTALISGDRFDVKSICPTIIPVWQRDESFVHLQKYCAKKTSHPMSSARQQAKEKIIDEWRRNHSSRFYTVNMPTGYGKTIASLHLALEMLKTYDYKKIIYIAPYLSIIEQTAKTIEEALNQNVLEHHSLSMLKEDKKRLSLADDEDRLSLAIESWANGIVCTSFQQWTRAMFPKRAQHTLRRSFLEKSVIIIDEPQIFQPEGWNVFLLGLEAMAERYDLRVIFLSATMPPFQYGLSKPPVSLTVQAVEAHNRYVVKRTEKMDEKQAAMFLTKCSSQSKAMILNTIEDAYRVYKELKSLETNVYLLHGLMIPIHKQAVIKQIQSRLLEQLPTTVISTQIIEAGVDVSFETVVRANAILPSIVQAAGRVNRHLEKEKGLFWIMPFYREGEKDTRHPIYDRFLTSITDEILMEKEIWTEFELTSVVQKYYEKMFTYNTYEATKRMIQEAYEGNWNKLSEYEPFGKGYLKLSLFVNWDWDEYIQHVSLDVMRLMKHYGVHCPMELYERFQDQTWLKHLSLEERKRFMILVHAFVVNVPIKYALKVASKEQFLQKKIPLLEDTEAYHPKLGLTFPFDEQFDCII

SEQ ID NO: 12765 - protein, 764 aa, Xanthomonas translucens DAR61454
MKFYAHSAKRQDRGDWQPLAEHLIQVGDFAAEHAAPFGGQILARAAGRLHDLGKYTEKFQARLDGAPARVDHATWGARIARERYSTTGALIAYGIAGHHAGLADGRAGHEAQSRPSLQERLSDDYRKHELPPLLPEWERELALPDKLALPAGFAGHSHLERRPFQLSLLARMLFSCLVDADFTDTDDFYRRLEGRPSRAEEAGTRPTLAQLRERLNTHMAGFPREGGINSLRTQILHEVRAKADMPPGLFSLTVPTGGGKTLASLAFALDHAIAHAQSHGLRRVIYVIPFTSIVEQTVQVFRHALGVQDRDDVVLEHHSAFFDDPSAAPQAIAKRRLAMENWDAPIVVTTAVQFFESLFADRPARCRKLHNIAGSVVVLDEAQTLPHNLLRPCVALLDELARNYRVSPVLCTATQPALRLEQGFKGGLEHVQELVDDPPALYAQLQRVRVRHVGMLDDDVLADHLRRREQVLCIVNNRRHARHLFDAIAGQPGVRHLTTLMHARHRSAVLAELREDLKAGRPCRLVATSLIEAGVDVDFPAVLRAEAGLDSIAQAAGRCNREGRRPLDASEVLVFAPANRDWAPPKELELFAEVFRGVERAHRNDLLAMEAVADYFGALYRRLGDGRLDREDLLGLLRNADIDGLPLDTLARKFKLIRTTMRPLIVPYAPGSDKEVPEVADTLRQLEHAEQVGVAGAARRLQPWLVQVPEQAYKALWQAYAIAPVAQARYGEQFVRLVNPRLYDARFGLHWDNPQFIAAEALVN

SEQ ID NO: 12766 - protein, 831 aa, Photobacterium marinum
MSFIAHCREDDACQQTVFEHLSQTSDLSARFAQKIGLPNSGKLLGLLHDFGKYSGAFQAYIQSAQGLIDPDALNFVDAKSHKGKIDHATAGAQYLYQRLRQYGRQGQGELCGQVLALSIASHHSGLIDMLAADFNKGNVFDRRMQKSNDKTHFAECCQNAEPELLEQLELLLGSDGKAPVVLKEMGECLCQMLGSPNQADSITKSFVLGFLSRFMFSCVVDADRINSAEFCEPRRLEERLSKPEKPDWVVAIERLENHLSALSPRNPIDHIRQQISHRCQQQALLPKGVYSLTVPTGGGKTYASLRYAVHHACKHKMDRIFYIIPFTSIIEQNAAVIRDVLEQEGDLHTWVLEHHSSLEPEAQTWKSKISADNWDAPVVVTTMVQFLEALFAGGTRSVRRLHQLANSVLVFDEIQTLPINCTHLFCNALDFLIRHTGSTAVLCTATQPLLDKLDNPHKGQLSVSGELVEDVSRLFNDLKRVHVENACKPPGWELDEIAELALGEFEQKGSCLTIVNTKQWAQDLYQACAGRVDSEALFHLSTNQCPAHRKRLLILIRQRLAAGEPVMCFSTQLIEAGVDVDFATVIRFLAGLDSIAQAAGRCNRNGRQPCATVYVINPREENTRMLIDIDKGKDVALRVMSEGFDDLLCPQAMERYFEYYFYQRSDDMDYRCKDSQQNATSLLTLLSNNFEHPLASNDQRVARGCLPRLEQSFMEAGRIFQAINAPTQAVIVPYQQTETELTDGLMSADEIINTLCSKDEKFDAQVYYHALRQAQKYSVNVFPNVWDKLIQAQAVAETQPGSGVYYLLEQYYDADFGLSTEPVSSSSFICC

SEQ ID NO: 12767 - protein, 892 aa, Fulvivirga imtechensis AK7
MEASFRSFEEIVSERLALFDILEGDYWAHIDGCDHSVESLKEHCTLVSDYFLKVVKAHELESIITNQITKLTDLLSLDDPKEVRLQLVEVFISTVIYHDLGKVNSNFQREKMNNPAFSRKTLSFGSQHSSLGAFLFCSLYIEKLLKAKLSEKDVNILLYIILCFANPIYKHHSSYLDIKKELASLPVSEFADFLSAYNICIDKSVISNVFRDDALKELRKLFNQNASQKAHFILYSLLKLNFSLLTASDYYATGEFMSGPTVTDFGLLNEKLRFEIDNNFRTALSYNRDLFNKFNEYKSLSFNGLQERTGENLNFLRQKLNAEVISEIRKSPSSHWYYIEAPTGAGKTNLSLACINELLAVDKGLNKVFYVFPFTTLITQTFSGVKEAIKVTNADVVQLHSRAGFHRKEEREDGTYGDEKLNFIDNLFTNYPITITSHVKFFEIVKGNSKESNYLFHRLCNSIVVLDEIQSYNPQHWDKLVYFLEQIAPPFNMRFIIMSATLPKIDLLSKSLNGKVTSLTPNRNRYFSNPNFAQRARFNFSLLNDKAPSKSEKESYLESLATTIHEKSEQYENISGRGSGVLIEFITKNSASLFNKVVKRSSCFMDYTIYLLSGDILEPRRRNIISQIRNRTDNKVLLISTQVVEAGVNIDMDLGFKNHAIIDSDEQFAGRINRNATKQHNEIYLFRCDSAKTIYGKDERYKQQQTKADIFDNIEEILENKSFHSLYEKVFAEKLKIDPNDADKLESYVRNFEELELQEISRQFRLIEDNETQQIFIPLDIPLEYFDDPGYLKEIEVISDNMVRGELVFEFYKAILKREIDYIPKSIEIKKLGGILSDFTINAYPTVIKKLAGYFDEGENGQYGFKYLLHCKECYTLEDGFDFSSESQDIFL

SEQ ID NO: 12768 - protein, 759 aa, Gloeocapsa sp. PCC 73106
MQLKLEPDLLLAKSFQPGKWKGSYGLVGHTADVVNAITILVRVLGDRLIEQFGLKCTLAQLEATARQSAYIHDWGKANEHFQKVVRHQRDPLKNPQLLRHEVLSILLAWEFREWFENGPGDFLTALAAAGGHHLKLGGKKGEPTSEFGEIRPSGDDKLYLYVIDRIDGKPQFNRHFQQLLKYGVKKLGLPAKIQFSKSFAQELKQRSALIWSVTEIKDKRKEINEFLSNEWEPDAVLLAVVKALLIPADAIASAIPNTNLSISHWITQEVQRTLDEEKIQKVINARLQNNELRPFQIQLAQSSARVTLARAGCGTGKTLGAYNWAKSKAIGRKLIFCYPTTGTSTEGFLDYVHNEVDAILLHSRANVDLEMAKTGEEDAAGEEINNEVALKLESFQAWGAEAIVCTVDTVLGLLQCNRRPLYCFPVIAQAAFVFDEVHCYDDCLFGALLRFLAVVKAPILLMSASFLPWQLEAIQKAVGEPIQVISGPQDLEQQYRYRFDYTDNPNWERVETELKEGGKVLWVCNQVNTAIAVYREAKAKGLNATLYHSRFRYEDRVKHHRKVVDAFKANHTQPVLAIATQVAEMSLDLSATLLVSQIADPAGLIQRLGRLNRRYCGRALDALFYTDEKTGFPYSQEQLEQGLKLIQSFTGEVCQADLAQWLESVAKKGNPDTGSVLLDQSWRTYPASLREAGFTVTVLLEQDLRTVKYLSSKELPRYTVPIIANIKEVKTWKKHKFYPIAPSDRWNYSPDLGVYEIKS

SEQ ID NO: 12769 - protein, 928 aa, Xenococcus sp. PCC 7305
MNFTPEIIDKYFKQLTTFTPRGFQREAIANLLNQPKPINTILKAPTGSGKTETAIAPFLFAKLHDLDFPNKLIYVVPLRTLANSLRTRTQQYIFQYIEKWNEQSKTKNIKDIVVTLQTGENPEDPRFEGDIIFCTIDQMLSSFLNIPYSVGRGSANVNAGAIFASYLVFDELHLLDPERSFATVLKVLEQAKGISPFLLMTATLTKQLVDEIMSAAGGSIKEVKVEKEDLDNIQGDRQRTFKAIDQPLSAKLILDDIEKRDRKRVIVICNTVSVSQGLFRDLEEIIDPNKIDVTLLHSRFLPGDRKKKESNLETIFGKGWRDDGKCYVLISTQVIEVGINITSQVMHVQLCPMSSLLQRAGRCARFQGETGEVRVYKNVAIEENNQELAEADTDDAETELIHNQPEKKRRFLPYSDDVCEKTSEILETQHDAQKSVGFETEDDWIQKVHQDESELQKKRRQNNRLEFENKFRDAIFEGDRSTARQLIRFVDNRTIYVSNISTDNAMVLDGSSQEDGEGVDLSKLSVFSVPKTSLLKALKEFNENKLDWLFKRVENPQADKAETYKKPGAKKITITSEKVNSAKEVVASFRLIINRKYVGYSKDIGLEINVTNPPEQKQDIPKPDNSEKPYKDEYEYYMDTYAQHLKMMWDCWHNQFPPQAAEDKLTYTSIREELLQAGGRFIRAKIFTQASKEKAEALFELLVMFVILTHDLGKLQVKWQEVMRGWQEIAYKKSENIDDFNASNPKDLLLAHTDHKPSIPELKAEYKKYMAENKRPPHAVESAFLMTELLEIHLQPILEDSFDADEEQIENIFGVIQMAAGRHHSAWARGWKLSDVARNETIELVENANDAIADSWQKLVKNLKLPDSISLSLSSEPFELKQTIYDAGVIDLNFFDSDSLEYQQLYALVVRALRICDMRSVQLIEFKK

SEQ ID NO: 12770 - protein, 1122 aa, Vibrio cholerae HC-78A1; identical to SEQ ID NO: 12513

SEQ ID NO: 12771 - protein, 768 aa, Aggregatibacter actinomycetemcomitans serotype c str. AAS4A; identical to SEQ ID NO: 11710

SEQ ID NO: 12772 - protein, 623 aa, Aggregatibacter actinomycetemcomitans serotype b str. SCC4092
MRRNRQVFRPNFPDLEDMHSRYEKHMLDLAEKSDKHSVLNQERSAILAQCFSAAESDRTLFSLTVPTGGGKTLASLGFALKHALKFGKKRIIYAIPFTSIIEQNADFFRKALGDDAVLEHHSNLEVKEDKETAKTRLAAENWDAPLIVTTNVQLFESLFAARTSRCRKIHNIADSVIILDEVQQLPRDFQKPITDMMRILACDYGVTFVLCTATQPELGKNIDAFGRTVLEGLPDVREIVADKIALSERLRRVRIKMPPPNDETQSWQEIADEIAERPCVLAVVNTRKHARRLFAALPSNGIKLHLSANMCATHRSEVIALVRRYLELYREGRLKKPLWVVSTQLIEAGVDLDFPCVYRAMAGLDSIAQAAGRCNREGKLPDLGEVIVFRAEQGAPSGSLKQGQDITEEMLKAGLLADPLSPLAFAEYFRRFNSKGDLDKHKITELLTAEFSNDNPLAIKFRTAAERFRLIDNQGVALIVPFIPLIHENGDKSPKIVQANELDDFFRRHLDGVVESDWQKTLDDYRYPSPPDNHFGQTDKPPLPEPFEMWFKLLEADPLKNKWVYRKLQRYTITVYETELKKLYKDAVFSRAGLLVLDNGHYHDVLGADFDDDTVVPPEESVL

SEQ ID NO: 12773 - protein, 595 aa, Aggregatibacter actinomycetemcomitans serotype a str. A160; identical to SEQ ID NO: 12534

SEQ ID NO: 12774 - protein, 985 aa, Wohlfahrtiimonas chitiniclastica SH04
MIVTFISQCEKKALSRTRRVLDAYANRIGDNVWQTIITDDGLLMVKKLLRKTASKNTAVSCHWIRSRRRSELLWIVGNRSRFNEMGYVPVNWTMKDLITDVMTMKAKENELYANTQLQPLAEHLFAVGWVAEEIFKRTVKNEEYQKLSQIAFLAGCLHDVGKLDPYFQEWVRKGKQKNLEDDGQHIDVKFTFDKHPRHNEISAILLAIFDSELQGLNLRQKEALIHVIYWHHAKPFRKTDDFEEVFKAYEYLRKNLDSSAFQKLMNGTKALLKAIQSIATQYQSKESLITRQDWSVDALADLFEQFEYHYKGKTFAEFKSYSLTDDFEQLRNNIQKNAHNNLLRACVTSADRLISQQTAENLLSLIAEGRLDALIENVTEDEISLLIPHLESASSKFPMSERTQVQNKMAEELSQKRDIPVLAGPAGCGKTRIALEWARLQNASQIIWVCPRVQVCQGIFQELIETYLPDADVEIFTGEFKYTKEWGNETPEEAYFSGDVIVTTIDQILGSIVTHTRVDSLIPFMQAHVVFDEFHEYIPMDIFNILFAELIANKNMHENYQKKALLVSATPHYFYLKEILGIHPEDVVEMASFNPSQYQLQFVEYDEKSLDNNPFFQSYENNTFVISNTALTAQLGFIYQKDQENSILFHSKYKKSDKRILFDEVYNSFKKDGTHKYAVLRSGPIVQASLNISADTMLTEMTSPENMLQRLGRLDRFGQNKDPNILTIAVTEAVKNGKSLGTSAYFLNQLNRLQTTKYWYDFLQEKIGDRTFSLTELYQIYKDFYHSELGARATQGDLEKAIKQSITLIGKKVAEPSVVVKNKAKDQKARISKNSLRGDSRFVQLALLDLDDYQHPIFMNAYAYEPPLDDRSEYDNLTESLTAVRDLLPFIAQKQGIIDPSHPMKGIPAKKMKLREQVLEGHARDPDYPLYLSYHIDDLDKVGGVGQRNEHAIYYAICSQQAIGMIAYDKLQLLNHNPSEGENHE

SEQ ID NO: 12775 - protein, 264 aa, Tupaia chinensis
MVSCRLRKLGYSKEEEGEMYNPDFFYENAKIPSITLNKDSQFQIIKQARTAFGKDGECYSQRIHSSLPVEVPLNHKRYVCDLTQADRLALYDFVVEETKKKRSSSQIIENDSDLFVDLAAKVNQDNSRKSPKSYLEILAEVRDYKRRRQSYRAKNVHITKKSYTEVIRDVISVHMEELSNHWQEEQEKAEDAAKDEERRSVSVDSRQSGGSYLDAEYSRHRRDRSRSPHKRKRNKDKDKSCESRRRKERDGERHHSHKRRKQKM

SEQ ID NO: 12776 - protein, 937 aa, Haloferax volcanii DS2; identical to SEQ ID NO: 11729

SEQ ID NO: 12777 - protein, 875 aa, Natronorubrum sulfidifaciens JCM 14089
MAVRYSHPPEGDHNGVALLDHLEDVAERVEYVVPEEARTPAGGSLKDVVETIAYVHDFGKATTYFQQYLDVLPGSPELEQCRYHAPVGSFAAYYALDARGFNVETCLAGFVAVAKHHGTLPDVATYVFERSHRRENVSAGNQNASEKQQTAIAMQLEDIDDHVPELANEIFQKATAEKGSWESFYEGFLGLLNEIESTVATTGTGVGINRESLSDSCYALVLECWGSLVLADKTSAASNAHSTGPSSDTYKAKQPTFQKLDEYVRKLERDTSADPDGTRGERLNHYRSRARTAVLENAETFADDGGGVATLTLPTGMGKTLSGLSAALSVRDQLGGNRIVYALPFTSIIDQVVDEIEEVYETDTAGRLLTAHHHLSETTIRDENNDGSDADAADLNDDVSGMLAEGWRAGLTVTTFVQLFESLAGPSNRQSMKLPALRNSVIVLDEPQSLPLDWWKLAPRLVAMLTERYDATVIAMTATQPQLFDDAVELVDDPDVYFEATERVHYHLDPSTERYIDTQAGPKSYEEATFELLDTFEANDSALAVCNTIDSARKLTDNVVDRFPGLTNVGEVYEAELESVDDVDGIDPTAIANQVVATGDRSLLHLSTRIRPIDRLLLIETAKELTERGHALVTVSTQLVEAGVDISFDRVYRDLAPIDSIVQAAGRCNRSFERERGDVTVWWLDAPDEQEKTPAEAVYNQGTTLLPVAAETLESIRVGDDLLKETSVARTAVEKYYQKLHHEKNVGKREYAIYVDEARGDELARLSLIDQRHAIDIIVCRTTQEREKVEDIARAVDRYDFSSANSLLDDMQTKQISVPIYQSDSKEARELADLPPVHSETDVRYVDPSKPQFENFFDPVTGFVVPDSTVERRFL

SEQ ID NO: 12778 - protein, 688 aa, Natrinema versiforme JCM 10478
MSKQVQQVETIFCHQTGDDYLVVVERDGKRLFRAKLGLSETSAGPRPAKFRLKQGSSEEPRQPDEFVELARRATRLRISEQTSAEGRRELREMFAGYQLEDKAKTVRTCRYCASAGRYSPITTETAVKDDTDWICRDCARQELERQLSFSGGGAVSGAAKDRLEDLMMEVQDLERIVNLLKGQLDPDLTKFDTISATTDEVDPVRTDSLSLHPGLQNLLEDRFDTLLPVQSLSVEHGLFDGNDQLVVSATATGKTLVGELAGINRVLNNKGTMLFLVPLVALANQKYEDFQDEYGHLVDVSIRVGASRVADEGERFDPNADVIVGTYEGIDHALRTGKDMGDIGTVVIDEVHTLKEDDRGHRLDGLISRLKYTCEQRAKHRNDYGGAQWVYLSATVGNPKQLTEALEATLIEFEERPVPIERHVTFADGQEKVRVENKLVRREFDSESSKGYRGQTIIFTNSRRRCHEISRKLDYSAAPYHAGLDYKRRKEVERKFGEQELSAVVTTAALAAGVDFPASQVIFDSLAMGIEWLSVQEFHQMLGRAGRPDYHDKGTVYVLVEPDTAYHNSMEMTEDEVAFKLLKGEMESVMTHYDEAAAVEETLANVTVGGKAAKALNDRMLGEVPTKHAIGKLLEYDFIDGFEPTPLGQVVTEHFLEPGQAFMILDAIRKDAHPYELVADLELRDTDL

SEQ ID NO: 12779 - protein, 688 aa, Natronobacterium gregoryi SP2; identical to SEQ ID NO: 11945

SEQ ID NO: 12780 - protein, 860 aa, Natronobacterium gregoryi SP2
MLLRDHLEDVAQRVGYVVPDDARTPNDDPLRDIVETLAYVHDFGKATTYFQEYLLKGVDPDDSYCRYHAPIGSFAAYYALEAKGYDDETCLAGFVAVAKHHGRLPDIAEYVYERTHRREKIATEQDAEKQQTAVAKQISDINDHVLEFAGNVFDAATDGDGSWEEFCHRFAGNLLEDIKATVATEGYSEGIDRESLSNSCYALVLECWGSLVFADKTSAAAAATDTEPSAATYEAVRPTADSLDDHVRSLEEQASADPDGTRAERLNHYRSEARTDVLESAASFADDGGGVATLTLPTGMGKTLSGLSAAMEIRDRRDGDRVVYALPFTSIIDQVVDELEDIYEVDTTGRLLTAHHHLSETTIRDEDAEDNDDAQADDADRNDDVAGMLGESWRAGLTVTTFVQLFESLAGPSNKQSMKLPALRNSVVVLDEPQSLPLDWWKLVPRLVELLTEQYDATVIAMTATQPQLFEDATELVDDPETYFDATERVTYELDPSAERYLDDQTEPKGYDDAAATLLESTADDESALAVCNTIDSARTLTERVTDRLPESTDVAEVYAEKLEHAGDVEDVDPKCVAERVADAGGRSVLHLSTRLRPCDRLRLIETAKALTQRDQQLLTISTQLVEAGVDISFDRVYRDLAPIDSIVQAAGRCNRSFERDRGRVVVWWLETPAEQEKTPAEAVYNRGTKLLPTTAKTLDAVRSGATISETTVARNAVTRYYDRLHDEKDVGADAYPTYVDEANGRKLAELSLIDKRLAIDVIVCRTAADRRKVNEIRDALNRYDFDAVDSLMRELRPKQISVPVYRSDSKEAQKLAELDTVHGESDIRWVDTTKPHYNGFFDEMTGFVVPDNTAERRLL

SEQ ID NO: 12781 - protein, 688 aa, Natrinema altunense JCM 12890
MSKQVQQVETIFCHETGDDYLVVVERDGKRLFRAKLGLSETSAGPRPAKFRLKEGSSEEPRQPDEFVELARRAKRLRISEQTSAEGRRDLREMFAGYQLEDKVKTVRTCRYCAGAGRYSPITTETAVKDDTDWICRDCARQELERQLSFSGGGEVTGAAKERLEDLMMEVQDLERIVNLLTGQLDPDLTKFDTISATTDEVDPVRTDSLSLHPGLQDLLEDRFDTLLPVQSLSVEHGLFDGDDQLVVSATATGKTLVGELAGINRVLNGKGTMLFLVPLVALANQKYEDFQDEYGHLVDVSIRVGASRVADEGERFDPNADVIVGTYEGIDHALRTGKEMGDIGTVVIDEVHTLKEEDRGHRLDGLISRLKYTCEQRAKRRDDYGGAQWVYLSATVGNPEQLTEALEATLIEFEERPVPIERHVTFADGQEKVRVENKLVRREFDSESSKGYRGQTIIFTNSRRRCHEISRKLDYSAAPYHAGLDYKRRKEVERKFGDQDLAAVVTTAALAAGVDFPASQVIFDSLAMGIEWLSVQEFHQMLGRAGRPDYHDKGKVYVLVEPETVYHNSMEMTEDEVAFKLLKGEMESVMTHYDEAAAVEETLANITVGGKAAKALNDRMLGEIPTKHAVGKLLEYDFIDGFEPTPLGRVVTEHFLEPGQAFMLIDGIRKDAHPYELVADLELRETEL

SEQ ID NO: 12782 - protein, 906 aa, Natrialba chahannaoensis JCM 10990
MSILRRSTTEPSFSSEMSTRYSHPPDGDQDPANGANGGVLLIDHLEDVAKRTGFVVPDDAQTPDGESLQDVVETLAYVHDFGKATTFFQDYLIESIEPDRKMYRYHAPLGSFAAFYALEAKGYDAETCLAGFVAVAKHHGSVPDVASYVFDRSHRRENVSEQTQTEQSQTAIRLQIKDILDHAPDLASEVFEAATDGHGSWSEFCERYAGNLLEDIESTVTTTETGTFDYESLSESCYALVLECWGSLVLADKTSAAQAGSSDDVSEATYAADSPSLSQLDEHVAEIEAGVTADPNGTRSEQLNHYRSRARRRVLENAASFADNGGGVATLTLPTGMGKTLSGLSAAMEIRDRTGGDRIVYALPFTSIIDQVVDEIEEIYDADTAGRLLTAHHHLSETTIRDEEHPGEDSDQEADDADQNDDVSGMLAESWRAGLTVTTFVQLFESLAGPANTQSMKLPALRDSVVILDEPQSLPLNWWKLVPRLVALLTERYDATVIAMTATQPQLFDETTPFVEDATELVDDPDVYFETTERVTYELDSSTERYIDKQTGPKSYEDAAAELLEAITDGESALAICNTIDSAQTLTERVTGGRSELADVGEAYAAELERCGSVDDVDPEVLANRIMDSGENSILHLSTRLRPIDRLTLIETAKILTEHGHPLVTISTQLVEAGVDISFDRVYRDLAPIDSIVQAAGRCNRSFERDRGIVTVWWLDVPEEQQKTPAEAVYNRGPSLLPVAAETLAEVRADDSPLPETAVARTAVKRYYNRLHQEKNVGKDAYPTYVDDARGDELEALSLIEQRHAIDVVISRTDEDRELIEEVEAAIDRYDFETVNSLMDELRTRQISVPIYQSGSEEERKLANLPTVHRETDIRLLDTSNSQVRNFFDPVTGFVVPDNTVERRFL

SEQ ID NO: 12783 - protein, 986 aa, Natrialba chahannaoensis JCM 10990
MGYFSDHADQIDFQQFGSEGIKGVRSCQAGGFWGVKSHFTAYEDEPALVSMPTGSGKTALMMLLAFGLSEKQVLIVTASDVLRTQTAAKFEQLDGLRQANVVDDKLEAPSVTTVTSRITDEETWNELDEDVVVTLPHNISKVYDSDQYPNSIVSPPEEKFDLVFFDEAHHIRAPSWMELLESVNSAKRVLLTATPFRRDRQTLPGRMVYHYPLSNAMEERLYQPLSLTEVSTHRADDPDSKLAAEAATKLADIRTDYSSAKLLIRCDQINTARDLEKVYSNHDLEVEAIHSDRTSKQNAETISALREGNLDGVIAVGMLGEGVDITDLKVAVLHQPPKSFAFTLQLIGRVTRPTENSDIAATVIADPDKLREVGVDDVVKRLYHEDAGWRQLIPELVDKYIETNVAATTAGQDMLRGVNEQDLQPYRSTRLYKSTESDIDLGADVSLDNDTIVYKLPRSDDVFLGLITEQVDKPTWGTRTPLVYRQYDLHLYYYHGETKTLFEASSSDTLASHIRSQIVSDEIELYGGESLVRMLQAEVDIEYQVAGLANALGPSGSLPSYKMYLGDRVEGAVRQTDAQAFAQGHAVAEVDGEIIGISNDQGRVWSTGREGIGDFISWCRGLAGKLERYEFESAAPKLGLGEISRIDEFPAKPVYGTHNPAIQQLNVEIDTSEVHEEGGWQPMKKSVLEDINYRADEPTAVEFSYLPEETAQSLSGTYNIKDNKLIGQLANCQFRVDGGDKISELTGDVFFNRYPLYFCTGDGTLVYNGRGHKVKQELSEVPSTCFVDESKIDWSECATWREYSIDDDSDPEELIHVHAWVEDFIEANGESEQVLFRDHSSGEIADYVQFEPSQKHISLYHCKACKKGNKSGARLEDVRDVVDQVFRSIAWIKNSGLPKRIRYRQENTGVEGFKLNEEGFDEIETRFQPNEWSFRVYIVQPGLDHEKARLRNNINTLLLTCKEWLEAVDTELRIIGDPNDQVVEVS

SEQ ID NO: 12784 - protein, 924 aa, Halorubrum californiensis DSM 19288
  misc_feature (864)..(864): Xaa can be any naturally occurring amino acid
MVDFTDRPSHIGPDGEQIPLEEHLDDVRERVGWLVPDDAKTPEGNSLSELAEVVTRVHDFGKLTAWFRDHLLSDDAQPAGPKHHAPISALLAHYALEARGFDGADQLVGFLAVARHHGRLPDTADYVHRASVEQSGRIQTLYRSDALEQAAHIDETVPELAEALVDRATGGAGDWETFHERLADSDAAIELPWVAEAVCSGRRLRPAPEKLPPSFYESVLQVWSALVFADKASAAYLSTGIEIGRKAYRSPTPGRLEIDAYIDELQTENAETELDPRTEQMNERREDARQEVHARAKEFVDDDRNVATLTLPTGMGKTLTGLDAALTVLEGSEMASNPNEGRLVYALPYTSIIDQVAEQSRELFGTGERGERLTVDHHLADTLVSPPDEPESVADDAVENVGALLGESWRSGMVVTTFVQVFESLAGPTNARSMKLPSLYGSVVVLDEPQALPLEWWPLVDRLVELLTDEYGASVIAMTATQPELLSAGDREPFSLVSDPDPYYAELDRLDFVLHPSAVAMLPGENETGSETSDDAESAALPYDRAGELVANRADNGDSVLAICNTIDSARELAESVDDRTEPLDVNEVYDELLTDADRSTESIRPERTLADAVRRRRSGQPLLVHLTTRHRPCDRRHLIDVASDLAEAGEPVLFVSTQLVEAGVDVSFDEVIRDFAPMDSLVQAAGRCNRSYGRNRGRVTVWQLAPPPNRETTPASAVYGRGESLTKLTGQALATVYDGDPMPEPDVTRNAVEHYFDLLDGRDVGADEYVEYLERAEAEQLGRLSLIDERPAVDVIVTRTADERETVEEIRRAFDEYRWDDLDDLVESTGDWQVSVPVYPGDDDTIEKLAACEPLFPDTDRLXVSVPVYPGDDDTIEKLAACEPLFPDTDRLVLDGRPGRHNGYFDATDGVVIPDTSVEARLL

SEQ ID NO: 12785 - protein, 881 aa, Haloferax sp. ATCC BAA-646
MTERYSHPPNDVHDGVPLVDHLEDVAGRVGYIVPGDAKTPADEPLRAVVETLAYVHDFGKATTYFQDYLLRSSEPRYEQYRYHAPLGSFAAYYALSAQNFDSETCLAGFVAVAKHHGRLPDVAAYVFSRANRRENVSRGNQNAAEMQQVAIAKQLKDIDEHVPELAREVFQSATVGEGSWSSFRSSFRELLTEVRKSTGSSATTINRETLSERCYGLVLECWGSLVLADKTSAAAAASGSDASAGTYDAEKPTFERLDEYIESIERTADSDQHGNRGERLNFLRGKARASVLSNVESFADADGGVGTVTLPTGMGKTLTGLTAALSVRDRLGQKRVIYALPFTSIIDQVVAEVEKIYQVDTTGRLLTAHHHLSEATIVDESDESADEADANDDIAGMLAESWRAGMTVTTFVQLFESLAGPANRQSMKLPALRNSVVVLDEPQSLPLDWWKLVPRLVRMLTEQYGATVIAMTATQPQLFDDATELVSAPETYFEATERVRYELDDSATRYIDSREEPKSYAEAASEIVDGSAGANGTRSDEAGETESVLAICNTIDSAQALTTHVTEALSDAMSVGSVYADVLESTDRDSTGIEVATVAERVADAGGRPVLHLSTRLRPVDRLRLIETAKLLTERGCSLVVVSTQLVEAGVDISFDRVCRDLAPIDNIVQAAGRCNRSFERDRGRVVIWWLEAPDEQTKTPSEAVYNRGTALLPVATETLDDIGGGEGTIPEAEVSKTAVEEYYRRLHDEKNVGKDAYVEYVNHARADDLAELSLIEKRRSVEVVVCRTATERKRVEAARAAWRDYEFERVRQLIDSLKEATVSIPIYRSDSEEAQALSGLARIHEDTETRWIDTRDSRHDSYFDSTTGLVAESSVDNRIL

SEQ ID NO: 12786 - protein, 881 aa, Haloferax sp. ATCC BAA-645; identical to SEQ ID NO: 12785

SEQ ID NO: 12787 - protein, 822 aa, Haloferax prahovense DSM 18310
MRDLGTLDDSLVVAIAGLHDIGKLTTWFQQYIRDEIPPGNKTHHSHIGGAVVNYALSALDADLDDQLAGTVAVLKHHGALPDMQGGAGGFAQQFGDPHGGNAETYDAIDRKLDNIDSNPDARAVAESLINRATAGEGSWAECKEQINAREELPKLAKHASHVVSYVNDNEGDFYAHLVDTWTTLTLADTTSAAHIDLEDLSCGTLNPDAVQRHIRGFDAATDAREAELNEIRDTAREIALRRVGSFLDAKTQVANITLPTGFGKTLTSTQVGLTLADRKATRTGQPSRVVYALPFTSIIDQTADELASVFPDAGALDLAVHHYLADVSPDEESFETDALAERDRMLIRDSWRQQFTLTTFVQLFESLAGPRKSQGLKLPSLRNAVVILDEPQALPPEWMNLVSRLCRVLTDRYNVHVISMTATQPKLFELFEHTLDPFTLVEADDSAFSTSSPMSFIDSHPRVRYTIHPSADSTTTDSPLSPENAAATVMEGIESPTLAICNTVSSSRALATHASEYVSAETLNEHFAEWVVEHDESEFDVDGFVASLDTDRPLVAHLTTRHRPFDRLQLISVAKRLCKMNAPLLFVSTQLIEAGVDVSFDRLYRDFAPVPSIVQAAGRCNRSFGAERRDVCIWKLESAKDGQPPSEVIYSTLAFGDPLAGTETALDEYREGIHVAETAMISDVVDRYYSAYHTSSGTTTTSLPSLVDEAKCSTLGAKHIINQQSSIDVLVPRSGTEVEKITQLATQSDVNKQAVYEARGMQSITVSIPAYPSNQDELNRLRTRLLPVDEDIGLYVIPELSTYDAFLGLRAPDSTVDSRVIG

SEQ ID NO: 12788 - protein, 880 aa, Haloferax lucentense DSM 14919
MTDRYSHPPNDVHDGVPLVDHLEDVAERVGYIVPGDAKTPADEPLRAVVETLAYVHDFGKATTYFQDYLLRSSEPRYEQYRYHAPLGSFAAYYALSAQNFDSETCLAGFVAVAKHHGRLPDVAAYVFSRANRRENVSRGNQNAAEMQQVAMAKQLKDIDEHVPELAREVFQSATVGEGSWSSFRSSFKELLTEVRKSTGSSATTINRETLSERCYGLVLECWGSLVLADKTSAAAAASGSDASAGTYDAEKPTFERLDEYIESIERTADSDRHGNRGERLNFLRGKARASVLSNVESFADADGGVGTVTLPTGMGKTLTGLSAALSVRDRLGQKRVIYALPFTSIIDQVVAEVEGIYQVDTTGRLLTAHHHLSEATIVDESDESADEADANDDIAGMLAESWRAGMTVTTFVQLLESLAGPANRQSMKLPALRDSVVVLDEPQSLPLDWWKLVPRLVRMLTEQYNATVIAMTATQPQLFDDATELVSEPETYFEATERVQYELDDSTTRYIESREEPKSYTEAASAIVDETAEANGTNSDEAGETESVLAICNTIDSAQALTAHVTESLSDAISVGSVYADVLESTDRDSTTEVTTVAERVADAGGQPVLHLSTRLRPVDRLRLIETAKLLTERSCSLVVVSTQLVEAGVDISFDRVYRDLAPIDSIVQAAGRCNRSFERDRGRVVVWWLEAPDEQTKTPSEAVYNRGTALLPVATETLDDIGGGEGTIPEAAVSKTAVEEYYRRLHDEKNVGKDAYVEYVNEARADELGELSLIEQRRSVEIVVCRTATERKRVEAARVAWRDYEFERVRQLMDSLKEATVSIPIYRSDSEEAQALSGLARIHEDTETRWIDTRDVRHDSYFDSTTGLVAESSVDNRIL

SEQ ID NO: 12789 - protein, 881 aa, Haloferax sp. ATCC BAA-644; identical to SEQ ID NO: 12785

SEQ ID NO: 12790 - protein, 862 aa, Haloferax elongans ATCC BAA-1513
MTSEYERRYSHPPENGRPGVFLFDHLRDVRDRVDMILPAGATTPDDESVRGVVRRLALVHDIGKATTYFQQYIGEYPGNPKHDALRYHAPLGSFAAYYVLRETGHSTATCLAGFIAVAKHHGRLPNAITYLFSRVSSPDPEPRRRIKHQVVDIHQHAPTLATAVFETATGDDSVWKSFAMACANDESLFDEIASHVTLNGERPITDPDFLTHEFYGLMLECWGALVLADKTSAAGAPRKRSVYSAAPPSTETLTQYIDDLSGTTTTPGGTRTERLNHFRSRARRDVLNSIPDFVSGDSRVATITLPTGMGKTLTGLNAAFKIRDRTDGARIVYALPFTSIIDQVGAEVQTIFETDGTDGMLALHHHLSETRFENTDDDAADLNDDIAGLLGEGWRAGLTITTFVQLFESLAGPRNTQSMKIPALRNSVVVLDEPQSLPLDWWKLVPRLVEVLTDQYGATVISMTATQPELFPNAEPLVSETEQYFSVAERVQYRLHDSIDRFLQGEDQPLGYDAAATEIVEVAAAGESLLAICNTIDSARALTAAVTERLAAVSLAEQYFEVLHGGASDPVTQTVERVRQSTKRAFVHLSTRLRPTDRLALIQTVKRLRDAGVQVIAVTTQLVEAGVDVSFENVYRDLAPVDSIVQAAGRCNRSFEQERGNVTIWWLAQPAEQTHTPAVAVYDNNGPSLTPVTAAALNSVRGDKTKLDGKAVARTAVNEYYRRLQHDKNVGKEQYRKYVESADAESLGRLSLITQTNTVDVLIAVTQSDQDLVSALEEAYDNYDFETVKRLLNATKPLRVSVPIYRDDSPEAKTVTNLRPLAGHDKERSLRVLSAESHTFERYFDHTTGFVVPDTTIEDRFL

SEQ ID NO: 12791 - protein, 880 aa, Haloferax alexandrinus JCM 10717; identical to SEQ ID NO: 12788

SEQ ID NO: 12792 - protein, 845 aa, Haloferax mucosum ATCC BAA-1512
MLLFAHLKDVRDRIDMVVPEDTKTPDGMLLSGVIQRLALVHDVGKATTFFQQYIGESPGKPRYEKLRYHAPLGSLAAYYVLDETGHSTATCLAGFVAVAKHHGRLPNVVEYLFNRTARPDPEKWDPVKAQISDIHEHAPKLVTAIFQEATGDADAWQNFAKACVNDESLFTEIADHITTNGERPITDPSFLTDEFYGLLLECWGTLVLADKTSAAGAPQSSTVYDGTTPKTTTLAEYIDEIEDPNANPDGSQTERLNYFRSRARKDVLDSVSVFIESESNVATITLPTGMGKTLTGLNAALEIRDRTDRDRIVYALPFTSIIDQVGAEVQDIFDTDGTDGLLALHHHLSDTRFGYRDSDDDVSDLNDDIAGMLGESWRAGIMVTTFVQLFESLAGPRNTQSMKIPALRESVVVLDEPQSLPLDWWKLVPRLVAVLTEQYDATVISMTATQPELFSDSVSLVSDPEQYFSAAERVRYHLHDSVERFLQGDEQALEYDVAAAEIADVAASGESLLAICNTIDSARKLAEAVTDRIQSVSVAEQYFASLKSGSADPVEDTVRQIIQSPKQAFVHLSTRLRPTDRLALIRIIKKLRSAGYAVTAVTTQLVEAGVDISFENVYRDLAPVDSIVQAAGRCNRSFEHERGDVTVWWLAQPAAQTHTPAVAVYDLQGPSLTPVTAKALDSVRQGQTTLPGKSVARTAVQNYYDRLHTEKNVGKEAYSAYVDTADAESLGRLSLITQTKTVDVLICVTEADHELVSSLETAYEKYEFEEVKRLLTATKPLRVSIPIYRDDSPEADAVTSLRPLADREEESQIRVLSAETRAFENYFDRSTGFVVTDRTVEDRFL

SEQ ID NO: 12793 - protein, 864 aa, Haloferax mediterranei ATCC 33500; identical to SEQ ID NO: 11908

SEQ ID NO: 12794 - protein, 881 aa, Haloferax denitrificans ATCC 35960
MTERYSHPPNDVHDGVPLVDHLGDVAERVGYVVPADAKTPAGEPLRAVVETLAYVHDFGKATTYFQDYLLRSVEPRYEQYRYHAPLGSFAAYYALSAQNFDPETCLAGFVAVAKHHGRLPDVAAYVFSRANRRENVSRGNQSTAEMQQVAIAKQLKDIDEHAPELAREVFQSATDGEGSWSSFRGSFRELLTEVKKSTGSSATAITRETLSERCYGLVLECWGSLVLADKTSAAAAASGSNASAGTYDAEKPTFERLEEYIESIERTADADRDGNRSERLNFHRAKARASVLSNVESFADADGGVATVTLPTGMGKTLTGLSAALSVRDQLGGGRVVYALPFTSIIDQVVAEVEEIYQVDTTGRLLTAHHHLSEATIVDESDESADEADANDDVAGMLAESWRAGMTVTTFVQLFESLAGPANRQSMKLPALRDSIIVLDEPQSLPLDWWKLVPRLVRMLTEQYNATVIAMTATQPQLFDDATELVSAPETYFEATERVQYELDDSTTRYIDSREEPKSYAEAASAIVDETTDANGTNSDEAGETESVLAICNTIDSAQALTTHVTETLSDAISVGSVYADVLENADRNSTDIEVATVAKRVADAGGRPVLHLSTRLRPVDRLRLIETAKLLTERGCSLVVVSTQLVEAGVDISFDRVYRDLAPIDSIVQAAGRCNRSFERDRGHVVVWWLEAPDEQTKTPSEAVYNRGTALLPVATETLDDIGGTEGTIPEATVSKTAVEEYYRRLHDEKNIGKDAYVEYVNEARADELGELSLIEQRRSVEVVVCRTTEERERVEAVRAAWQDYEFETVRRLMDSLKEASVSVPIYRGDSKEAKALSGLTRIYEDTETRWIDTRDARHGSYFDSTTGLAAESSVDNRIL

SEQ ID NO: 12795 - protein, 470 aa, Haloarcula vallismortis ATCC 29715
MRLEFDDGTLVLHDAPETVPHAEWDDRVSEYRAQAYRYQAILDWAGHWTDGGGQATLQDGFTHDVEDAARAYPDLALTPALQIEPRDYQQAALDAWRTHDRQGSVILPTGSGKTFLGLQAIADAGVSALVVTPTIDLMNQWHATLTNAFGAQLTDDVGVLGGGSHDIGAITVTTYDSAYRYIDEYGDQFGLLITDETHHLAAETYLQIPEMTIAPYRLGLTATYERADGREELLKDRMGPVVYQEAVDNLAGEFLSEYETIQMSVELTSEERTEYDDEYQIYRDYVDSHDFDLWKEQGYAEFLKRTSYDPQGRRALVAKQRAERIARTAEKKLDTLDNLLKRHHDDRVIVFTANNDFAYDISREYILPCITHQTDTDERTEILERFRSGEYSMLATSQVLDEGIDVPAANVGIILSGSASKRQYAQRLGRILRPTDDRQPARLYEIITTDTMETYVSQRRRDGVSSSADS

SEQ ID NO: 12796 - protein, 935 aa, Haloarcula sinaiiensis ATCC 33800
MDLPLISHPDVDENDAYPSSQLTDDGALRLDAHNRTVGDRAVRLFGPDDDRTQYLRIAASLHDFGKVTPQFQAHVRPTENYDGPEDEKVHARLGALATWYVLEETDAPPRDQLAATLAVARHHQALPNAAQYTGETLARAVEASADVLQAQINRIDETWPEAADDLFRCTGSDGSSWAEFAEWARSGAATAALQDCSVRETLSGVEPTPSRLPDFLYDRTIHYWAALTLADKSHAMGLSEERVFDFDTLDLETLERHINTLRQQEASSLHEAQLNDERERARRQALRGTHEWLNQEQTDIATLTLPTGLGKTFTGLSAAFEARDILDETDTEHPDNPRPVIYALPYTSIIEQTRALFEDPELWGADPKKSALTVHHYLSETVVYGDEYDAADVDESDAGEAAQFLGETWRDGTILTTFVQLFESLTGPSNRQGLKLPSLDSALIILDEPQALPKDWWDGIERLLQLLTGEYGAKVIAMTATQPSLFREMGTSSLLELGAAHAQTDCSHCRRQPAYETELPPISQESYFNEADRVRYTIDESALSHRLETEEEFVEYDSAASRIHETAAQADSVLAICNTIESSRQLTQAVSQHSDAVHLGPVLESILTAPDANVAESEMNPGEIVSEVLETVGIEDQCSDEPTARNQEVPSPQGPFVLTLNSRYRPFDRQVIIQLAEQLSTGPVPFILISTQAIEAGVDISFEMVYRDIAPLDSIVQAAGRCNRAYEWGKNGGQVTIWTLAPTGPDAANPPAYWVYERGSTDAGMPDHLRLISDVLNKVPGQRDIADIHLSKHAVDRYFEQLSRRSLDDGSIRDHIDHAEGRWLSQQSLIGGYETADVLVAVSESESQTLDRITQMFTDGNPRAYDRLDDLSHLRVSLPAKIIDENPKLTRIDGQGRKDDGVNVFRFNGTGGLTYTLEDGGLRATEESIQDRFTI

SEQ ID NO: 12797 - protein, 867 aa, Haloarcula californiae ATCC 33799
MTFEQYISHPAKTDDGEPTLLIGEGGQFDQDGHLQTVANRMVEACRGQTLADGTPAEPVAEVIGLTHDFAKLTHWAQKHLRCQPFQHSDEYRYHAFPGALVTLYCLLNRRDGTGPLKDDHAAEVATLVVAGHHDIQSPPEPSKLAKNYGRDTLEVQETYKRITEQFEDIGDRVPERADQIIHKATDGEGSWEDFREWHADRTAPIDGPHHHLIYFAQIGDRDTRDGYYSDVVRLWTALKFADQTDASGLKNEDIGGTLLDRSELTRHIEDLDKGENVLAELNDLRNKARQEVTENVETLVKSNDVGLITLPTGFGKTYAGISAGLRAANINDSRLVYALPYTSILDQTASEIQSVFGVSPYSRAFTLHHHLSNTYTGLGDHYTDADIGRSPGALHAESWLSGVTLTTTVQLFESLAAPTARQATRVPALHEAVVVIDEPQAIPEDWWQIIPELVELLVDSYNATVILMTATQPGLVKYGSNTLNTRELTDATDKYTDFLADHPRVRYRLHDTVRTDVGDEYATLDYATAGSRVSGAAEGGRDVLAVCNTRASAEELYRSVTATVNTKEKVPVELGHLLHDYVEETGELPSPVELRRFAIDAVAERDVATLYAFLSGDVRPDDRKLIIDTLYDDEIGDEDEPEPLLDSDWSVILVSTSVVEAGVDVSFDTVFRDYAPIPNIVQSGGRCNRSFDGETGDVVVWRLAEPENGSAIPSLVIHGADGGDQLPLLLATGNVLRRHAARDGTIDESTMVSDTVSEFYESLFEGPLNPGNERLADAISSASMSELEGEHMIDEIEDYEDVVACLTDEERDDLLSSDPEAVSIRGHPGAQVSTDLEAWTKKVTIGNSQYLLVDALSGSYHPVFGVR

SEQ ID NO: 12798 - protein, 876 aa, Haloarcula argentinensis DSM 12282
MAVYSHPPEDGYEGVNLRDHLDDVARRASEIVPGEATTPDGESLQQVVETLAYVHDFGKATTFFQKYLRHGTEPEHKPCRYHAPIGSFAAYYALDAQGFETETCLAGFVAVAKHHGQLPDVTQYIYKRAYTSENSTGGAETNNEQLQAAIAMQLNDIEEHVPELAADIFDDATDSDGSWDGFRHSYKELLGEIAAAVATESGTTISRESLSESCYGLSLEIWGSLVLADKTSAASRSEETDSDSTYEAKQPSLQVLDEYVAELEASSPANPDGSRTERLNHYRSRARSAVVENAKQFAEAGGGVATLTLPTGMGKTLSGMSAAQTVRDELGSERVVYALPFTSIIDQVVDEIKDIYGTDTLGRLLTAHHHLSETTIVDEDDVDADDADMNDDVAGMLAESWRAGLTVTTFVQLFESLAGPANKQSIKIPALRDSVVILDEPQSLPLDWWKLVPRLVAILTEQYGATVIAMTATQPQLFNEATERGGDVTELVDDPDVYFSATERVKYELDASTERYIETQEVPKSYADAGPELLTTVDSGESTLAVCNTIDSARALFDELIDNGDSLLSVGDIYADELSTVKTTADINPKTLASRIEGRSDRSILHLSTRLRPVDRLKLIETAKRLTDDGHSLITISTQLIEAGVDISFDRVYRDLAPIDSIVQAAGRCNRSFEREQGRVVVWWLDVPDEQQKTPAEAVYNQGATLLPVAAETLDAVREEDTLLSETSVARTAVTEYYKTLHTDKNVGKQEYAGYVDDVRGDKLGELSLIDQRNAVDIIICRTEAERERVEQVREAWSQYEFDRVHRLMDGLKEARVSIPVYYGESDKKEKLSQLNRVHSDTDVRWLDVRKHGLGEYFDQNTGFVIPDSTAERRIL

SEQ ID NO: 12799 - protein, 693 aa, Halobiforma nitratireducens JCM 10879
MLLRDHLEDVAQRVGYVVPDDARTANDDPIRDIVETLAYVHDFGKATTYFQEYLLNGVDPDDSYCRYHAPLGAFAAYYALEAKGYDAETCLAGFVAVAKHHGRLPDVAEYVYERTHRRESIATEQDAEKQQTAVAKQINDINDHVLEFAGNVFDAATDGDGSWEEFCHRFAGNLLEDIKATVATEGHSEGIDRESLSDSCYALVLEFWSSLVLADKTSAAAAATDTEPSAATYEGVQPTADSLDDHVRSLEEQASADPDGTRAERLNHYRSEARTDVLENAASFADDGGGVATLTLPTGMGKTLSGLSAAMEIRDRRDGDRVVYALPFTSIIDQVVDELEDIYEVDTTGRLLTAHHHLSETTIRDEDAEDNDDAQADDADRNDDVAGMLGESWRAGLTVTTFVQLFESLAGPSNKQSMKLPALRNSVVVLDEPQSLPLDWWKLVPRLVALLTERYGATVIAMTATQPQLFDDATELVDDPETYFDATERVTYELDPSAERYLDDQTGPKGYDDAAATLLESAVDDESVLAVCNTIDSARTITDRVTDRLPESTDVAEVYAEELEHAGDVEDVDPRCVAERVADAGDRSVLHLSTRLRPCDRLRLIETAKALTQRDQKLLTISTQLVEAGVDISFDRVYRDLAPIDSIVQAAGRCNRSFERDRGRVVVWWLETPAEQEKTPAEAVYNRGTKLLP

SEQ ID NO: 12800 - protein, 650 aa, Halococcus thailandensis JCM 13552
MGKGTPREGYYADVIRLWTALKFADQTAASGLKQDDLNGTLPDRIDLDNHINDLDGGEGILADLNQLRDQARQDVTKNVEALVESDDVGLITLPTGFGKTYAGLSAGLRAANINDSRLVYVLPYTSILDQTAREIQSVFGTSPYSRSFTLHHHLSNTYTGLGDRYTDAEIGRSPGALHAESWLSGLTLTTTVQLFESLTAPTARQATRIPSLQEAVVVIDEPQAIPEDWWQIVPLLVNLLVSIYDATVILMTATQPGLVKYGSNDLETQELTDDTDQYTDFLAEHPRVTYRLHDTVQENSGDKYGVLDYPTAGSQISDTVQDGNDVLAVCNTRASAEELYQYVYQTARADENASVELGQLLHDYVSKAGELPNPVQLRRFALDAVAEKDTASIYAYLSGDVRPNDRSLIIDTLYNEDVGDSDDPNPLLDRDESVVLISTSVVEAGVDISFDTVFRDYAPIPNIVQSGGRCNRSFGGETGNVIVWRLDDPNDGNNIPSLVIHGGDGGDALPLLRETGNVLRRHATEDGSIDESTMVSDTVVDFYESLFEGPLDPGDEQLAAAVESASMSELAGEHMIDDIESYDDVVACLTDEEHRNLLTYDLSARDIGEHPGAQVNTDPDTWEDEVSVGNSRYLLLDARSASYDPVFGVR

SEQ ID NO: 12801 - protein, 894 aa, Halorubrum kocurii JCM 14978
MVDFTDRPSHIGPDGEQIPLEEHLDDVRERVGWLVPDDAETPEGNSLSELAEVVTRVHDFGKLTAWFREHLLSDDAQPAGPKHHAPISALLAHYALEARGFDGADQLVGFLAVARHHGRLPDTADYVHRASVEQSGRIQTLYRSDALEQAAHIDETVPELAEALVDRATGGAGDWGTFHERLADSDAAIELPWVAETVCSGRRLRPAPEKLPPSFYESVLQVWSALVFADKASATYLSTGIEIGRKAYRSPTPGRLEIDAYIDELQTENAETELDPRTEQMNERREDARQEVHARAKEFVDDDRNVATLTLPTGMGKTLTGLDAALTVLEGSDMASNPNEGRLVYALPYTSIIDQVAEQSRELFGTGERGERLTVDHHLADTLVSPPDEPESVADDAVENVAALLGESWRSGMVVTTFVQLFESLAGPTNARSMKLPSLYGSVVVLDEPQALPLEWWPLVDRLVELLTDEYGASVIAMTATQPELLSAGDREPFSLVADPDPYYDELDRLDFVLHSSAVAMLPGQNETESETNHGAESAALPYDRAGELVANRADDGKSVLAICNTIDSARELAESVDDSTAPLNVNEVYDELLDDADESTESIPPKRTRADVVRRRRPGQPLLVHLTTRHRPCDRRHLIDVASDLAQAGEPVLFVSTQLVEAGVDVSFDEVIRDFAPMDSLVQAAGRCNRSYDRNRGRVTVWQLAPPPNRETTPASAVYGRGESLTKLTGQALATVYDGEPMPEPDVTRSAVEHYFDLLEGRGVGTDEYVEFLERAEAEQLGRLSLIDERPAVDVVVTRTADERETVEEIRRAFGEYRWDDLDDLVESTGDWQVSVPVYPGDDDTMEKLAVCEPLFPDTDRLVLDGRPGRHDGYFDATDGVVIPDTSVEARLL

SEQ ID NO: 12802 - protein, 767 aa, Rhodopirellula europaea 6C
MPHYAHSLPNEPDRSRWETMCKHEERVASRCSEFLTRIAPELGPWGEILGRWHDLGKYRPEFQRKLAGEAVQIEHAGAGAALAAEKSPVHTIPIQFAIAGHHTGLANHTTNETQNTKRRPIKRSPLRERLIGNREVINDISSNVDRETIDLPIPDLTKWIRENSDRDSVHRQIDALTRILFSALVDADRLATQWFYKSSESEVSEETRTEFESLKVLRDRFDGYVDSLRAEKHSTRSAINELRDLVLDSCRKKASSTGGIFSLTVPTGGGKTFSAMSFALNHAIQNELDRVIIVIPYTSIIRQNANVYRKAFAKPNEGLDLCNIIEHHSAIDTQQAKENNPEAEKRREQAVENWDAPVIVTTSVQFFETLFSDHPSQCRKLHRIANSVVILDEIQTIPPQYVIPITDMIRELSSRYKTSIVLSTATPPALKEHLGEVREIVDDPIGLAKHPAARRVQTEWRIENPTTYEELANELKTNGHQQSLAIVHRRADAANLAKMLPRNHRMHLSAQMCPEHRIQAVDEILRRVKEGEPCLAVTTQLIEAGVDLDMPIVYRALAGADSLAQAAGRCDREGKRTVASGYPAGKLIVFRPETKPPGQTLQDAADASLTMWNLKALEGSEFDVFDPDHCREYFQHFYGTKMLDQHHLQRERASLNFANVAALFEMIEDGWSFPVVVPWPFNEDGSHGEGRRRSEAFRESPNRETSRALQPYIVQVPKHAASILVEQGVIEVMFGSIGIPTDLFNSSWYSDEFGLTYDEGEMSFLQC

SEQ ID NO: 12803 - protein, 488 aa, Gelatoporia subvermispora B
MTPSSWSIQRIRDLTQQKFGKRACRFQLNVARSLYEKQNDVVAIAATGSGKTLSFWIPLLMALEDKQDKMIFVVTPLNILGRQNVEILGAAGISAVAVDAQSATEETFADIEAGKHQVVVINPEMLMRSKGHCEKLWKNPGFTSRILYFVFDEGHCISEWSAFREQYKHVGSLRYLIPDSIPFYVASATLPTPVLSDVTDLLHLRPDQTDYILRSNDRPDIAIGVRKMRHSAESYRDLDFLIPDNFKDGDPPLPKFLVFFNNIREAEAATQHLRSRLPEHLRHKVKWFHSIMSDKYRNDEFEALKNSDTFGLCVTDSFGMGLDLSDIKIVIQWKVPSSLNTLWQRFGRAARGDGFQGFAILIAEKALWDSDIQKRAHRKAQAAAPKKRKRKNTSKKASKRRRLENQQAPHAGAVVLSEPASNDSSESSDDDNIANSDIPAATQPALNADIETKTVQPALLDVVNAESRGFKCRRTPITLFYSNDKCST

SEQ ID NO: 12804 - protein, 479 aa, Gelatoporia subvermispora B
RIRDLTQQKFGKRACRFQLNVARSLYEKQNDVVAIAATGSGKTLSFWIPLLMALEDKQDKMIFVVTPLNILGRQNVEILGAAGISAVAVDAQSAMEETFADIEAGKHQVVVINPEMLMRSKGYCEKLWKNPGFTSRILYFVFDEGHCISERSAFREQYKHVGSLCYLIPDSIQFYVASATLPTPVLSDVTDLLHLRPDRTDYILHSNDRPDIAIGVRKMRHSAESYRDLDFLIPDNFKDGDPPPPKFLVFFNNIREAEAATQHLRSRLPEHLRHKVKWFHSIMSDKYRNDKFEALKNSDTFGLCVTDSFGMGLDLSDIKIVIQWKVPSSLNTLWQRFGRAARGDRFQGFAILIAEKALWDSDIQKRAHRKAQAAAPKKRKRKNTSKKASKRRRLDNQQAPHAGAVVLSEPASNDSSESSDNDNIADSDIPAATQPALNADIETKTVQPALLDVVNAESRGFKCRRTPITLFYSNDKRST

SEQ ID NO: 12805 - protein, 762 aa, Mannheimia haemolytica serotype 6 str. H23; identical to SEQ ID NO: 11977

SEQ ID NO: 12806 - protein, 706 aa, Pseudocercospora fijiensis CIRAD86
MDLRRLLARGQKSNRSPSAKTATTTTPSSGQNASPQLFPSKGEGSVSTVLTTSKKRKRGKGEPPETVELNFFGNHSRNDARGTDSQAGAIGGKHVEKQEAHPPHLPSKKPAMISLDERKRILKEHKVKVTWLNAAPCSQKAPERGTPKKKDKSERAEKISIFPQPLCSFAELEAQYDISSRISANIEEQGYTMPTEVQLGAIPLLLEKPKNVLSSADRPLAAAHSSSLDLLTVAPTGSGKTLAFAITLLHSIQRLRRERPGDRRSSKGIILAPTKELAGQIVNEIRKLARNTGIKVTQVRKGMRLGSAMTTDSDGDSDEDEDHSEGREVSVKSDVLVSTPGILASIVSASDAKLPDVQYLVLDEADVLLDPLFREQTLGIWHALPHVELRVSLWSATMGSNIEELAISVIGERKAKLGIVQDDSPLIRLVVGLKDSAVPNVEHRLIYAASEQGKLMGLRQLLHPTTPSSEAGPPLLLPFLVFTQTIERAVALHSELLYDIPAEAGGISRIAVLHSDLSDSARDTVMTKFRKGEIWVLITTDLLSRGVDFRGVNGVVNYDIPTSSAAYVHRVGRTGRAGREGGVAVTLYTKEDVPYIKHVANAVAAAQKQKAEAGASQEGGVQQWLLDTLPSLTKKAKHDLRKYGVESRTARGASKDPKAARKAKISTKAGYVRREENKRKGAIQGSRNRSREAAPEDSDSDFGGFD

SEQ ID NO: 12807 - protein, 944 aa, Streptomyces gancidicus BKS 13-15
MPGEWGMLDESVWGKSRGLDPGLAPYPLIRHLLDAAAMALHLWDVFLSENQRVRIAEGLGLAGEPGRARAVVGLCAGLHDIGKISGFQFCSGHGSRYLSAELGGDRAGMSAERFGHDVAGLQSVREVLAGLGFAVDGELRAAQRLAEVVGGHHGRFHRAEDGIAASFLGGAAWARQRSAHAAAVYEALGAPGAPGVFKASAAVLVTGVVILADWLVSQEDYLRKRQRELEPVLADHFKRSQQDAPGLLAGAGLARVRLQRKGFAQAYGIQGEPNPLQRSVMEELRSAVGEGRRGGIFLVTAAPGDGKSETALEAERVLSEAFGTQGYAFLLPTMATSDQMHGRVATALSRQEGEDAGLTLVHSMAWLNSAYADEELEAQSVLTCEEVGEGSGRVETDLRPQRWLRGSKRPLLAQFAVGTIDQALMAVLPVRHNALRLLALSGKTFIVDEAHAYDPYMQVLLGRLLNWLGAYGVPVVLLSATLPASVSDRLIKEYLQGAGHKTRALSKQTFPAPYPGWLYVDGNSGRATQISPARRREQARARSMELGVVVEPVVHGSDGGARARLAVIERLLKPVSRAEGGTALVVCNTVGDAQDTYLRLRERFDERSHAQGGSVQLLHARFPGDVREARTREVTQGLGRTGPRPLRRIVVATQVVEQSLDLDADIVISDLAPLSLLLQRAGRCWRHENYWTRHGYPGGRGRPGWASGPQLVVLDPITGGGAVPRQWGEVYSEHLLATTSRTLAEFQGGTISIPDDVQHLVEAVHGNSEDFDWNNPGGSETKAWTAHKGKEMAERSMAGLLAVPRARSVSTLHDLHNLPGEEDEWEVSTRLGADSVRLLCAYVHNDGRVTLDVEGEHLLPQVALDGKMPVSLVREVMRRTMAVRADWLKEADFDSIAPPTSWTQHPMLADLRVLHQPVQGANAQSVKVGGKTLRLDADCGLVRR

SEQ ID NO: 12808 - protein, 745 aa, Leptospira interrogans serovar Pomona str. Fox 32256; identical to SEQ ID NO: 12647

SEQ ID NO: 12809 - protein, 762 aa, Leptospira interrogans serovar Lora str. TE 1992
MILLAKSYPGIEKQLKSGDPESWALLEHHSSATYQVAEVLLKILEPILRKWTRLSESEYNKFVLVVCLSAGLHDLGKANEDFQKMLQRRKYLQRFRHEIWSVLALTGSGPFSDWFRKTIGDETWVRIGQMGILSHHLKATRETLYADHETAEIKVFWKDQGVIKMFQSICRLAGISSPDFSSPDFSSPDFSSPSISSYTCLGEDADKSIRIWTREILNARIDPRYQHSIGAVRAMIIAADRLASAYKGADALKLWATEALNRVLSEQECSKIVKQGLGEKNLRPFQKQVGDSTSRVTLVRAGCGSGKTIAAFQWAKTHSAGRKLFFCYPTMGTATEGFRDYVSDIPGLDALLSHSRASLDLGELASTGEEDEGDSLNMHSRMLQEWTAQVTFCTVDQILGLLQNYRSSLTLSPAIFLGAFVFDEIHMYDSILFGNLLTFLKEFSHTSILLMTASLPETMLSAIQETVGADLGPVISGEAQIEERLRYRILHSSREDALQKAIQEFKNGGRVLWVCNKVEHCLKLYDELSEKYDIEALVYHSRFKYEDRKERHRAVIDSFQEGYKKSLPVFAITTQVCEVSLDISATLLISELCPFAALIQRLGRVNRPGQEMEGIAQVLIIPFQGKPYEKENEDDGESELERCKEILKPLLDRELSQKDLALALENAKGTEHQKIPSQWLSLGWEAKPDSIRESGYTLDVILESDAYKVLKNERPWEKSKLYTIPMPIQKQFSYGEPPLRIPVVPDSQIQYSSVRGGEWNLN

SEQ ID NO: 12810 - protein, 960 aa, Streptomyces bottropensis ATCC 25435
MMKRESAPPGDPPIDIRLWGKEHGLPRPYPVVCHLLDAAAVFGALWDALLSDQVREKVTQALGLTMAETRQVLAFWAGLHDLGKITPPFQAQVPEAFAAVRSESAFGYAPGAERERAFRHQMATHWALTLLFDEAGYPGNSRLMRAAVSHQVAQLLGGHHGCFGAVLRAKEVAHGSAYQAGLGGEGWAVQRRAHFVELRRVTGGWAVPERGLPAELAVIVTGLVVVADWLASQTEAIVPLLPSAGWRGTPEEIDEHWERTQKAAPRLVAGAQLGRARFTAERFEDMFPFPPNLLQADLVSHLPGVVHGKGAGLLLVTAPTGDGKTEAALYAASVLGHAAGARGLFFALPTMATADAMYPRVSAFAEHALSGERALTLLHSMAWLSPAYVTAGQLGGVAAAAGEVSADAATATAAGMWLRGRLRGLLAPLGAGTIDQALSAVLPITHNALRLFGLSDKVFVVDEAHAYGPWMHQLLTRLLEWLGAFGAPVVLLSATLSGRTASSLVDAYRRGAGFLEPSAVQPCYPGWVFTDAATGEVSTPHEVGSERERTLDVHLQPVIWDTADPAGSPLQGGGRREALREALEPVTSAGGTALVCCTTVAEAQQTVRDLRAAFPQLVQSDGGLRLLHSRYPANTRQRITGECETAYGKPRSATDIARPRPASILVATQVVEQSLDFDFDLIVSDLAPLAQLLQRAGRGRRHARGSNGRPHWALPEDTPRLVVLEPVDANGTTLVPRTWGLVYDAGLLQRTAHLLRERAEAGIAVPGHVQELVDAVYAEDFVDHLDGSAQRELRRMDAERQADEAAQAHLADMVTICAPADVAGDLYKLSRREAGVTEELLTTRLGADTGRVLCLYEQPDGSLALDEAGTLPLPTGDRQGLPHAGLVQVMARVAPVPGRWLRGAEGHPAPKSWAKHPVLCDLVLLVMRPVSPASNGSGSAWSCRHGTRTIQISDVGLEAD

SEQ ID NO: 12811 - protein, 752 aa, Leptospira interrogans serovar Canicola str. LT1962
MILLAKSYPGIEKQLKSGDPESWALLEHHSSATYQVAEVLLKILEPILRKWTRLSESEYNKFVLVVCLSAGLHDLGKANEDFQKMLQRRKYLQRFRHEIWSVLALTGSGPFSDWFRKTIGDETWVRIGQMGILSHHLKATRETLYADHETAEIKVFWKDQGVIKMFQSICRLAGISSPDFSSPSISSYTCLGEDADKSIRIWTREILNARIDPRYQHSIGAVRAMIIAADRLASAYKGADALKLWAEEALNRVLSEQECSNIVKQGLGEKNLRPFQKQVGDSTSRVTLVRAGCGNGKTIAAFQWAKTHSAGRKLFFCYPTMGTATEGFRDYVSDIPGLDALLSHSRASLDLGELASTGEEEEGDSLNMHSRMLQEWTAQVTFCTVDQILGLLQNYRSSLTLSPAIFLGAFVFDEIHMYDSILFGNLLTFLKEFSHTSILLMTASLPETMLSAIQETVGADLGPVISGEAQIEERLRYRILHSSREDALQKAIQEFKNGGRVLWVCNKVEHCLKLYDELSEKYDIEALVYHSRFKYEDRKERHRAVIDSFQEGYKKSLPVFAITTQVCEVSLDISATLLISELCPFAALIQRLGRVNRPGQEMEGIAQVLIIPFQGKPYEKENEDDGESELERCKEILKPLLDRELSQKDLALALENAKGTEHQKIPSQWLSLGWEAKPDSIRESGYTLDVILESDAYKVLKNERPWEKSKLYTIPMPIQKQFSYGEPPLRIPVVPDSQIQYSSVRGGEWNLN

SEQ ID NO: 12812 - protein, 931 aa, Leptospira weilii serovar Topaz str. LT2116
MKSKEKSYYKYWGKANKEGNYHLLVYHCFDVAAVGEIYLSQNETLCVHFSQKLGIDPLTFKNLFVFFLILHDLGKFSDCFQSLIPDIKSTFGNSNSPIGPYSIRHDSLGYIFWGKWILKDERFGNYSGFLTEQNWLGWNGLQSSKDKSYFTEFTDILIRCVTGHHGRPPSKNGYSGQTAVSLDSHFTETDRLAALDFSKEVNRILSPNLYFKGNFKTLYDSTLQISFWLAGLSVLCDWIGSNAEIFKYHTTPIDLEEYYTTISLNNASKAVKKSGILPSKIALNGNHFGIFEYLQEPTPLQKFCSEVVLPDSPSLFILEDVTGSGKTEAALILTHRLMQKNTYSGFYVGLPTMATANGMYRRMSSVYRNLYTKESLPSLVLAHGARNLSDSFQSSVISDNAILADRNYSFQSEKNQEESASAICNIWLSDNQKKSLLADVGVGTIDQALLSVLSAKFQSLRMFGLSRKVLILDEVHSYDPYMVELICCLLKAQAKIGASVILLSATLPKILRKTFSESFALGLDTELQDIKSEEYPLVSLISDRPVVEETPISTRKEVSRKLNVKFFFNQEQVLQKILEISNQGRCVCWIRNTVSDASQAFSFLHSKLGDRVTLFHSRFAMGDRLNIESQILENFGIHSDQISRKGKVVVATQVVEQSLDLDFDCIITDLAPIDLILQRAGRLYRHSRDISGNIKQGLDERGVPILWIFSPEPIDDPKSDWFSRFSRGGSMVYSDHGKLWLTARLLQERKGWRMPEDARNLIESVYGTNVMVPQSFQENQSKLENEKKKRESAAALSTIRLELGYDSTLNETSWDDSKFSTRYGIDNSTKVVLAKFVSDRLVPWISDTNRDWQNSELPVPNYLVEKEFIFENSNLSEVISHCKKNLPDKGKHCVLLPLFYANNSWRGKALNKKNEVVSLTYDERFGFRKEK

SEQ ID NO: 12813 - protein, 932 aa, Leptospira santarosai str. ST188
MEAEEKSYYKYWGKADQEGNYHLLVYHCLDVAAVGEVYLSQNETLCVHLSQKLGIDSPTFKNLFVFFLVLHDLGKFSDCFQSLIPNIKRILGNSNSPIGPYSVRHDSLGYIFWGEWILKDKRFGNYDGLLTEQNWLGWNGLRSFKEKSYFTEFLDVLIRCVTGHHGRPPSKNGYSGQTAVSPDSHFTEADRSAALAFCKEVNRIFSPNFEGDFKSLFDSTLPISFWLAGLSVLCDWIGSNSEIFKYRRTPIDLEEYYTTISLINAQKAVLKSGLSSAKIAFNENHFRIFEYLREPTPLQKFCSEVVLPDSPSLFILEDVTGSGKTEAALILTHRLMQKNAYSGFYVGLPTMATANGMYRRMSGVYRNLYTKESLPSLILAHGARNLSDSFQSSVISDNAILADRNYQSDKDPEESATAICNIWLSDNQKKSLLADAGVGTIDQALLSVLSAKFQSLRMFGLSRKVLILDEVHSYDPYMVELICCLLKAQAKIGASVILLSATLPKILRKRFSDSFALGLDTELQDIKSGEYPLVSLVSNRFEVEETPISTRKEVGRKLNVEFLFDQETVFQKILEMSNQGRCVCWIRNTVSEASQAFFFLHSKLGDRVILFHSRFAMGDRLNIESQILENFGVRSDQKSRKGKVVVATQVVEQSLDLDFDCIFTDLAPIDLILQRAGRLHRHSRDIFGNVKQGLDERGEPLLWIFSPEPIDDPTSNWFSQFSRGGGMVYSDHGKLWLTAKLLHERKGWKMPEDARNLIESVYGIDVKVPHSFRENRSKVENDRKKQESAAVLSTIRLELGYDSTSNETSWDDSKFSTRYGIGNSTKVVLAKFVSDRLVPWISGTSRDWQNSELPVPNYLVEKEFIFENSNVSEVISDCKKNLPDKGKHCVLLPLFYANDFWRGKAFNKKNEVVSFTYDERFGFKKEQLRGIV

SEQ ID NO: 12814 - protein, 632 aa, Leptospira borgpetersenii str. 200701203
MQKFCSEVAIPDSPSLFILEDVTGSGKTEAALILTHRLMQKSAYSGFYVGLPTMATANGMYQRMSGVYRNLYTKESIPSLVLAHGARNLSDSFQSSVISDNAILADRNYSLQLDKDPEESASAICNIWLSDNQKKSLLADAGVGTIDQALLSILSTKFQSLRMFGLSRKVLILDEVHSYDPYMVELICCLLKAQAKIGASVILLSATLPKILRKTFSESFALGLDTELQDLKSVEYPLISLISDRSEVEEIPISTRKEVSRKLNVKFLFNQEQVLQKILEMSNQGRCVCWIRNTVSDASQAFSFLHSKLGDQVILFHSRFVMGDRLNIESQILENFGVRSDQNSRKGKVVVATQVVEQSLDLDFDCIITDLAPIDLILQRAGRLHRHCRDIFGNAKQGLDERGEPILWIFSPEPIEDPTSNWFSQFSRGGSMVYSDHGRLWLTARLLQERKGWRMPEDARNLIESVYGIDVEIPQSFRENQFKVKNDKKKLESAAALSTIHLELGYDSTLNETSWDDSKFSTRYGIDNSSKAVLAKFVSDRLVPWISGTTRDWQNSELPVPNYLVEKEFIFENLNFSEVISNCKKNLPDKGKHCVLLPLFYTNNSWRGKALNKKNEVVSFTYDERFGFRKEK

SEQ ID NO: 12815 - protein, 752 aa, Leptospira interrogans serovar Grippotyphosa str. LT2186; identical to SEQ ID NO: 12739

SEQ ID NO: 12816 - protein, 719 aa, Campylobacter showae CC57C
PNKLLENHIKNMISPGDEELDKQVKLYHDIAKLKNNFQIYIRDTSNDKLDKNHSLLSAYFFLLNSKFDEIPTLFGFLAIVSHHGDAVNLMMLAREANKFFKNSKELEYWEEVANAAKNIQVYSGLSTKKDEFLGKAKKLRQYLILLQYRHKFTYEDFINFKSLYSNLVYSDKFEAIFSMPKQETKEIPIDVLESDIQNLPPNEKRDAFRKFVLNNFDENYKLFTLTAPTGYGKTLTALNFSLKFNKSRIIYVLPFTSIIDQTYDIVAKIYKNSDILVSKAHHKTTIDEENLTEEDRYSKIKFLMESFSGEINVTTLYQLIFALFGNKNKDNVKFNQLKNSVVILDEAQAIPYKFRKDFILLCEIISQRLGTIFIFMSATMPVIKSENFKEISNLEYFSKQDRYVIKWLDVSGEEDLLEKICETASDKNTLVVVNTIKKAQELFVKLREKFNCFCLNEYMYKDQKHATIEAVKRAINTNKDDPLASKILLISTQSIEAGVDLDFDVGFREVSPISSVIQTAGRVNRHFGEIRGELYVFPEISKFTNLIYGDLQKVSKAILEIFKQREVRESEILEISNFYFQKISDQLENLYIQSEIKKLEFENINHKIEEVMKDNHKQTLIIEAKENFIKDFEAKILEIKNSSNSEFTIRDILKNHIRKLSKFSINVTFKDKEKLTPNLKQINGLKDMFYLPFGSSYFYSDDYGLKKDTNLDIEDEVFD

SEQ ID NO: 12817 - protein, 798 aa, Klebsiella pneumoniae JHCK1
MAAAGHDIGKVSPTFAAKIFAACDVNDHRLAGLSAVNPGLETLWGGHAGVSQATAESLHAPRYVPEILGQHHGFNPGLNGRRGDAEVFGGPLWFDERKKLVDKLKAEFSADWPTFDSAAQARVVAGLTSVADWIGSGEFFENPEQAWQPVITAALNNAGFIKPVIRQGLSFADVFFPDDPSKKPREAQSRFIDQVVGPGLYILEAQMGMGKTEAALYAAYQMLVQEKATGIYFALPTQLTSNKIYDRFNAFLHQIVSTETPQHALLLHSGAWLMDTEMGEEGSPGGAWFNHRKRGLLAPFAVGTIDQALMAVMNVKHGFVRAYGLAGKVVILDEVHTYDLYTGTILNALVEFLRQIDCTVIILSATLSQTRRDALLQQSTTSEAYPLITAAPSAEREHGLVEIGVPVTENTTVILHSCRKDESAREEALRRAELGQQVLWIENTIAEAQQTYLDLASRAVEAGCETGLLHSRFTPQHRNRHEQRWVALYGRAGWPQRKQCGRILVGTQVLEQSLDIDADFLVSRFAPTDMLLQRLGRLWRHTDTPRHASAKAECWLLSPSLESALANPGFAFGMSAMVYSPYVLCRSLEVWQAIPSLSLPGDIRPLIDQTYTERAEEGTWATLLHELKNGSRFRSGEQALQSLAKLTLSTGGKTLPEHKAETRYSDRDTHDLLLLRGLRTQDGITYMRLLDGAELTLPHGRHRLSRAQWRQLAVVLNQQLVRVSPAFCPPTIAKSELEKLHLQEVFYLGRPEDDEALLRVAIVSPAGELKTLDGRPAGDKYTLEYSEYLGFRAISKKE

SEQ ID NO: 12818 - protein, 725 aa, Anoxybacillus gonensis
MTFYAKSEGKETIREHTDRLLHNLNLLKDAYGHKFMLMDEQMWKLLEIAVQYHDVGKANTVFQNKIRQAIHESMLETDVETNVPHNYLSAGCIPLKQLDLTKEEERLLIHAVGYHHERDQLPEKEMIRHVLENDIKQQLPQLSEHMGLQMTEKFSYRFVDRLLKRYTYHDGEEFWKYVMIKGLLHRLDHAASAHMDVERDVEKSIYINVNEYMQKQGFHKNDLQQFAERHHDKHVIAIAQTGMGKTEAALLWIREDKAFFTLPLRVSINAIYDRIKEKMGYDAVGLLHSTSVHYLVDKEENWEELKQQSEHYAKKLLLTTIDQILKFPFYYKGFEKELATMANAKIVIDEIQAYEPRIAAMLIKALEMIHHVGGKFMIMTATLPTLYLEELKQRNVIHDDEFVTGEFIDTDVHRHRICLRSECIEETIGEMLELGETSQVLVIVNTVRKAMSLYDKFLDCDTQVPIYLLHSQFTQEDRQLLEKRIKQFNEKNERGIWITTQLVEASIDIDFDYLFTEMSTLDSLFQRFGRCYRKRALDHDHCNIHIFTENISGIPRVYNEHLVNESIRLLEQYDYQIVDERAKVEMVKQLYDRKQLKGTSFLKEFEDALYMFDNLDPYGMDKREAQQKLRDIQNIQIITRQMYDQIEHLFEQYKKEKEWKERLKLRMEIEKKTVSVQRYVAEKYVSERLPKPFDHIYIADVQYDFNREQLKGKGILLDKPSSNQY

SEQ ID NO: 12819 - protein, 746 aa, Rhodopirellula europaea SH398
MPHYAHSLPDNPDRSKWETLQQHEQAVAKLSASFLNRINVELAAWGDLVGHWHDIGKYSDDFQDYLASAGGSDVHDSEISGKVDHSTAGAQLAFGKPSPLGRLIAYVLAGHHAGLPDWDVATGRSGLKQRLNKRVPNWQNEETKELVGLKIPQTIPIQPPHTRETFCRHRISAFRVTFLTRIIFSALVDADFLATEAFMSPGQSIQRTNIMVGMSDLSNAMEKHLADLRSNAKPSPVNQIRDEVSEACAKASDLAPGLFSLNVPTGGGKTLASLQFALRHAEHHGLDGVVIGIPFTSIIEQNAKVYRDVFESLGEGVVLEHHSNTDPDQETTRSRLQTENWDAPLVVTTNNQLFESLFACRTSRCRKLHRISRRVIILDEVQSLPVELLTPTMLAIRELVESFGCTVVLCTATQPALHWQEDFAIGLHGIRDIVPVSAKLHDRLRRTTVNSIGPLDDGELVDRINAENQALCIVNTRPHASKLFEELDHSESNFHLSTRMCAAHRLNVLDQQIRPRLDEGLPCRVISTQLIEAGVDVDFPVVFRDVCGIDSLTQAAGRCNREGRADEGNVYFFQGERRPPPGTLRMSADHGLEIARHYNDLLSPEAIEAYFRLHYWQQKDRWDFRQVMDAIGRDPSRMEFQFRQIADRYRFIDEEAETLYVPWQKGEQLIHNLSESQSPPDRKLRRRLQRYSINVRRHEMAQLHAAGAVLPFHGYATLTQRHLYEEKLGLVLLNADGVVPPSDLMC

SEQ ID NO: 12820 - protein, 791 aa, Rhodopirellula sallentina SM41
MEIRLTNVSSRRNLLCRLEQKGRLMKFYAHSIPGETDQTRWETMTEHEERVATRCKEFLARIDPSLEPWGEVLGRWHDLGKYQPDFQRRLTGEALQVEHAGAGAALAASRSPIHTIPMQFAIAGHHAGLANQITNDTKKLVSEPVTRSTLRERLIQNRDVARVVSKLAGLETLDLPLPELTTWLREERDSDSINRQIDVFTRVLFSALVDADRLATQWFYESSESEVSEEMRTEFESLKVLRDRFDGYVDSLRAEKHSRRSAINELRDLVLDSCRKKASSTGGIFSLTVPTGGGKTFSAMSFALNHAIHNELDRVIIVIPYTSIIRQNANVYRKAFAKPNEGLDLCNIIEHHSAIDTQQAKENNPEAEKRREQAVENWDAPVIVTTSVQFFETLFSDHPSQCRKLHRIANSVVILDEIQTIPPQYVIPITDMIRELSSRYKTSIVLSTATPPALKEHLGEVREIVDDPIGLAKHPAARRVQTEWRIENPTTYEELANELKTNGHQQSLAIVHRRADAANLAKMLPRNHRMHLSAQMCPEHRIQAVDEILRRVKEGEPCLAVTTQLIEAGVDLDMPIVYRALAGADSLAQAAGRCDREGKRTVASGYPAGKLIVFRPETKPPGQTLQDAADASLTMWNLKALEGSEFDVFDPDHCREYFQHFYGTKMLDQHHLQRERASLNFANVAALFEMIEDGWSFPVVVPWPFNEDGSHGEGRRRSEAFRESPNRETSRALQPYIVQVPKQAASILVEQGVIEVMFGSIGIPTDLFNPTWYSDEFGLTFDEGEMSFLQC

SEQ ID NO: 12821 - protein, 745 aa, Leptospira interrogans serovar Pomona str. CSL10083; identical to SEQ ID NO: 12647

SEQ ID NO: 12822 - protein, 758 aa, Leptospira sp. Fiocruz LV4135; identical to SEQ ID NO: 12713

SEQ ID NO: 12823 - protein, 922 aa, Leptospira noguchii str. Bonito
MSDGYYNYWGKAGIDESYHLLVYHSLDVAAVGEVIFQKNPSLLYKFSNLLKIEPALFRKIFLFFLAIHDLGKFSNAFQGQVKSVYEKLNPGTIPKPYSIRHDSLGFMLWNKHFLINQRGKLSGRFVDSNLFYLNSDQNRDIKDFLNIFISITTGHHGKPPSNTGYTGNSVDLSSHFTTQNIDDSYQFLLNVYNFFLTDSEIKQLEDFSLKESIVNLRLFSFWLAGLSVLCDWIGSNKEIFKFNSIVEDLQSYWNQFAIPRAFEAVYKSGILSSKVTDYSKPIELFPYLSTPTPLQTACDSLVVADGPQLFILEDVTGAGKTEAALILAKKLMNSNGYTGMFIGLPTMATANGMYDRVSSFYRRIYEPEATPSLILAHGGRNLSDTFRQSIISDTIPKDRSYAQDEESASAQCTAWLADSSKKATLSDIAVGTIDQVLISILLSKFQSLRLFGLLDKILILDEIHAYDEYMNELIQNLLSSQAKIGNSVILLSATIPHSLKEKFISAFNETEEERRPKSLNKHYPLLTQCSPKGIKEFKITTREEVKRSTPVNFIYEKSEIHSLIQNSIQDGKCICWIRNTVADALEAFEVMRNLFPEGQVILFHARFAMGDRLDIEQKVKDYFGPNSNHEQRKGKIVISTQVVEQSLDLDFDVMISDLAPIDLLIQRAGRLHRHTRDQLGNRIQNKDTRENLTFHIYSPAIEEEPQANWYSSFSKGGSVVYPDHGKLFLTSKILKQKGELKMPEDARTLIEYVYGDREPIPINLLDRNRKNTEKQKQNASRANNNVINLQSGYTAVDNEAIWNDLNAPTRLGEETVRVILAKYENGVLAPWYNVEPFPWPNSEVKVLSYFLKSEKENPELEAEIRKCKEQLPDKGKHSILMPLIKNFDNQWIGTALDKEGNDVQCVYDSEFGFRKIKSGAVV

SEQ ID NO: 12824 - protein, 932 aa, Leptospira sp. Fiocruz LV4135; identical to SEQ ID NO: 12714

SEQ ID NO: 12825 - protein, 745 aa, Leptospira noguchii str. Bonito
MIKEKQSIFLAHVLRKDDGSFVEHLIDDHLYSVAEFTKKFCEKFEAGTVGYLIGFWHDLGKFKLEFQERIRIRSGHIGEEAHLEGKTAKSVKHSVSGAIHCFNKFKKSDIIKKLICLPILCHHSGLKNFGIDVDIQLNDEKEISAWSKTISHIPQQILDGIDLKQLGRSFKDFSLLIRMLFSALIDADRLDTERFMDLSKFKERYSKTIILQDLNIKLDKHLNEIQKQADVTKVNSTRKRILEEVQSKTNLKPGFYTLTVPTGGGKTLTSLSFALKHCIANKMDRVIYGVPYLSIIEQTADIFKKILGEDSVLEHHSGIDISKEKENSINRLLTENWDHPLIVTTNVQLFESLFSSKTTKVRKLHNIINSVIILDEAQMIPPQFLQPIVKTLKELVEYYNVTIILCTATQPTLSSIKSTDLNFDGIDTTIELAPEPEKLFQKLKRVIIHKPEEKKLSFIEVATRILNYDQVLTIVNRKSDASGIFNELTGNKYYLTTNLCAEHRRDILKKVKSHLDNGESVYLVSTQLIEAGVDIDFPIVFRAVGGLDSIAQAAGRCNREGKLLDKNGQEKLGEVFLFHLEQDPPSGHLLQTKQASEDCIKNFEELIHPDALKQYFNTLFWLKQNKGLDKEEIEELKINLQFETINEKFKLVDEDSRPVIVPYKEGKDIIIQLQNSAIKNNFLDYKLIRKSQRYTVNLKTNLYNKLLSEGIISEIEGIIGILNFDSYYYNDLGILESPNEQDLII

SEQ ID NO: 12826 - protein, 742 aa, Leptospira interrogans str. FPW1039
MKRNKQSIFIAHVLRKDDGNFVEHLLDDHLYSVAELTEKFCEKFGAGTFGYLIGLWHDLGKFKLEFQERIRIRSGHIGEEAHLEGKTAKSVKHSVSGAIHCFNKFKQSDIIKKLICLPILCHHSGLKNFGIDVDIQLNEEREILALSETTPHIPQEILDGIDLKQLGKSFKDHSLLIRILFFALIDADRLDTERFMNPAKFKERYSKTIILQDLNIKLDKHLKNIQKQADTTKVNSIRKRILEEVQSKTNLKPGFYTLTVPTGGGKTLTSLSFALKHCITNKMDRVIYGVPYLSIIEQTTDVFKKILGEDSVLEHHSGIDISKEKENSINRLLTENWDHPLIVTTNVQLFESLFSSKTTKVRKLHNIINSVIILDEAQMIPPQFLQPIVKTLKELVEFYNVTIILCTATQPTLSSIKSIDLNFDGINTAIELAPEPEKLFQELKRVIIHKPEERKLSFIEIATKISNYDQVLTIVNRKSDSSGIFNQLTGNKYYLTTNLCAEHRRDILKKVKSHLSNGESVYLVSTQLIEAGVDIDFPIVFRAVAGLDSIAQAVGRCNREGKLVDENGQEKLGEVFLFHPEQDPPSGHLLQTKQASEDCIKNFEELIHPDTLKQYFNTLFWLKQDKGLDKEEIEKDKRSFQFETINKNFKLIDEDSRPVIVPYKEGKDLIVQLQNSVVQNNFVDYKLIRKSQRYTVNLKTNLYNKLLSEGIISEIEGILNFDSYYHNDLGILESPNDQDLII

SEQ ID NO: 12827 - protein, 750 aa, Leptospira interrogans str. FPW1039
MILLAKSYPGIEKQLKSGDPESWALLEHHSSATYQVAEVLLKILEPILRKWTRLSESEYNKFVLVVCLSAGLHDLGKANEDFQKMLQRRKYLQRFRHEIWSVLALTGSGPFSDWFRKTIGDETWVRIGQMGILSHHLKATRETLYADHETAEIKVFWKDQGVIKMFQSICRLAGISSPDFSSPSISSYTCLGEDADKSIRIWTREILNARIDPRYQHSIGAVRAMIIAADRLASAYKGADALKLWATEALNRVLSEQECSKIVKQGLGEKNLRPFQKQVGDSTSRVTLVRAGCGNGKTIAAFQWAKTHSAGRKLFFCYPTMGTATEGFRDYVSDIPGLDALLSHSRASLDLGELASTGEEDEGDSLNMHSRMLQEWTAQVTFCTVDQILGLLQNYRSSLTLSPAIFLGAFVFDEIHMYDSILFGNLLTFLKEFSHTSILLMTASLPETMLSAIQETVGADLGPVISGEAQIEERLRYRILHSSREDALQKAIQEFKNGGRVLWVCNKVEHCLKLYDELSEKYDIEALVYHSRFKYEDRKERHRAVIDSFQEGYKKSLPVFAITTQVCEVSLDISATLLISELCPFAALIQRLGRVNRPGQEMEGIAQVLIIPFQGKPYEKENEDDGESELERCKEILKPLLDRELSQKDLALALENAKGTEHQKIPSQWLSLGWEAKPDSIRESGYTLDVILESDAYKVLKNERPWEKSKLYTIPMPIQKQFSYGEPPLRIPVVPDSQIQYSSVRGGEWN

SEQ ID NO: 12828 - protein, 758 aa, Leptospira santarosai str. HAI1349
MEKLLAKSLSGDPRDNEQELYLVPHLRAAEEAGSAIYESIGERILKAVGLPSIIWSKRLKILLPLACLLHDLGKANNWFQELLRGMKIYQPIRHEFLSVIMILRSTKKIQNYLKEKIHVLETSEDKTPFINSIYSGILAHHMKMDIDLKRACPALFANGGTPTEIIAYTNASDFDSLFGPDKPTNDFCFTFLSSHANDKYKPIHRWIDEFQKISCEWEGFLKENNDWHIFSTILKPLVISADVIASALVPKGIEYKDWVIKSLQNYIEQNDINQIVKERLHGKSPREFQRQIANSEERITLVEAGCGSGKTIGAYLWAANNALDSKLFFCYPTTGTATEGYLGYVSDSSYESKLIHSKSQVDLEGIHKTGDEDSTELTDKIHALHSYHPKIIICTADTILSLIKNGRKSILSFPSIATGIFVFDEIHSYNDEMFLVMVRFIQFFKNTKFLLMSASLQPERKNVLKREFINFQEIESPTDLMDIPRYKFEEIRDSKTLSEDIKRHAGHSKILVVVNTVKRAQSIYRDLKSSGLNVKIYHSRYKYKDRVIRHREFITAFKDEAPPVVGIATQVAEMSLDIDSDILFCELAPIPSIIQRLGRLNRRTALDNQLPARSVYFSRPEKPLPYDKEELELAEQWIEILRNSKDEISQNDLQEFFLNIKTETADLFPPVYYDFNKPTFYFTPATEGLRGASSTVNCILRSDLLEIDQSPYNIANYIIPMTMNRKVDFTILDQYKYAFVIPDEKILYDSLEGAQWLN

SEQ ID NO: 12829 - protein, 932 aa, Leptospira santarosai str. HAI1349
MEAEEKSYYKYWGKADQEGNYHLLVYHCLDVAAVGEVYLSQNETLCVHLSQKLGIDFPTFKNLFVFFLVLHDLGKFSDCFQSLIPNIKRILGNSNSPIGPYSVRHDSLGYIFWGEWILKDKRFGNYDGLLTEQNWLGWNGLRSSKEKSYFTEFLDVLIRCVTGHHGRPPSKNGYSGQTAVSPDSHFTEADRSAALAFCKEVNRIFSPNFEGDFKSLFDSTLPISFWLAGLSVLCDWIGSNSEIFKYHRTPIDLEEYYTTISLINAQKTVLKSGLSSAKIAFNENHFRIFEYLREPTPLQKFCSEVVLPDSPSLFILEDVTGSGKTEAALILTHRLMQKNAYSGFYVGLPTMATANGMYRRMSGVYRNLYTKESLPSLILAHGARNLSDSFQSSVISDNAILADRNYQSDKDPEESATAICNIWLSDNQKKSLLADAGVGTIDQALLSVLSAKFQSLRMFGLSRKVLILDEVHSYDPYMVELICCLLKAQAKIGASVILLSATLPKILRKRFSDSFALGLDTELQDIKSGEYPLVSLVSNRFEVEETPIPTRKEVGRKLNVEFLFDQETVFQKILEMSNQGRCVCWIRNTVSEASQAFFFLHSKLGDRVILFHSRFAMGDRLNIESQILENFGVRSDQKSRKGKVVVATQVVEQSLDLDFDCIFTDLAPIDLILQRAGRLHRHSRDIFGNVKQGLDERGEPLLWIFSPEPIDDPTSNWFSQFSRGGGMVYSDHGKLWLTAKLLHERKGWKMPEDARNLIESVYGVDVKVPHSFRENRSKVENDRKKQESAAVLSTIRLELGYDSTSNETSWDDSKFSTRYGIGNSTKVVLAKFVSDRLVPWISGTSRDWQNSELPVPNYLVEKEFIFENSNISEVISDCKKNLPDKGKHCVLLPLFYANDFWRGKAFNKKNEVVSFTYDERFGFRKEQLRGIV

SEQ ID NO: 12830 - protein, 730 aa, Leptospira interrogans str. UT126
MKRNKQSIFIGHILRKDDGNFVEHLLDDHLYSVAELTEKFCEKFGAGTFGYLIGLWHDLGKFKLEFQERIRIRSGHIGEEAHLEGKTAKSVKHSVSGAIHCFNKFKQSDIIKKLICLPMLCHHSGLKNFGIDVDIQLNEEREILALSETTPHIPQEILDGIDLKQLGKSFKDHSLLIRMLFSALIDADRLDTERFMDPAKFKERYSKTIILQDLNIKLDKHLKNIQKQADTTKVNSIRKRILEEVQSKTNLKPGFYTLTVPTGGGKTLTSLSFALKHCITNKMDRVIYGVPYLSIIEQTTDVFKKILGEDFVLEHHSGIDISKEKENSINRLLTENWDHTLIVTTNVQLFESLFSSKTTKVRKLHNIINSVIILDEAQMIPPQFLQPIVKTLKELVEFYNVTIILCTTTQPTLSSIKSIDLNFDGINTAIELAPEPEKLFQELKRVIIHKPEKRKLSFIEIATKISNYDQVLTVVNRKSDSSGIFNQLTGNKYYLTTNLCAEHRRDILKKVKSHLSNGESVYLVSTQLIEAGVDIDFPIVFRAVAGLDSIAQTVGRCNREGKLVDENGQEKLGEVFLFHLQQDPPSGHLLQTKQASEDCIKNFEELIHPDTLKQYFNTLFWLKQDKGLDKEEIEKDKRSFQFETINKNFKLIDKDSRPVIVPYKEGKDLIVQLQNSVVQNNFVDYKLIRKSQRYTVNLKTNLYNKLLSEGIISEIEGIIGILNFDSYYHN

SEQ ID NO: 12831 - protein, 752 aa, Leptospira interrogans str. UT126
MILLAKSYPGIEKQLKSGDPESWALLEHHSSATYQVAEVLLKILEPILRKWTRLSESEYNKFVLVVCLSAGLHDLGKANEDFQKMLQRRKYLQRFRHEIWSVLALTGSGPFSDWFRKTIGDETWVRIGQMGILSHHLKATRETLYADHETAEIKVFWKDQGVIKTFQSICRLAGISSPDFSSSSISSYTCLGEDADKSIRIWTREILNARIDPRYQHSIGAVRAMIIAADRLASAYKGADALKLWAEEALNRVLSEQECSKIVKQGLGEKNLRPFQKQVGDSTSRVTLVRAGCGNGKTIAAFQWAKTHSAGRKLFFCYPTMGTATEGFRDYVSDIPGLDALLSHSRASLDLGELASTGEEDEGDSPNMHSRMLQEWTAQVTFCTVDQILGLLQNYRSSLTLSPAIFLGAFVFDEIHMYDSILFGNLLTFLKEFSHTSILLMTASLPETMLSAIQETVGADLGPVISGEAQIEERLRYRILHSSREDALQKAIQEFKNGGRVLWVCNKVEHCLKLYDELSEKYDIEALVYHSRFKYEDRKERHRAVIDSFQEGYKKSLPVFAITTQVCEVSLDISATLLISELCPFAALIQRLGRVNRPGQEMEGIAQVLIIPFQGKPYEKENEDDGESELERCKEILKPLLDRELSQKDLALALENAKGTEHQKIPSQWLSLGWEAKPDSIRESGYTLDVILESDAYKVLKNERPWEKSKLYTIPMPIQKQFSYGEPPLRIPVVPDSQIQYSSVRGGEWNLN

SEQ ID NO: 12832 - protein, 752 aa, Leptospira interrogans serovar Valbuzzi str. Duyster
MILLAKSYPGIEKQLKSGDPESWALLEHHSSATYQVAEVLLKILEPILRKWTRLSESEYNKFVLVVCLSAGLHDLGKANEDFQKMLQRRKYLQRFRHEIWSVLALTGSGPFSDWFRKTIGDETWVRIGQMGILSHHLKATRETLYADHETAEIKVFWKDQGVIKMFQSICRLAGISSPDFSSSSISSYTCLGEDADKSIRIWTREILNAKIDPRYQHSIGAVRAMIIAADRLASAYKGADALKLWAEEALNRVLSEQECSNIVKQGLGEKNLRPFQKQVGDSTSRVTLVRAGCGNGKTIAAFQWAKTHSAGRKLFFCYPTMGTATEGFRDYVSDIPGLDALLSHSRASLDLGELASTGEEDEGDSPNMHSRMLQEWTAQVTFCTVDQILGLLQNYRSSLTLSPAIFLGAFVFDEIHMYDSILFGNLLTFLKEFSHTSILLMTASLPETMLSAIQETVGADLGPVISGEAQIEERLRYRILHSSREDALQKAIQEFKNGGRVLWVCNKVEHCLKLYDELSEKYDIEALVYHSRFKYEDRKERHRAVIDSFQEGYKKSLPVFAITTQVCEVSLDISATLLISELCPFAALIQRLGRVNRPGQEMEGIAQALIIPFQGKPYEKENEDDGESELERCKEILKPLLDRELSQKDLALALENAKGTEHQKIPSQWFSLGWEAKPDSIRESGYTLDVILESDAYKVLKNERPWEKSKLYTIPMPIQKQFSYGEAPLRIPVVPDSQIQYSSVRGGEWNLN

SEQ ID NO: 12833 - protein, 718 aa, Leptospira interrogans serovar Valbuzzi str. Duyster
MKRNKQSIFIGHILRKDDGNFVEHLLDDHLYSVAELTEKFCEKFGAGTFGYLIGLWHDLGKFKLEFQERIRIRSGHIGEEAHLEGKTAKSVKHSASGAIHCFNKFKQSDIIKKLICLPMLCHHSGLKNFGIDVDIQLNEEREILALSETTPHIPQEILDGIDLKQLGKSFKDHSLLIRMLFSALIDADRLDTERFMDPAKFKERYSKTIILQDLNTKLDKHLKNIQKQADTTKVNSIRKRILEEVQSKTNLKPGFYTLTVPTGGGKTLTSLSFALKHCITNKMDRVIYGVPYLSIIEQTTDVFKKILGEDSVLEHHSGIDISKEKENSINRLLTENWDHPLIVTTNVQLFESLFSSKTTKVRKLHNIINSVIILDEAQMIPPQFLQPIVKTLKELVEFYNVIIILCTATQPTLSSIKSIDLNFDGINTAIELAPEPEKLFQELKRVIIHKPEERKLSFIEIATKISNYDQVLTIVNRKSDSIGIFNQLTGNKYYLTTNLCAEHRRDILKKVKSHLSNGESVYLVSTQLIEAGVDIDFPIVFRAVAGLDSIAQAVGRCNREGKLVDENGQEKLGEVFLFHPEQDPPSGHLLQTKQASEDCIKNFEELIHPDTLKQYFNTLFWLKQDKGLDKEEIEKDKRSFQFETINKNFKLIDEDSRPVIVPYKEGKDLIVQLQNSVVQNNFVDYKLIRKSQRYTVNLKTNLYNKLLSEESSPKSKEL

SEQ ID NO: 12834 - protein, 745 aa, Leptospira interrogans serovar Pomona str. CSL4002; identical to SEQ ID NO: 12647

SEQ ID NO: 12835 - protein, 931 aa, Leptospira sp. P2653
MKSEEKSYYKYWGKANKEGYYHLLVYHCFDVAAVGEVYLSQNETLCVHFSQKLGIDPLTFKNLFVFFLILHDLGKFSDCFQSLIPDIKSAFGNSNSPIGPYSIRHDSLGYIFWGKWILKDERFGNYNGLLTEQNWLGWNGLQSSKDKSYFTEFTDVLIRCVTGHHGRPPSKNGYSGQTAVSPDSHFTEADRLAALDFSKEANRILSPNLYFKGNFKTLYDSTLQISFWLAGLSVLCDWIGSNAEIFKYHTTPIDLEEYYTTISLNNASKAVKKSGILPSKITLNGNHFGIFEYLQEPTPLQKFCSEVVLPDSPSLFILEDVTGSGKTEAALILTHRLMQKNTYSGFYVGLPTMATANGMYRRMSSVYRNLYTKESLPSLVLAHGARNLSDSFQSSVISDNAILSDRNYSFQSEKNQEESASAICNIWLSDNQKKSLLADAGVGTIDQALLSVLSAKFQSLRMFGLSRKVLILDEVHSYDPYMVELICCLLKAQAKIGASVILLSATLPKILRKTFSESFALGLDTELQDIKSEEYPLVSLISDRPVVEETPISTRKEVSRKLNVKFFFNQEQVLQKILEISNQGRCVCWIRNTVSDASQAFSFLHSKLGDRVTLFHSRFAMGDRLNIESQILENFGIQSDQISRKGKVVVATQVVEQSLDLDFDCIITDLAPIDLILQRAGRLYRHSRDISGNIKQGLDERGVPILWIFSPEPIDDPKSDWFSRFSRGGSMVYSDHGKLWLTARLLQERKGWRMPEDARNLIESVYGTNVMVPQSFQENQSKVENDKKKRESAAALSTIRLELGYDSTLNETSWDDSKFSTRYGIDNSTKVVLAKFVSDRLVPWISDTNRDWQNSELPVPNYLVEKEFIFENSNLSEVISHCKKNLPDKGKHCVLLPLFYANNSWRGKALNKKNEVVSLTYDERFGFRKEK

SEQ ID NO: 12836 - protein, 752 aa, Leptospira interrogans str. 2003000735; identical to SEQ ID NO: 12699

SEQ ID NO: 12837 - protein, 757 aa, Leptospira interrogans str. 2002000632; identical to SEQ ID NO: 12700

SEQ ID NO: 12838 - protein, 757 aa, Leptospira interrogans str. 2003000735; identical to SEQ ID NO: 12700

SEQ ID NO: 12839 - protein, 752 aa, Leptospira interrogans str. 2002000632; identical to SEQ ID NO: 12699

SEQ ID NO: 12840 - protein, 754 aa, Leptospira interrogans str. 2002000631
MKRNKQSIFIGHILRKDDGNFVEHLLDDHLYSVAELTEKFCEKFGAGTFGYLIGLWHDLGKFKLEFQERIRIRSGHIGEKAHLEGKTAKSVKHSASGAIHCFNKFKQSDIIKKLICLPMLCHHSGLKNFGIDVDIQLNEEREILALSETTPHIPQEILDGIDLKQLGKSFKDHSLLIRMLFSALIDADRLDTERFMDPAKFKERYSKTIILQDLNIKLDKHLKNIQKQADTTKVNSIRKRILKEVQSKTNLKPGFYTLTVPTGGGKTLTSLSFALKHCITNKMDRVIYGVPYLSIIEQTTDVFKKILGEDSVLEHHSGIDISKEKENSINRLLTENWDHPLIVTTNVQLFESLFSSKTTKVRKLHNIINSVIILDEAQMIPPQFLQPIVKTLKEIVKFYNVTIILCTATQPTLSSIKSIDLNFDGINTAIELAPEPEKLFQELKRVIIHKSEERKLSFIEIATKISNYDQVLTIVNRKSDSSGIFNQLTGNKYYLTTNLCAEHRRDILKKVKSHLSNGESVYLVSTQLIEAGVDIDFPIVFRAVAGLDSIAQAAGRCNREGKLVDENGQEKLGEVFLFHLQQDPPSGHLLQTKQASEDCIKNFEELIHPDTLKQYFNTLFWLKQDKGLDKEEIEKDKRSFQFETINKNFKLIDKDSRPVIVPYKEGKDLIVQLQNSVVQNNFVDYKLIRKSQRYTVNLKTNLYNKLLSEGIISEIEGIIGIIGIIGIIGILNFDSYYHNDLGILESPNDQDLII

SEQ ID NO: 12841 - protein, 752 aa, Leptospira interrogans str. 2002000631; identical to SEQ ID NO: 12699

SEQ ID NO: 12842 - protein, 931 aa, Leptospira borgpetersenii serovar Hardjo-bovis str. Sponselee; identical to SEQ ID NO: 11580

SEQ ID NO: 12843 - protein, 758 aa, Leptospira kirschneri str. JB
MEKLLAKSLSKHPSDKEQELYLVPHLKAAEKAGSVIYDSIGERILKSVGLSSEIWGNRLKILLPLSCLLHDLGKANNWFQELVRGNKIFQPIRHEFLSVIMILRSKNKLQNYIKTKISEIISLENLTPFINSIYSGILAHHLKIDIDLKRACPGLGINGGTPTEIIVYADSPDFDLLFGVNKPSNTFYFTFLPSHSDQKYKSIHEWIDEFYTINNEWEEFLRENEDWHIFSTILKPLVISADVLASALVPKGIEYKDWVIESLQNYVELNDINLIIKERLKDKLPRTFQKQIANSKERITLVEAGCGSGKTIGAYLWAANNISDSKIFFCYPTTGTATEGYLGYVSDSGYEAKLIHSRSEVDLKGIQTTGEEDGNELTDRIDALHSYHPKLIICTVDTVLSLMRNGRKAILSFPSIAMGIFVFDEIHSYNDEMFLVLIRFMQFFKNTKFLLMSASLQPERKEILKREFSSLQDIESPTDLMGLPRYKFNPIRQSKSLLEDIKRHAGNSKILVVVNTVKRAQTIYRDISSSGLNVKIYHSRYKYKDRVIRHREFIDAFQDKSPPVIGIATQVAEMSLDIDSDVLFTELASISSIIQRLGRLNRRTTPENKLPSRNVCFFKPEKTLPYSSDELELAEQWIKNLLNINNEISQNDLQEYFFRLSPKNENLYPPIYYDFNKPTFFFLPATEGLRGPNNTINCILESDMPSVMQKPKDISNFTIPMTINSGFDFQTANFYKYVVVIPDENIHYDKIEGAAWRN

SEQ ID NO: 12844 - protein, 745 aa, Leptospira kirschneri str. JB
MTKDKQSIFIAHVLRKDDGSFVEHLIDDHLYSVAEFAKKFCEKFGAETFGYLIGLWHDLGKFKLEFQERIRIRSGHIGEEAHLEGKTAKSVKHSVSGAIHCLNKFKQSDIIKKLICLPILCHHSGLKNFGIDVDIQLNDEKEISALSETITYIPQQILDGIELKQLGKSFKDHSLLIRMLFSTLIDADRLDTERFMDLVKFKERYSKTIILQDLNIKLDKHLNDIQKQADATKVNSTRKRILEEVQSKTNLKPGFYTLTVPTGGGKTLTSLSFALKHCIENKMDRVIYGVPYLSIIEQTADVFKKILGEDSVLEHHSGIDISKEKENSINRLLTENWDHPLIVTTNVQFFESLFSSKTTKVRKLHNIINSVIILDEAQMIPPQFLQPIVKTLKELVEYYNVTIILCTATQPTLSSIKSTDLNFDGIDTAIELAPEPEKLFQELKRVIIHKPEEKKLSFMEVATRILNYDQVLTIVNRKSDASGIFNQLTGNKYYLTTNLCAEHRRDILKKVKNHLNNGESVYLVSTQLIEAGVDIDFPIVFRAVAGLDSIAQAAGRCNREGKLLDENGQEKLGEVFLFKPEQDPPAGHLLQTEQASRDCIKNFEELIHPDTLKQYFNTLFWLKQDKGLDKEEIEKDKRSFQFETINKKFKLIDEDSRPVIVPYKEGKDLIVQLQNSVIQNNFLDYKLIRKSQRYTVNLKTNLYNKLLSEGIISEIEGIIGILTFDSYYHNDLGILESPNEQDLII

SEQ ID NO: 12845 - protein, 773 aa, Leptospira alstonii serovar Sichuan str. 79601
MTEGKLLAKTKTNDGREISLIEHSLDTDTAGSAIFKKDSRFLNNWLRFFKVSNEDADKFLLNLSIACLFHDIGKANEDFQKAVNDTTFFHQGIRHEHLSALILHLPEVSSWLAKNENLDHNIITASVLTHHLKAEESGFYEWGKLRREGIIEVSLNHSEIKSILNQVSTIAQLNNIPKLPTESFNSAKNNTLWDGIIANGKKQARQFHRSLRSDSDRKSLLLSIKAALIVSDSVSSGLWREKKDFDAWIEEKLHCSEISPDEILEKIIQPRIETIEKESGKQFQIHNFQSLVATKGSRVLLLAPCGAGKTFAAWEWAKEQSKVNQVSRIIFLYPTRGTATEGFKDYVAAAPESDAALMHGSSKYELEQLRNNPDEKDSQRKNYNVKQEDERLFALGYWSKRFFSATVDQFLSFLQNNYKGICLLPPLTDSLLIIDEIHSLDKKMFESLLSFLEHFNSPVLCMTATLQKERREELIKLGLKAYPDLVDKEFLKDLILLESKPRYNKKLIHSFEEGIEIAKKELENGNRKVLWVVNTIAQAQKLTKLLAAYQPICYHSMFKLADRQSKHKDTVQLFKTTSKNKPVLAITTQVCEMSLDLDADVMITELAPISSLIQRFGRVNRKIDGKPSEFRGEIFIYKPEKALPYEDKDLTAAERFINHLSDKDLSQKDLADSMEQFSPDQPTPQEFSQFVLSDYYATSEEYRDIEEFTEQCALDSDLRAIEQFLNNKHPIDEFILPAPKKMILKENKPKFLPKYLSVVDGKNYNSELGLIRT

SEQ ID NO: 12846 - protein, 765 aa, Leptospira kirschneri str. MMD1493; identical to SEQ ID NO: 12729

SEQ ID NO: 12847 - protein, 745 aa, Leptospira kirschneri str. MMD1493; identical to SEQ ID NO: 12646

SEQ ID NO: 12848 - protein, 745 aa, Leptospira kirschneri
MTKDKQSIFIAHVLRKDDGSFVEHLIDDHLYSVAEFAKKFCEKFGAETFGYLIGLWHDLGKFKLEFQERIRIRSGHIGEEAHLEGKTAKSVKHSVSGAIHCLNKFKQSDIIKKLICLPILCHHSGLKNFGIDVDIQLNDEKEISALSETITYIPQQILDGIELKQLGKSFKDHSLLIRMLFSTLIDADRLDTERFMDLVKFKERYSKTIILQDLNIKLDKHLNDIQKQADATKVNSIRKRILEEVQSKTNLKPGFYTLTVPTGGGKTLTSLSFALKHCIENKMDRVIYGVPYLSIIEQTADVFKKILGEDSVLEHHSGIDISKEKENSINRLLTENWDHPLIVTTNVQFFESLFSSKTTKVRKLHNIINSVIILDEAQMIPPQFLQPIVKTLKELVEYYNVTIILCTATQPTLSSIKSTDLNFDGIDTAIELAPEPEKLFQELKRVIIHKPEEKKLSFMEVATRILNYDQVLTIVNRKSDASGIFNQLTGNKYYLTTNLCAEHRRDILKKVKNHLNNGESVYLVSTQLIEAGVDIDFPIVFRAVAGLDSIAQAAGRCNREGKLLDENGQEKLGEVFLFKPEQDPPAGHLLQTEQASRDCIKNFEELIHPDTLKQYFNTLFWLKQDKGLDKEEIEKDKRSFQFETINKKFKLIDEDSRPVIVPYKEGKDLIVQLQNSVIQNNFLDYKLIRKSQRYTVNLKTNLYNKLLSEGIISEIEGIIGILTFDSYYHNDLGILESPNEQDLII

SEQ ID NO: 12849 - protein, 771 aa, Leptospira kirschneri
MEKLLAKSRTQDGREISLQEHSFDTENAAISIFRKESRFLNNWLRFFKIKKEEKEKFLLNLRVTCLFHDIGKANDDFQKAVKEKGLFHQGIRHEHLSALILHLPEVKSWLAQNKKLDHDVISASVLTHHLKTEENGFYEWGKLRREGIVEISLKHPEINHILSRVSKIALIDNIPTLPNEPFNSAKDNTLWDQIIADGKKQARVFHRNLRSDSFRKSLLLSIKAGLIVSDSVSSGLWREQKDFDQWIEEKLHCDEISNDEIREKIILPRIRSIEQSSGKEFKIHNFQSLAAKKGNRVLLLAPCGAGKTFAAWEWAKEQSGKNKVSRVIFLYPTRGTATEGFKDYIASAPESDATLMHGSSKYELEQILNNPVEKSSQKKNYHIQQEEERLFALAYWSKKFFSSTVDQFLSFLQNNYKGICLLPPLTDSLLIIDEIHSFDKKMFESLLSLLKHFDFPVLCMTATLQRERKEILIRTGLKVYPDETDKELLTDLIYSESKPRYSKKFIQSAEEAIEIAKNKLNNGNSKVLWVVNTIAQAQTLAKLLFEYQPLCYHSMFKLADRQSKHIDTVQSFKSIATDKPVLAITTQVCEMSLDLDADVMISELAPISSLIQRFGRVNRKTDGKPADFRGEIFIYKPIQVLPYNKEDIAAAENFVSNLSDSDLSQKELTDKMELFSPKQSTPKEFAQFVSSDYYATPEEYREIEEFAKQCVLDTDLPEIEKFLNQKKPIDEFVLPAPVKMILNREKPEFLPKYLSIVDSKNYNSELGFMRI

SEQ ID NO: 12850 - protein, 931 aa, Leptospira sp. serovar Kenya str. Sh9; identical to SEQ ID NO: 12719

SEQ ID NO: 12851 - protein, 765 aa, Leptospira kirschneri serovar Bim str. PUO 1247; identical to SEQ ID NO: 12729

SEQ ID NO: 12852 - protein, 745 aa, Leptospira kirschneri serovar Bim str. PUO 1247
MTKDKQSIFIAHVLRKDDGSFVEHLIDDHLYSVAEFAKKFCEKFGAETFGYLIGLWHDLGKFKLEFQERIRIRSGHIGEEAHLEGKTAKSVKHSVSGAIHCLNKFKQSDIIKKLICLPILCHHSGLKNFGIDVDIQLNDEKEISALSETITYIPQQILDGIELKQLGKSFKDHSLLIRMLFSTLIDADRLDTERFMDLVKFKERYSKTIILQDLNIKLDKHLNDIQKQADATKVNSIRKRILEEVQSKTNLKPGFYTLTVPTGGGKTLTSLSFALKHCIENKMDRVIYGVPYLSIIEQTADVFKKILGENSVLEHHSGIDISKEKENSINRLLTENWDHPLIVTTNVQFFESLFSSKTTKVRKLHNIINSVIILDEAQMIPPQFLQPIVKTLKELVEYYNVTIILCTATQPTLSSIKSTDLNFDGIDTAIELAPEPEKLFQELKRVIIHKPEEKKLSFMEVATRILNYDQVLTIVNRKSDASGIFNQLTGNKYYLTTNLCAEHRRDILKKVKNHLNNGESVYLVSTQLIEAGVDIDFPIVFRAVAGLDSIAQAAGRCNREGKLLDENGQEKLGEVFLFKPEQNPPAGHLLQTEQASRDCIKNFEELIHPDTLKQYFNTLFWLKQDKGLDKEEIEKDKRSFQFETINKKFKLIDEDSRPVIVPYKEGKDLIVQLQNSVIQNNFLDYKLIRKSQRYTVNLKTNLYNKLLSEGIISEIEGIIGILTFDSYYHNDLGILESPNEQDLII

SEQ ID NO: 12853 - protein, 745 aa, Leptospira interrogans str. Kito; identical to SEQ ID NO: 12711

SEQ ID NO: 12854 - protein, 750 aa, Leptospira interrogans str. Kito; identical to SEQ ID NO: 12712

SEQ ID NO: 12855 - protein, 765 aa, Leptospira kirschneri serovar Bulgarica str. Nikolaevo; identical to SEQ ID NO: 12710

SEQ ID NO: 12856 - protein, 745 aa, Leptospira kirschneri serovar Bulgarica str. Nikolaevo
MTKDKQSIFIAHVLRKDDGSFVEHLIDDHLYSVAEFAKKFCEKFGAENFGYLIGLWHDLGKFKLEFQERIRIRSGHIGEEAHLEGKTAKSVKHSVSGAIHCLNKFKQSDIIKKLICLPILCHHSGLKNFGIDVDIQLNDEKEISALSETITYIPQQILDGIELKQLGKSFKDHSLLIRMLFSSLIDADRLDTERFMDLVKFKERYSKTIILQDLNIKLDKHLNDIQKQADATKVNSIRKRILEEVQSKTNLKPGFYTLTVPTGGGKTLTSLSFALKHCITNKMDRVIYGVPYLSIIEQTADVFKKILGEDSVLEHHSGIDISKEKENSINRLLTENWDHPLIVTTNVQFFESLFSSKTTKVRKLHNIINSVIILDEAQMIPPQFLQPIVKTLKELVEYYNVTIILCTATQPTLSSIKSTDLNFDGIDTAIELAPEPEKLFQELKRVIIHKPEEKKLSFMEVATRILNYDQVLTIVNRKSDASGIFNQLTGNKYYLTTNLCAEHRRDILKKVKNHLNNGESVYLVSTQLIEAGVDIDFPIVFRAVAGLDSIAQAAGRCNREGKLLDENGQEKLGEVFLFKPEQDPPAGHLLQTEQASRDCIKNFEELIHPDTLKQYFNTLFWLKQDKGLDKEEIEKDKRSFQFETINKKFKLIDEDSRPVIVPYKEGKDLIVQLQNSVIQNNFLDYKLIRKSQRYTVNLKTNLYNKLLSERIISEIEGIIGILTFDSYYHNDLGILESPNEQDLII

SEQ ID NO: 12857 - protein, 931 aa, Leptospira weilii str. 2006001855
MKSEEKSYYKYWGKANKEGNYHLLVYHCFDVAAVGEVYLSQNETLCVHFSQKLGIDPLTFKNLFVFFLILHDLGKFSDCFQSLIPDIKSAFGNSNSPIGPYSIRHDSLGYIFWGKWILKDERFGNYNGLLTEQNWLGWNGLQSSKDKSYFTEFTDVLIRCVTGHHGRPPSKNGYSGQTAVSPDSHFTEADRLAALDFSKEANRILSPNLYFKGNFKTLYDSTLQISFWLAGLSVLCDWIGSNAEIFKYRTTPIDLEEYYTTISLNNASKAVKKSGILPSKIALNGNHFGIFEYLQEPTPLQKFCSEVVLPDSPSLFILEDVTGSGKTEAALILTHRLMQKNTYSGFYVGLPTMATANGMYRRMSSVYRNLYTKESLPSLVLAHGARNLSDSFQSSVISDNAILSDRNYSFQSEKNQEESASAICNIWLSDNQKKSLLADTGVGTIDQALLSVLSAKFQSLRMFGLSRKVLILDEVHSYDPYMVELICCLLKAQAKIGASVILLSATLPKILRKTFSESFALGLDTELQDIKSEEYPLVSLISDRPVVEETPISTRKEVSRKLNVKFFFNQEQVLQKILEISNQGRCVCWIRNTVSDASQAFSFLHSKLGDRVTLFHSRFAMGDRLNIESQILENFGIQSDQISRKGKVVVATQVVEQSLDLDFDCIITDLAPIDLILQRAGRLYRHSRDISGNIKQGLDERGVPILWIFSPEPIDDPKSDWFSRFSRGGSMVYSDHGKLWLTARLLQERKGWRMPEDARNLIESVYGTNVMVPQSFQENQSKVENDKKKRESAAALSTIRLELGYDSTLNETSWDDSKFSTRYGIDNSTKVVLAKFVSDRLVPWISDTNRDWQNSELPVPNYLVEKEFIFENSNLSEVISNCKKNLPDKGKHCVLLPLFYANNSWRGKALNKKNEVVSLTYDERFGFRKEK

SEQ ID NO: 12858 - protein, 931 aa, Leptospira santarosai str. 2000030832
MEAEEKSYYKYWGKADQEGNYHLLVYHCFDVAAVGEVYLSQNETLCVHLSQKLGIDPPTFKNLFVFFLVLHDLGKFSDCFQSLIPNIKRILGNSNSPIGPYSVRHDSLGYIFWGEWILKDKRFGNYDGLLTEQNWLGWNGLRSKEKSYFTEFLDVLIRCVTGHHGRPPSKNGYSEQTAVSPDSHFTEADRSAALAFCKEVNRIFSPNFEGDFKSLFDSTLPISFWLAGLSVLCDWIGSNSEIFKYRRTPIDLEEYYTTISLINAQKAVLKSGLSSAKIAFNENHFRIFEYLREPTPLQKFCSEVVLPDSPSLFILEDVTGSGKTEAALILTHRLMQKNAYSGFYVGLPTMATANGMYRRMSGVYRNLYTKESLPSLILAHGARNLSDSFQSSVISDNAILADRNYQSDKDPEESATAICNIWLSDNRKKSLLADAGVGTIDQALLSVLSAKFQSLRMFGLSRKVLILDEVHSYDPYMVELICCLLKAQAKIGASVILLSATLPKILRKRFSDSFALGLDTELQDIKSGEYPLVSLVSNRFEVEETPIPTRKEVGRKLNVEFLFDQETVFQKILEMSNQGRCVCWIRNTVSEASQAFFFLHSKLGDRVILFHSRFAMGDRLNIESQILENFGVRSDQKSRKGKVVVATQVVEQSLDLDFDCIFTDLAPIDLILQRAGRLHRHSRDIFGNVKQGLDERGEPLLWIFSPEPIDDPTSNWFSQFSRGGGMVYSDHGKLWLTAKLLHERKGWKMPEDARNLIESVYGVDVKVPHSFRENRSKVENDRKKQESAAVLSTIRLELGYDSTSNETSWDDSKFSTRYGIGNSTKVVLAKFVSDRLVPWISGTSRDWQNSELPVPNYLVEKEFIFENSNVSEVISDCKKNLPDKGKHCVLLPLFYANDFWRGKAFNKKNEVVSFTYDERFGFRKEQLRGIV

SEQ ID NO: 12859 - protein, 752 aa, Leptospira interrogans str. 2006001854
MILLAKSYPGIEKQLKSGDPESWALLEHHSSATYQVAEVLLKILEPILRKWTRLSESEYNKFVLVVCLSAGLHDLGKANEDFQKMLQRRKYLQRFRHEIWSVLALTGSGPFSDWFRKTIGDETWVRIGQMGILSHHLKATRETLYADHETAEIKVFWKDQGVIKMFQSICRLAGISSPDFSSSSISSYTCLGEDADKSIRIWTREILNARIDPRYQHSIGAVRAMIIAADRLASAYKGADALKLWATEALNRVLSEQECSKIVKQGLGEKNLRPFQKQVGDSTSRVTLVRAGCGNGKTIAAFQWAKTHSAGRKLFFCYPTMGTATEGFRDYVSDIPGLDALLSHSRASLDLGELASTGEEDEGDSLNMHSRMLQEWTAQVTFCTVDQILGLLQNYRSSLTLSPAIFLGAFVFDEIHMYDSILFGNLLTFLKEFSHTSILLMTASLPETMLSAIQETVGADLGPVISGEAQIEERLRYRILHSSREDALQKAIQEFKNGGRVLWVCNKVEHCLKLYDELSEKYDIEALVYHSRFKYEDRKERHRAVIDSFQEGYKKSLPVFAITTQVCEVSLDISATLLISELCPFAALIQRLGRVNRPGQEMEGIAQALIIPFQGKPYEKENEDDGESELERCKEILKSLLDRELSQKDLALALENAKGTEHQKIPSQWLSLGWEAKPDSIRESGYTLDVILESDAYKVLKNERPWEKSKLYTIPMPIQKQFSYGEPPLRIPVVPDSQIQYSSVRGGEWNLN

SEQ ID NO: 12860 - protein, 745 aa, Leptospira interrogans str. 2006001854
MKRNKQSIFIAHVLRKDDGNFVEHLLDDHLYSVAELTEKFCEKFGAGTFGYLIGLWHDLRKFKLEFQERIRIRSGHIGEEAHLEGKTAKSVKHSASGAIHCFNKFKQSDIIKKLICLPMLCHHSGLKNFGIDVDIQLNEEREILALSETTPHIPQEILDGIDLKQLGKSFKDHSLLIRMLFSALIDADRLDTERFMDPAKFKERYSKTIILQDLNIKLDKHLKNIQKQADTTKVNSIRKRILEEVQSKTNLKPGFYTLTVPTGGGKTLTSLSFALKHCITNKMDRVIYGVPYLSIIEQTTDVFKKILGEDSVLEHHSGIDISKEKENSINRLLTENWDHPLIVTTNVQLFESLFSSKTTKVRKLHNIINSVIILDEAQMIPPQFLQPIVKTLKELVEFYNVTIILCTTTQPTLSSIKSIDLNFDGINTAIELAPEPEKLFQELKRVIIHKPEKRKLSFIEIATKISNYDQVLTIVNRKSDSSGIFNQLTGNKYYLTTNLCAEHRRDILKKVKSHLSNGESVYLVSTQLIEAGVDIDFPIVFRAVAGLDSIAQAVGRCNRESKLVDENGQEKLGEVFLFHPQQDPPSGHLLQTKQASEDCIKNFEELIHPDTLKQYFNTLFWLKQDKGLDKEEIEKDKRSFQFETINKNFKLIDKDSRPVIVPYKEGKDLIVQLQNSVVQNNFVDYKLIRKSQRYTVNLKTNLYNKLLSEGIISEIEGIIGILNFDSYYHNDLGILESPNDQDLII

SEQ ID NO: 12861 - protein, 759 aa, Leptospira santarosai str. 2000027870
MMEKLLAKSLSGDPRDNEQELYLVPHLRAAEEAGSAIYESIGERILKAVGLPSIIWSKRLKILLPLACLLHDLGKANNWFQELLRGMKIYQPIRHEFLSVIMILRSTKKIQNYLKEKIHVLETSENKTPFINSIYSGILAHHMKMDIDLKRACPALFANGGTPTEIIAYTNASDFDSLFGPDKPTNDFCFTFLSSHANDKYKPIHRWIDEFQKISCEWEEFLKENNDWHIFSTILKPLVISADVIASALVPKGIEYKDWVIKSLQNYIEQNDINQIVKERLHGKSPREFQRQIANSEERITLVEAGCGSGKTIGAYLWAANNALDSKLFFCYPTTGTATEGYLGYVSDSSYESKLIHSKSQVDLEGIHKTGDEDSTELTDKIHALHSYHPKIIICTADTILSLIKNGRKSILSFPSIATGIFVFDEIHSYNDEMFLVMVRFIQFFKNTKFLLMSASLQPERKNVLKREFINFQEIESPTDLMDIPRYKFEEIRDSKTLSEDIKRHAGHSKILVVVNTVKRAQSIYRDLKSSGLNVKIYHSRYKYKDRVIRHREFIAAFKDEAPPVVGIATQVAEMSLDIDSDILFCELAPIPSIIQRLGRLNRRTAPDNQLPARSVYFSRPEKPLPYDKEELELAEQWIEILRNSKDEISQNDLQEFFLNIKTKTADLFPPVYYDFNKPTFYFTPATEGLRGASSTVNCILRSDLLEIDQSPYTIANYIIPMTMNRKVDFTILDQYKYAFVIPDEKIFYDSLEGAQWLN

SEQ ID NO: 12862 - protein, 932 aa, Leptospira santarosai str. 2000027870
MEAEEKSYYKYWGKADQEGNYHLLVYHCLDVAAVGEVYLSQNETLCVHLSQKLGIDPPTFKNLFVFFLVLHDLGKFSDCFQSLIPNIKRILGNSNSPIGPYSVRHDSLGYIFWGEWILKDKRFGNYDGLLTEQNWLGWNGLRSSKEKSYFTEFLDVLIRCVTGHHGRPPSKNGYSGQTAVSPDSHFIEADRSAALAFCKEVNRIFSPNFEGDFKSLFDSTLPISFWLAGLSVLCDWIGSNSEIFKYHRTPIDLEEYYTTISLINAQKAVLKSGLSSAKIAFNENHFRIFEYLREPTPLQKFCSEVVLPDSPSLFILEDVTGSGKTEAALILTHRLMQKNAYSGFYVGLPTMATANGMYRRMSGVYRNLYTKESLPSLILAHGARNLSDSFQSSVISDNAILADRNYQSDKDPEESATAICNIWLSDNQKKSLLADAGVGTIDQALLSVLSAKFQSLRMFGLSRKVLILDEVHSYDPYMVELICCLLKAQAKIGASVILLSATLPKILRKRFSDSFALGLDTELQDIKSGEYPLVSLVSNRFEVEETPISTRKEVGRKLNVEFLFDQETVFQKILEMSNQGRCVCWIRNTVSEASQAFFFLHSKLGDRVILFHSRFAMGDRLNIESQILENFGVRSDQKSRKGKVVVATQVVEQSLDLDFDCIFTDLAPIDLILQRAGRLHRHSRDIFGNVKQGLDERGEPLLWIFSPEPIDDPTSNWFSQFSRGGGMVYSDHGKLWLTAKLLHERKGWKMPEDARNLIESVYGVDVKVPHSFLENRSKVENDRKKQESAAVLSTIRLELGYDSTSNETSWDDSKFSTRYGIGNSTKVVLAKFVSDRLVPWISGTSRDWQNSELPVPNYLVEKEFIFENSNVSEVISDCKKNLPDKGKHCVLLPLFYANDFWRGKAFNKKNEVVSFTYDERFGFRKEQLRGIV

SEQ ID NO: 12863 - protein, 752 aa, Leptospira interrogans serovar Djasiman str. LT1649; identical to SEQ ID NO: 12811

SEQ ID NO: 12864 - protein, 745 aa, Leptospira interrogans serovar Zanoni str. LT2156
MKRNKQSIFIGHILRKDDGNFVEHLLDDHLYSVAELTEKFCEKFGAGTFGYLIGLWHDLGKFKLEFQERIRIRSRHIGEEAHLEGKTAKSVKHSASRAIHCFNKFKQSDIIKKLICLPMLCHHSGLKDFGIDVDIQLNEEREILALSETTPHIPQEILDGIDLKQLGKSFKDHSLLIRMLFSALIDADRLDTERFMDPAKFKERYSKTIILQDLNIKLDKHLKNIQKQADTTKVNSIRKRILEEVQSKTNLKPGFYTLTVPTGGGKTLTSLSFALKHCITNKMDRVIYGVPYLSIIEQTTDVFKKILGEDSVLEHHSGIDISKEKENSINRLLTENWDHPLIVTTNVQLFESLFSSKTTKVRKLHNIINSVIILDEAQMIPPQFLQPIVKTLKELVEFYNVTIILCTATQPTLSSIKSIDLNFDGINTAIELAPEPEKLFQELKRVIIHKPEERKLSFIEIATKISNYDQVLTIVNRKSDSSGIFNQLTGNKYYLTTNLCAEHRRDILKKVKSHLSNGESVYLVSTQLIEAGVDIDFPIVFRAVAGLDSIAQAVGRCNREGKLVDENGQEKLGEVFLFHPEQDPPSGHLLQTKQASEDCIKNFEELIHPDTLKQYFNTLFWLKQDKGLDKEEIEKDKRSFQFETINKNFKLIDEDSRPVIVPYKEGKDLIVQLQNSVVQNNFVDYKLIRKSQRYTVNLKTNLYNKLLSEGIISEIEGIIGILNFDSYYHNDLGILESPNDQDLII

SEQ ID NO: 12865 - protein, 745 aa, Leptospira noguchii str. 2007001578
MIKEKQSIFLAHVLRKDDGSFVEHLIDDHLYSVAEFTKKFCEKFEAGTVGYLIGFWHDLGKFKLEFQERIRIRSGHIGEEAHLEGKTAKSVKHSVSGAIHCFNKFKKSDIIKKLICLPILCHHSGLKNFGIDVDIQLNDEKEISAWSKTISHIPQQILDGIDLKQLGRSFKDFSLLIRMLFSALIDADRLDTERFMDLSKFQERYSKTIILQDLNIKLDKHLNEIQKQADATKVNSTRKRILEEVQSKTNLKPGFYTLTVPTGGGKTLTSLSFALKHCIANKMDRVIYGVPYLSIIEQTADIFKKILGEDSVLEHHSGIDISKEKENSINRLLTENWDHPLIVTTNVQLFESLFSSKTTKVRKLHNIINSVIILDEAQMIPPQFLQPIVKTLKELVEYYNVTIILCTATQPTLSSIKSTDLNFDGIDTTIELAPEPEKLFQKLKRVIIHKPEEKKLSFIEVATRILNYDQVLTIVNRKSDASGIFNELTGNKYYLTTNLCAEHRRDILKKVKSHLYNGESVYLISTQLIEAGVDIDFPIVFRAVGGLDSIAQAAGRCNREGKLLDKNGQEKLGEVFLFYPEQDPPSGHLLQTKQASEDCIKNFEELIHPDVLKQYFNTLFWLKQNKGLDKEEIEELKINLQFETINEKFKLVDEDSRAVIVPYKEGKDIIIQLQNSATKNNFLDYKLIRKSQRYTVNLKTNLYNKLLSEGIISEIEGIIGILNFDSYYYNDLGILESPNEQDLII

SEQ ID NO: 12866 - protein, 922 aa, Leptospira noguchii str. 2007001578
MSDGYYNYWGKAGIDESYHLLVYHSLDVAAVGEVIFQKNPSLLYKFSNLLKIEPALFRKIFLFFLAIHDLGKFSNAFQGQIKSVYEKLNPGTIPKPYSIRHDSLGFMLWNKHFLINQRGKLSGRFVDSNLFYLNSDQNRDIKDFLNIFISITTGHHGKPPSNTGYTGNSVDLSSHFTTQNIDDSYQFLLNVYNFFLTDSEIKQLEDFSLKESIVNLRLFSFWLAGLSVLCDWIGSNKEIFKFNSIVEDLQSYWNQFAIPRAFEAVYKSGILPSKVTDYSKPIELFPYLSTPTPLQAACDSLDLADGPQLFILEDVTGAGKTEAALILAKKLMNSNGYTGMFIGLPTMATANGMYDRISSFYRRIYEPEATPSLILAHGGRNLSDTFRQSIISDTIPKDRSYAQDEESASAQCTAWLADSSKKATLSDIAVGTIDQVLISILLSKFQSLRLFGLLDKILILDEIHAYDEYMNELIQNLLSSQAKIGNSVILLSATIPHSLKEKFISAFNETEKQNEPKSLNKHYPLLTQCSPKGIKEFKITTREEVKRSIPVNFIYEKSAIHSLIQNSIQDGKCVCWIRNTVTDALEAFEVMRDLFPEGQVILFHARFAMGDRLDIEQKVKDYFGPNSNHEQRKGKIVISTQVVEQSLDLDFDVMISDLAPIDLLIQRAGRLHRHTRDQLGNRIQNKDTRENLTFHIYSPVIEGEPQTNWYSSFSKGGSVVYPDHGKLFLTAKILKQKGELKMPEDARNLIEYVYGDREPIPINLLDRNRKNTEKQKQNASRANNNVINLQSGYTAVDNEAIWNDLNAPTRLGEETVRVILAKYENGVLAPWYNVEPFPWPNSEVKVLSYFLKSEKENPELEAEIRKCKEQLPDKGKHSILIPLIKNSNNQWIGTALDKEGNDVQCIYDSKFGFRKIKSGVVV

SEQ ID NO: 12867 - protein, 745 aa, Leptospira kirschneri serovar Bim str. 1051; identical to SEQ ID NO: 12852

SEQ ID NO: 12868 - protein, 765 aa, Leptospira kirschneri serovar Bim str. 1051; identical to SEQ ID NO: 12729

SEQ ID NO: 12869 - protein, 807 aa, Leptospira interrogans serovar Muenchen str. Brem 129
MILLAKSYPGIEKQLKSGDPESWALLEHHSSATYQVAEVLLKILEPILRKWTRLSESEYNKFVLVVCLSAGLHDLGKANEDFQKMLQRRKYLQRFRHEIWSVLALTGSGPFSDWFRKTIGDETWVRIGQMGILSHHLKATRETLYADHETAEIKVFWKDQGVIKMFQSICRLAGISSPDFSSPDFSSPDFSSPDFSSPDFSSPDFSSPDFSSPDFSSPDFSSPDFSSPDFSSPDFSSPSISSYTCLGEDADKSIRIWTREILNARIDPRYQHSIGAVRAMIIAADRLASAYKGADALKLWATEALNRVLSEQECSKIVKQGLGEKNLRPFQKQVGDSTSRVTLVRAGCGSGKTIAAFQWAKTHSAGRKLFFCYPTMGTATEGFRDYVSDIPGLDALLSHSRASLDLGELASTGEEDEGDSLNMHSRMLQEWTAQVTFCTVDQILGLLQNYRSSLTLSPAIFLGAFVFDEIHMYDSILFGNLLTFLKEFSHTSILLMTASLPETMLSAIQETVGADLGPVISGEAQIEERLRYRILHSSREDTLQKAIQEFKNGGRVLWVCNKVEHCLKLYDELSEKYDIEALVYHSRFKYEDRKERHRAVIDSFQEGYKKSLPVFAITTQVCEVSLDISATLLISELCPFAALIQRLGRVNRPGQEMEGIAQVLIIPFQGKPYEKENEDDGESELERCKEILKPLLDRELSQKDLALALENAKGTEHQKIPSQWLSLGWEAKPDSIRESGYTLDVILESDAYKVLKNERPWEKSKLYTIPMPIQKQFSYGEPPLRIPVVPDSQIQYSSVRGGEWNLN

SEQ ID NO: 12870 - protein, 932 aa, Leptospira santarosai serovar Arenal str. MAVJ 401
MEAEEKSYYKYWGKADQEGNYHLLVYHCLDVAAVGEVYLSQNETLCVHLSQKLGIDSPTFKNLFVFFLVLHDLGKFSDCFQSLIPNIKRILGNSNSPIGPYSVRHDSLGYIFWGEWILKDKRFGNYDGLLTEQNWLGWNGLRSSKEKSYFTEFLDVLIRCVTGHHGRPPSKNGYSGQTAVSPDSHFTEADRSAASAFCKEVNRIFSPNFEGNFKSLFDSTLPISFWLAGLSVLCDWIGSNSEIFKYRRTPIDLEEYYTTISLINAQKAVLKSGLSSAKIAFNENHFRIFEYLREPTPLQKFCSEVVLPDSPSLFILEDVTGSGKTEAALILTHRLMQKNAYSGFYVGLPTMATANGMYRRMSGVYRNLYTKESLPSLILAHGARNLSDSFQSSVISDNAILADRNYQSEKNPEESATAICNIWLSDNRKKSLLADAGVGTIDQALLSVLSAKFQSLRMFGLSRKVLILDEVHSYDPYMVELICCLLKAQAKIGASVILLSATLPKILRKRFSDSFALGLDTELQDIKSGEYPLVSLVSNRFEVEETPIPTRKEVGRKLNVEFLFDQETVFQKILEMSNQGRCVCWIRNTVSEASQAFFFLHSKLGDRVILFHSRFAMGDRLNIESQILENFGVRSDQKSRKGKVVVATQVVEQSLDLDFDCIFTDLAPIDLILQRAGRLHRHSRDIFGNVKQGLDERGEPLLWIFSPEPIDDPTSNWFSQFSRGGGMVYSDHGKLWLTAKLLHERKGWKMPEDARNLIESVYGVDVKVPHSFRENRSKVENDRKKQESAAVLSTIRLELGYDSTSNETSWDDSKFSTRYGIGNSTKVVLAKFVSDRLVPWISGTSRDWQNSELPVPNYLVEKEFIFENSNVSEVISDCKKNLPDKGKHCVLLPLFYANDFWRGKAFNKKNEVVSFTYDERFGFRKEQLRGIV

SEQ ID NO: 12871 - protein, 761 aa, Leptospira kirschneri serovar Sokoine str. RM1
MEKLLAKSRTQDGREISLQEHSFDTENAAISIFRKESRFLNNWLRFFKIRKEDEEKFLLNLRVTCLFHDIGKANDDFQKAVREKGFFHQGIRHEHLSAFVLHLPEIRKWLSQNKDLDIPIITSAVLCHHLKATDKNDHQYKWLTDPLRDFVILNLFHEEVKIILKKVNQFLKSDIDIPQLNYKTFSPEDENWKKTFQSGAKESGILGFRLDENRKQLHLAIKAALIVSDSASSGLVRENHLIEKWISKAIHSDEIKENEILKEIIQKRMDDKKILELHQFQKQVATKGDRVLLMAGCGMGKTLAAWNWANEVSKKQKISKVIFLYPTRGTATEGFKDYASWAPEADATLMHGTSDYELDSMFQNPDDEKSKRDFRISEADERLFAIAFWSKKFFSATADQFLSFLQNNYKGICLLPVLSECALIVDEVHSFDKAMFSSLLSFLKYFDLPILCMTATLTPKNKQSLLELDLEQYPKEEDRKELENLINLENHPRYNKTVLENAEQAKEIAIKSFREGKRVLWVLNTVDRCQKTYEELQTEVHCYHSRFKLSDRKTVHENTVNAFQGSNLNSIAVTTQVCEMSLDLDADVLISEFAPVSSMVQRFGRANRHLKKGDEFRAELYLYEVVGSLKPYSSDEINAAKNFLNNLPEKDISQNLLATKLEECSAQEYKTLPSASFIDGGYFALPSDYRDIEEFTAQAILDEDFPEVSQLLQSKKPIDPYILPVPDKRELNLRNEEHSLLPKYLKIVSKKYYNNKRGFAL

SEQ ID NO: 12872 - protein, 745 aa, Leptospira kirschneri serovar Sokoine str. RM1
MTKDKQSIFIAHVLRKDDGSFVEHLIDDHLYSVAEFAKKFCEKFGAETFGYLIGLWHDLGKFKLEFQERIRIRSGHIGEEAHLEGKTAKSVKHSVSGAIHCLNKFKQSDIIKKLICLPILCHHSGLKNFGIDVDIQLNDEKEISALSETITYIPQQILDGIELKQLGKSFKDHSLLIRMLFSTLIDADRLDTERFMDLVKFKERYSKTIILQDLNIKLDKHLNDIQKQADATKVNSIRKRILEEVQSKTNLKPGFYTLTVPTGGGKTLTSLSFTLKHCIENKMDRVIYGVPYLSIIEQTADVFKKILGEDSVLEHHSGIDISKEKENSINRLLTENWDHPLIVTTNVQFFESLFSSKTTKVRKLHNIINSVIILDEAQMIPPQFLQPIVKTLKELVEYYNVTIILCTATQPTLSSIKSTDLNFDGIDTAIELAPEPEKLFQELKRVIIHKPEEKKLSFMEVATRILNYDQVLTIVNRKSDASGIFNQLTGNKYYLTTNLCAEHRRDILKKVKNHLNNGESVYLVSTQLIEAGVDIDFPIVFRAVAGLDSIAQAAGRCNREGKLLDENGQEKLGEVFLFKPEQDPPAGHLLQTEQASRDCIKNFEELIHPDTLKQYFNTLFWLKQDKGLDKEEIEKDKRSFQFETINKKFKLIDEDSRPVIVPYKEGKDLIVQLQNSVIQNNFLDYKLIRKSQRYTVNLKTNLYNKLLSEGIISEIEGIIGILTFDSYYHNDLGILESPNEQDLII

SEQ ID NO: 12873 - protein, 752 aa, Leptospira interrogans serovar Pyrogenes str. L0374; identical to SEQ ID NO: 12702

SEQ ID NO: 12874 - protein, 750 aa, Leptospira interrogans serovar Medanensis str. L0448; identical to SEQ ID NO: 12744

SEQ ID NO: 12875 - protein, 745 aa, Leptospira interrogans serovar Medanensis str. L0448; identical to SEQ ID NO: 12647

SEQ ID NO: 12876 - protein, 750 aa, Leptospira interrogans str. L0996; identical to SEQ ID NO: 12744

SEQ ID NO: 12877 - protein, 745 aa, Leptospira interrogans str. L0996; identical to SEQ ID NO: 12647

SEQ ID NO: 12878 - protein, 931 aa, Leptospira weilii str. LNT 1234
MKSEEKSYYKYWGKANKEGNYHLLVYHCFDVAAVGEVYLSQNETLCVHFSQKLGIDPLTFKNLFVFFLILHDLGKFSDCFQSLIPDIKSAFGNSNSPIGPYSIRHDSLGYIFWGKWILKDERFGNYNGLLTEQNWLGWNGLQSSKDKSYFTEFTDVLIRCVTGHHGRPPSKNGYSGQTAVSPDSHFTEADRLASLDFSKEANRILSPNLYFKGNFKTLYDSTLQISFWLAGLSVLCDWIGSNAEIFKYRTTPIDLEEYYTTISLNNASKAVKKSGILPSKIALNGNHFGIFEYLQEPTPLQKFCSEVVLPDSPSLFILEDVTGSGKTEAALILTHRLMQKNTYSGFYVGLPTMATANGMYRRMSSVYRNLYTKESLPSLVLAHGARNLSDSFQSSVISDNAILSDRNYSFQSEKNQEESASAICNIWLSDNQKKSLLADTGVGTIDQALLSVLSAKFQSLRMFGLSRKVLILDEVHSYDPYMVELICCLLKAQAKIGASVILLSATLPKILRKTFSESFALGLDTELQDIKSEEYPLVSLISDRPVVEETPISTRKEVSRKLNVKFFFNQEQVLQKILEISNQGRCVCWIRNTVSDASQAFSFLHSKLGDRVTLFHSRFAMGDRLNIESQILENFGIQSDQISRKGKVVVATQVVEQSLDLDFDCIITDLAPIDLILQRAGRLYRHSRDISGNIKQGLDERGVPILWIFSPEPIDDPKSDWFSRFSRGGSMVYSDHGKLWLTARLLQERKGWRMPEDARNLIESVYGTNVMVPQSFQENQSKVENDKKKRESAAALSTIRLELGYDSTLNETSWDDSKFSTRYGIDNSTKVVLAKFVSDRLVPWISDTNRDWQNSELPVPNYLVEKEFIFENSNLSEVISHCKKNLPDKGKHCVLLPLFYANNSWRGKALNKKNEVVSLTYDERFGFRKEK

SEQ ID NO: 12879 - protein, 745 aa, Leptospira interrogans str. L1207
MKRNKQSIFIGHRHILRKDDGNFVEHLLDDHLYSVAELTEKFCEKFGAGTFGYLIGLWHDLGKFKLEFQERIRIRSGHIGEEAHLEGKTAKSVKHSASGAIHCFNKFKQSDIIKKLICLPMLCHHSGLKNFGIDVDIQLNEERETLALSETTPHIPQEILDGIDLKQLGKSFKDHSLLIRMLFSALIDADRLDTERFMDPAKFKERYSKTIILQDLNIKLDKHLKNIQKQADTTKVNSIRKRILEEVQSKTNLKPGFYTLTVPSVGGKTLTSLSFALKHCITNKMDRVIYGVPYLSIIEQTTNVFKKILGEDSVLEHHSGIDISKEKENSINRLLTENWDHPLIVTTNVQLFESLFSSKTTKVRKLHNIINSVIILNEAQMIPPQFLQPIVKTLKELVEFYNVTIILCTATQPTLSSIKSIDLNFDGINTAIELAPEPEKLFQELKRVIIHKPEERKLSFIEIETKISNYDQVLTIVNRKSDSSGIFNQLTGNKYYLTTNLCAEHRRDILKKVKSHLSNGESVYLVSTQLIEAGVDIDFPIVFRAVAGLDSIAQAVGRCNREGKLVDENGQEKLGEVFLFHPEQDPPSGHLLQTKQASEDCIKNFEELIHPDTLKQYFNTLFWLKQDKGLDKEEKDKRSFQFETINKNFKLIDEDFRTVIVPYKEGKDLIVQLQNSAVQNNFVDYKLIRKSQRYTVNLKTNLYNKLLSEGIISEIEGIIGILNFDSYYHNDLGILEYPNDQDLII

SEQ ID NO: 12880 - protein, 742 aa, Leptospira interrogans serovar Autumnalis str. LP101
MKRNKQSIFIGHILRKDDGNFVEHLLDDHLYSVAELTEKFCEKFGAGTFGYLIGLWHDLGKFKLEFQERIRIRSGHIGEEAHLEGKTAKSVKHSASGAIHCFNKFKQSDIIKKLICLPMLCHHSGLKNFGIDVDIQLNEEREILALSETTPHIPQEILDGIDLKQLGKSFKDHSLLIRMLFSALIDADRLDTERFMDPAKFKERYSKTIILQDLNIKLDKHLKKQADTTKVNSIRKRILGEVQSKTNLKPGFYTLTVPTGGGKTLTSLSFALKHCITNKMDRVIYGVPYLSIIEQTTDVFKKILGEDSVLEHHSGIDISKEKENSINRLLTENWDHPLIVTTNVQLFESLFSSKTTKVRKLHNIINSVIILDEAQMIPPQFLQPIVKTLKEIVEFYNVTIILCTATQPTLSSIKSIDLNFDGINTAIELAPEPEKLFQELKRVIIHKSEERKLSFIEIATKISNYDQVLTIVNRKSDSSGIFNQLTGNKYYLTTNLCAEHRRDILKKVKSHLSNGESVYLVSTQLIEAGVDIDFPIVFRAVAGLDSIAQTVGRCNREGKLVDENGQEKLGEVFLFHPQQDPPSGHLLQTKQASEDCIKNFEELIHPDTLKQYFNTLFWLKQDKGLDKEEIEKDKRSFQFETINKNFKLIDKDSRPVIVPYKEGKDLIVQLQNSVVQNNFVDYKLIRKSQRYTVNLKTNLYNKLLSEGIISEIEGIIGILNFDSYYHNDLGILESPNDQDLII

SEQ ID NO: 12881 - protein, 752 aa, Leptospira interrogans serovar Autumnalis str. LP101; identical to SEQ ID NO: 12649

SEQ ID NO: 12882 - protein, 931 aa, Leptospira borgpetersenii serovar Javanica str. MK146; identical to SEQ ID NO: 12719

SEQ ID NO: 12883 - protein, 752 aa, Leptospira interrogans serovar Pyrogenes str. R168; identical to SEQ ID NO: 12702

SEQ ID NO: 12884 - protein, 752 aa, Leptospira interrogans serovar Grippotyphosa str. UI 08434; identical to SEQ ID NO: 12702

SEQ ID NO: 12885 - protein, 745 aa, Leptospira interrogans serovar Bataviae str. UI 08561
MKRNKQSIFIGHILRKDDGNFVEHLLDDHLYSVAELTEKFCEKFGAGTFGYLIGLWHDLGKFKLEFQERIRIRSGHIGEEAHLEGKTAKSVKHSVSGAIHCFNKFKQSDIIKKLICLPILCHHSGLKNFGIDVDIQLNEEREILALSETTPHIPQEILDGIDLKQLGKSFKDHSLLIRILFFALIDADRLDTERFMNPAKFKERYSKTIILQDLNIKLDKHLKNIQKQADTTKVNSIRKRILEEVQSKTNLKPGFYTLTVPTGGGKTLTSLSFALKHCITNKMDRVIYGVPYLSIIEQTTDVFKKILGEDSVLEHHSGIDISKEKENSINRLLTENWDHPLIVTTNVQLFESLFSSKTTKVRKLHNIINSVIILDEAQMIPPQFLQPIVKTLKELVEFYNVTIILCTATQPTLSSIKSIDLNFDGINTAIELAPEPEKLFQELKRVIIHKPEERKLSFIEIATKISNYDQVLTIVNRKSDSSGIFNQLTGNKYYLTTNLCAEHRRDILKKVKSHLSNGESVYLVSTQLIEAGVDIDFPIVFRAVAGLDSIAQAVGRCNREGKLVDENGQEKLGEVFLFHPEQDPPSGHLLQTKQASEDCIKNFEELIHPDTLKQYFNTLFWLKQDKGLDKEEIEKDKRSFQFETINKNFKLIDEDSRPVIVPYKEGKDLIVQLQNSVVQNNFVDYKLIRKSQRYTVNLKTNLYNKLLSEGIISEIEGIIGILNFDSYYHNDLGILESPNDQDLII

SEQ ID NO: 12886 - protein, 752 aa, Leptospira interrogans serovar Bataviae str. UI 08561; identical to SEQ ID NO: 12649

SEQ ID NO: 12887 - protein, 745 aa, Leptospira interrogans str. UI 09600; identical to SEQ ID NO: 12711

SEQ ID NO: 12888 - protein, 750 aa, Leptospira interrogans str. UI 09600; identical to SEQ ID NO: 12712

SEQ ID NO: 12889 - protein, 745 aa, Leptospira interrogans serovar Grippotyphosa str. UI 12764
MKRNKQSIFIGHILRKDDGNFVEHLLDDHLYSVAELTEKFCEKFGAGTFGYLIGLWHDLGKFKLEFQERIRIRSGHIGEEAHLEGKTAKSVKHSVSGAIHCFNKFKQSDIIKKLICLPILCHHSGLKNFGIDVDIQLNEEREILALSETTPRIPQEILDGIDLKQLGKSFKDHSLLIRILFFALIDADRLDTERFMNPAKFKERYSKTIILQDLNIKLDKHLKNIQKQADTTKVNSIRKRILEEVQSKTNLKPGFYTLTVPTGGGKTLTSLSFALKHCITNKMDRVIYGVPYLSIIEQTTDVFKKILGEDSVLEHHSGIDISKEKENSINRLLTENWDHPLIVTTNVQLFESLFSSKTTKVRKLHNIINSVIILDEAQMIPSQFLQPIVKTLKELVEFYNVTIILCTATQPTLSSIKSIDLNFDGINTAIELAPEPEKLFQELKRVIIHKPEERKLSFIEIATKISNYDQVLTIVNRKSDSSGIFNQLTGNKYYLTTNLCAEHRRDILKKVKSHLSNGESVYLVSTQLIEAGVDIDFPIVFRAVAGLDSIAQAVGRCNREGKLVDENGQEKLGEVFLFHPEQDPPSGHLLQTKQASEDCIKNFEELIHPDTLKQYFNTLFWLKQDKGLDKEEIEKDKRSFQFETINKNFKLIDEDSRPVIVPYKEGKDLIVQLQNSVVQNNFVDYKLIRKSQRYTVNLKTNLYNKLLSEGIISEIEEIIGILNFDSYYHNDLGILESPNDQDLII

SEQ ID NO: 12890 - protein, 752 aa, Leptospira interrogans serovar Grippotyphosa str. UI 12764; identical to SEQ ID NO: 12649

SEQ ID NO: 12891 - protein, 752 aa, Leptospira interrogans serovar Grippotyphosa str. UI 12769; identical to SEQ ID NO: 12739

SEQ ID NO: 12892 - protein, 931 aa, Leptospira weilii str. UI 13098
MKSEEKSYYKYWGKANKEGNYHLLVYHCFDVAAVGEVYLSQNETLCVHFSQKLGIDPLTFKNLFVFFLILHDLGKFSDCFQSLIPDIKSAFGNSNSPIGPYSIRHDSLGYIFWGKWILKDERFGNYNGLLTEQNWLGWNGLQSSKDKSYFTEFTDVLIRCVTGHHGRPPSKNGYSGQTAVSPDSHFTETDRLAALDFSKEVNRILSPNLYFKGNFKTLYDSTLQISFWLAGLSVLCDWIGSNAEIFKYHTTPIDLEEYYTTISLNNASKAVKKSGILPSKITLNGNHFGIFEYLQEPTPLQKFCSEVVLPDSPSLFILEDVTGSGKTEAALILTHRLMQKNTYSGFYVGLPTMATANGMYRRMSSVYRNLYTKESLPSLVLAHGARNLSDSFQSSVISDNAILSDRNYSFQSEKNQEESASAICNIWLSDNQKKSLLADAGVGTIDQALLSVLSAKFQSLRMFGLSRKVLILDEVHSYDPYMVELICCLLKAQAKIGASVILLSATLPKILRKTFSESFALGLDTELQDIKSEEYPLVSLISDRPVVEETPISTRKEVSRKLNVKFFFNQEQVLQKILEISNQGRCVCWIRNTVSDASQAFSFLHSKLGDRVTLFHSRFAMGDRLNIESQILENFGIQSDQISRKGKVVVATQVVEQSLDLDFDCIITDLAPIDLILQRAGRLYRHSRDISGNIKQGLDERGVPILWIFSPEPIDDPKSDWFSRFSRGGSMVYSDHGKLWLTARLLQERKGWRMPEDARNLIESVYGTNVMVPQSFQENQSKVENDKKKRESAAALSTIRLELGYDSTLNETSWDDSKFSTRYGIDNSTKVVLAKFVSDRLVPWISDTNRDWQNSELPVPNYLVEKEFIFENSNLSEVISHCKKNLPDKGKHCVLLPLFYANNSWRGKALNKKNEVVSLTYDERFGFRKEK

SEQ ID NO: 12893 - protein, 745 aa, Leptospira interrogans serovar Medanensis str. UT053; identical to SEQ ID NO: 12647

SEQ ID NO: 12894 - protein, 750 aa, Leptospira interrogans serovar Medanensis str. UT053; identical to SEQ ID NO: 12744

SEQ ID NO: 12895 - protein, 617 aa, Leptospira interrogans serovar Pomona str. UT364
MILLAKSYPGIEKQLKSGDPESWALLEHHSSATYQVAEVLLKILEPILRKWTRLSESEYNKFVLVVCLSAGLHDLGKANEDFQKMLQRRKYLQRFRHEIWSVLALTGSGPFSDWFRKTIGDETWVRIGQMGILSHHLKATRETLYADHETAEIKVFWKDQGVIKMFQSICRLAGISSPDFSSPSISSYTCLGEDADKSIRIWTREILNARIDPRYQHSIGAVRAMIIAADRLASAYKGADALKLWAEEALNRVLSEQECSKIVKQGLGEKNLRPFQKQVGDSTSRVTLVRAGCGNGKTIAAFQWAKTHSAGRKLFFCYPTMGTATEGFRDYVSDIPGLDALLSHSRASLDLGELASTGEEDEGDSLNMHSRMLQEWTAQVTFCTVDQILGLLQNYRSSLTLSPAIFLGAFVFDEIHMYDSILFGNLLTFLKEFSHTSILLMTASLPETMLSAIQETVGADLGPVISGEAQIEERLRYRILHSSREDALQKAIQEFKNGGRVLWVCNKVEHCLKLYDELSEKYDIEALVYHSRFKYEDRKERHRAVIDSFQEGYKKSLPVFAITTQVCEVSLDISATLLISELCPFAALIQRLGRVNRPGQEMEGIAQVLIIPFQGKP

SEQ ID NO: 12896 - protein, 745 aa, Leptospira interrogans serovar Pomona str. UT364; identical to SEQ ID NO: 12647

SEQ ID NO: 12897 - protein, 671 aa, Leptospira interrogans serovar Icterohaemorrhagiae str. Verdun HP
MILLAKSYPGIEKQLKSGDPESWALLEHHSSATYQVAEVLLKILEPILRKWTRLSESEYNKFVLVVCLSAGLHDLGKANEDFQKMLRRRKYLQRFRHEIWSVLALTGSGPFSDWFRKTIGDETWVRIGQMGILSHHLKATRETLYADHETAEIKVFWKDQGVIKMFQSICRLAGISSPDFSSPSISSYTCLGEDADKSIRIWTREILNARIDPRYQHSIGAVRAMIIAADRLASAYKGADALKLWATEALNRVLSEQECSKIVKQGLGEKNLRPFQKQVGDSTSRVTLVRAGCGNGKTIAAFQWAKTHSAGRKLFFCYPTMGTATEGFRDYVSDIPGLDALLSHSRASLDLGELASTGEEDEGDSLNMHSRMLQEWTAQVTFCTVDQILGLLQNYRSSLTLSPAIFLGAFVFDEIHMYDSILFGNLLTFLKEFSHTSILLMTASLPETMLSAIQETVGADLGPVISGEAQIEERLRYRILHSSREDALQKAIQEFKNGGRVLWVCNKVEHCLKLYDELSEKYDIEALVYHSRFKYEDRKERHRAVIDSFQEGYKKSLPVFAITTQVCEVSLDISATLLISELCPFAALIQRLGRVNRPGQEMEGIAQALIIPFQGKPYEKENEDDGESELERCKEILKPLLDRELSQKDLALALENAKGTEHQKYRPNGFR

SEQ ID NO: 12898 - protein, 796 aa, Leptospira borgpetersenii str. Noumea 25
MSWNGLRSSKDKSYFTEFLDVLIRCVTGHHGRPPSKNGYSGQTAVSLDSHFTEADRSAALDFSKEVNRILSPNLNFDGDFKTLYNSALRISFWLAGLSVLCDWIGSNAEIFKYHQTPIDLEEYYTKISLKRALEAINRSGLLPSKITFNKDHFRIFEYLREPTPLQKFCSEVAIPDSPSLFILEDVTGSGKTEAALILTHRLMQKSAYSGFYVGLPTMATANGMYQRMSGVYRNLYTKESIPSLVLAHGARNLSDSFQSSVISDNAILADRNYSLQLDKDPEESASAICNIWLSDNQKKSLLADAGVGTIDQALLSILSTKFQSLRMFGLSRKVLILDEVHSYDPYMVELICCLLKAQAKIGASVILLSATLPKILRKTFSESFALGLDTELQDLKSVEYPLVSLISDRSEVEEIPISTRKEVSRKLNVKFLFNQEQVLQKILEMSNQGRCVCWIRNTVSDASQAFSFLHSKLGDQVILFHSRFVMGDRLNIESQILENFGVRSDQNSRKGKVVVATQVVEQSLDLDFDCIITDLAPIDLILQRAGRLHRHCRDIFGNAKQGLDERGEPILWIFSPEPIEDPTSNWFSQFSRGGSMVYSDHGRLWLTARLLQERKGWRMPEDARNLIESVYGIDVEIPQSFRENQFKVKNDKKKLESAAALSTIHLELGYDSTLNETSWDDSKFSTRYGIDNSSKAVLAKFVSDRLVPWISGTTRDWQNSELPVPNYLVEKEFIFENLNFSEVISNCKKNLPDKGKHCVLLPLFYTNNSWRGKALNKKNEVVSFTYDERFGFRKEK

SEQ ID NO: 12899 - protein, 758 aa, Leptospira santarosai str. CBC523
MEKLLAKSLSGDPRDNEQELYLVPHLRAAEEAGSAIYESIGERILKAVGLPSIIWSKRLKILLPLACLLHDLGKANNWFQELLRGMKIYQPIRHEFLSVIMILRSTKKIQNYLKEKIHVLETSEDKTPFINSIYSGILAHHMKMDIDLKRACPALFANGGTPTEIIAYTNASDFDSLFGPDKPTNDFCFTFLSSHANDKYKPIHRWIDEFQKISCEWEGFLKENNDWHIFSTILKPLVISADVIASALVPKGIEYKDWVIKSLQNYIEQNDINQIVKERLHGKSPREFQRQIANSEERITLVEAGCGSGKTIGAYLWAANNALDSKLFFCYPTTGTATEGYLGYVSDSSYESKLIHSKSQVDLEGIHKTGDEDSTELTDKIHALHSYHPKIIICTADTILSLIKNGRKSILSFPSIATGIFVFDEIHSYNDEMFLVMVRFIQFFKNTKFLLMSASLQPERKNVLKREFINFQEIESPTDLMDIPRYKFEEIRDSKTLSEDIKRHAGHSKILVVVNTVKRAQSIYRDLKSSGLNVKIYHSRYKYKDRVIRHREFIAAFKDEAPPVVGIATQVAEMSLDIDSDILFCELAPIPSIIQRLGRLNRRTAPDNQLPARSVYFSRPEKPLPYDKEELELAEQWIEILRNSKDEISQNDLQEFFLNIKTETADLFPPVYYDFNKPTFYFTPATEGLRGASSTVNCILRSDLLEIDQSPYTIANYIIPMTMNRKVDFTILDQYKYAFVIPDEKILYDSLEGAQWLN

SEQ ID NO: 12900 - protein, 932 aa, Leptospira santarosai str. CBC523
MEAEEKSYYKYWGKADQEGNYHLLVYHCLDVAAVGEVYLSQNETLCVHLSQKLGIDPPTFKNLFVFFLVLHDLGKFSDCFQSLIPNIKRILGNSNSPIGPYSVRHDSLGYIFWGEWILKDKRFGNYDGLLTEQNWLGWNGLRSSKEKSYFTEFLDVLIRCVTGHHGRPPSKNGYSGQTAVSPDSHFIEADRSAALAFCKEVNRIFSPNFEGDFKSLFDSTLPISFWLAGLSVLCDWIGSNSEIFKYHRTPIDLEEYYTTISLINAQKAVLKSGLSSAKIAFNENHFRIFEYLREPTPLQKFCSEVVLPDSPSLFILEDVTGSGKTEAALILTHRLMQKNAYSGFYVGLPTMATANGMYRRMSGVYRNLYTKESLPSLILAHGARNLSDSFQSSVISDNAILADRNYQSDKDPEESATAICNIWLSDNQKKSLLADAGVGTIDQALLSVLSAKFQSLRMFGLSRKVLILDEVHSYDPYMVELICCLLKAQAKIGASVILLSATLPKILRKRFSDSFALGLDTELQDIKSGEYPLVSLVSNRFEVEETPIPTRKEVGRKLNVEFLFDQETVFQKILEMSNQGRCVCWIRNTVSEASQAFFFLHSKLGDRVILFHSRFAMGDRLNIESQILENFGVRSDQKSRKGKVVVATQVVEQSLDLDFDCIFTDLAPIDLILQRAGRLHRHSRDIFGNVKQGLDERGEPLLWIFSPEPIDDPTSNWFSQFSRGGGMVYSDHGKLWLTAKLLHERKGWKMPEDARNLIESVYGVDVKVPHSFRENRSKVENDRKKQESAAVLSTIRLELGYDSTSNETSWDDSKFSTRYGIGNSTKVVLAKFVSDRLVPWISGTSRDWQNSELPVPNYLVEKEFIFENSNVSEVISDCKKNLPDKGKHCVLLPLFYANDFWRGKAFNKKNEVVSFTYDERFGFRKEQLRGIV

SEQ ID NO: 12901 - protein, 750 aa, Leptospira interrogans serovar Copenhageni str. HAI0188; identical to SEQ ID NO: 11551

SEQ ID NO: 12902 - protein, 758 aa, Leptospira santarosai str. HAI134
MEKLLAKSLSGDPRDNEQELYLVPHLRAAEEAGSAIYESIGERILKAVGLPSIIWSKRLKILLPLACLLHDLGKANNWFQELLRGMKIYQPIRHEFISVIMILRSTKKIQNYLKEKIHVLETSENKTPFINSIYSGILAHHMKMDIDLKRACPALFANGGTPTEIIAYTNASDFDSLFGPDKPTNDFCFTFLSSHANDKYKPIHRWIDEFQKISCEWEEFLKENNDWHIFSTILKPLVISADVIASALVPKGIEYKDWVIKSLQNYIEQNDINQIVKERLHGKSPREFQRQIANSEERITLVEAGCGSGKTIGAYLWAANNALDSKLFFCYPTTGTATEGYLGYVSDSSYESKLIHSKSQVDLEGIHKTGDEDSTELTDKIHALHSYHPKIIICTADTILSLIKNGRKSILSFPSIATGIFVFDEIHSYNDEMFLVMVRFIQFFKNTKFLLMSASLQPERKNVLKREFINFQEIESPTDLMDIPRYKFEEIRDSKTLSEDIKRHAGHSKILVVVNTVKRAQSIYRDLKSSGLNVKIYHSRYKYKDRVIRHREFIAAFKDEAPPVVGIATQVAEMSLDIDSDILFCELAPIPSIIQRLGRLNRRTALDNQLPARSVYFSRPEKPLPYDKEELELAEQWIEILRNSKDEISQNDLQEFFLNIKTETADLFPPVYYDFNKPTFYFTPATEGLRGASSTVNCILRSDLLEIDQSPYNIANYIIPMTMNRKVDFTILDQYKYAFVIPDEKILYDSLEGAQWLN

SEQ ID NO: 12903 - protein, 932 aa, Leptospira santarosai str. HAI134
MEAEEKSYYKYWGKADQEGNYHLLVYHCLDVAAVGEVYLSQNETLCVHLSQKLGIDFPTFKNLFVFFLVLHDLGKFSDCFQSLIPNIKRILGNSNSPIGPYSVRHDSLGYIFWGEWILKDKRFGNYDGLLTEQNWLGWNGLRSSKEKSYFTEFLDVLIRCVTGHHGRPPSKNGYSGQTAVSPDSHFTEADRSAALAFCKEVNRIFSPNFEGDFKSLFDSTLPISFWLAGLSVLCDWIGSNSEIFKYHRTPIDLEEYYTTISLINAQKTVLKSGLSSAKIAFNENHFRIFEYLREPTPLQKFCSEVVLPDSPSLFILEDVTGSGKTEAALILTHRLMQKNAYSGFYVGLPTMATANGMYRRMSGVYRNLYTKESLPSLILAHGARNLSDSFQSSVISDNAILADRNYQSDKDPEESATAICNIWLSDNQKKSLLADAGVGTIDQALLSVLSAKFQSLRMFGLSRKVLILDEVHSYDPYMVELICCLLKAQAKIGASVILLSATLPKILRKRFSDSFALGLDTELQDIKSGEYPLVSLVSNRFEVEETPIPTRKEVGRKLNVEFLFDQETVFQKILEMSNQGRCVCWIRNTVSEASQAFFFLHSKLGDRVILFHSRFAMGDRLNIESQILENFGVRSDQKSRKGKVVVATQVVEQSLDLDFDCIFTDLAPIDLILQRAGRLHRHSRDIFGNVKQGLDERGEPLLWIFSPEPIDDPTSNWFSQFSRGGGMVYSDHGKLWLTAKLLHERKGWKMPEDARNLIESVYGVDVKVPHSFRENRSKVENDRKKQESAAVLSTIRLELGYDSTSNETSWDDSKFSTRYGIGNSTKVVLAKFVSDRLVPWISGTSRDWQNSELPVPNYLVEKELIFENSNVSEVISDCKKNLPDKGKHCVLLPLFYANDFWRGKAFNKKNEVVSFTYDERFGFRKEQLRGIV

SEQ ID NO: 12904 - protein, 745 aa, Leptospira interrogans serovar Bataviae str. HAI135
MIKEKQSIFLAHVLRKDDGSFVEHLIDDHLYSVAEFTKKFCEKFEAGTVGYLIGFWHDLGKFKLEFQERIRIRSGHIGEEAHLEGKTAKSVKHSVSGAIHCFNKFKKSDIIKKLICLPILCHHSGLKNFGIDVDIQLNDEKEISAWSKTISHIPQQILDGIDLKQLGRSFKDFSLLIRMLFSALIDADRLDTERFMDLSKFKERYSKTIILQDLNIKLDKHLNEIQKQADVTKVNSTRKRILEEVQSKTNLKPGFYTLTVPTGGGKTLTSLSFALKHCIANKMDRVIYGVPYLSIIEQTADIFKKILGEDSVLEHHSGIDISKEKENSINRLLTENWDHPLIVTTNVQLFESLFSSKTTKVRKLHNIINSVIILDEAQMIPPQFLQPIVKNLKELVEYYNVTIILCTATQPTLSSIKSTDLNFDGIDTTIELAPEPEKLFQKLKRVIIHKPEEKKLSFIEVATRILNYDQVLTIVNRKSDASGIFNELTGNKYYLTTNLCAEHRRDILKKVKSHLDNGESVYLVSTQLIEAGVDIDFPIVFRAVGGLDSIAQAAGRCNREGKLLDKNGQEKLGEVFLFHLEQDPPSGHLLQTKQASEDCIKNFEELIHPDALKQYFNTLFWLKQNKGLDKEEIEELKINLQFETINEKFKLVDEDSRPVIVPYKEGKDIIIQLQNSAIKNNFLDYKLIRKSQRYTVNLKTNLYNKLLSEGIISEIEGIIGILNFDSYYYNDLGILESPNEQDLII

SEQ ID NO: 12905 - protein, 759 aa, Leptospira santarosai str. HAI821
MMEKLLAKSLSGDPRDNEQELYLVPHLRAAEEAGSAIYESIGERILKAVGLPSIIWSKRLKILLPLACLLHDLGKANNWFQELLRGMKIYQPIRHEFLSVIMILRSTKKIQNYLKEKIHVLETSEDKTPFINSIYSGILAHHMKMDIDLKRACPALFANGGTPTEIIAYTNASDFDSLFGPDKPTNDFCFTFLSSHANDKYKPIHRWIDEFQKISCEWEEFLKENNDWHIFSTILKPLVISADVIASALVPKGIEYKDWVIKSLQNYIEQNDINQIVKERLHGKSPREFQRQIANSEERITLVEAGCGSGKTIGAYLWAANNALNSKLFFCYPTTGTATEGYLGYVSDSNYESKLIHSKSQVDLEGIHKTGDEDSTELTDKIHALHSYHPKIIICTADTILSLIKNGRKSILSFPSIATGIFVFDEIHSYNDEMFLVMVRFIQFFKNTKFLLMSASLQPERKNVLKREFINFQEIESPTDLMDIPRYKFEEIRDSKTLSEDIKRHAGHSKILVVVNTVKRAQSIYRDLKSSGLNVKIYHSRYKYKDRVIRHREFIAAFKDEAPPVVGIATQVAEMSLDIDSDILFCELAPIPSIIQRLGRLNRRTAPDNQLPARSVYFSRPEKPLPYDKEELELAEQWIEILRNSKDEISQNDLQEFFLNIKTKTADLFPPVYYDFNKPTFYFTPATEGLRGASSTVNCILRSDLLEIDQSPYNIANYVIPMTMNRKVDFTILDQYKYAFVIPDEKILYDSLEGAQWLN

SEQ ID NO: 12906 - protein, 932 aa, Leptospira santarosai str. HAI821
MEAEEKSYYKYWGKADQEGNYHLLVYHCLDVAAVGEVYLSQNETLCVHLSQKLGIDSPTFKNLFVFFLVLHDLGKFSDCFQSLIPNIKRILGNSNSPIGPYSVRHDSLGYIFWGEWILKDKRFGNYDGLLTEQNWLGWNGLRSSKEKSYFTEFLDVLIRCVTGHHGRPPSKNGYSGQTAVSPDSHFIEADRSAALAFCKEVNRIFSPNFEGDFKSLFDSTLPISFWLAGLSVLCDWIGSNSEIFKYHRTPIDLEEYYTTISLINAQKAVLKSGLSSAKIAFNENHFRIFEYLREPTPLQKFCSEVVLPDSPSLFILEDVTGSGKTEAALILTHRLMQKNAYSGFYVGLPTMATANGMYRRMSGVYRNLYTKESLPSLILAHGARNLSDSFQSSVISDNAILADRNYQSDKDPEESATAICNIWLSDNQKKSLLADAGVGTIDQALLSVLSAKFQSLRMFGLSRKVLILDEVHSYDPYMVELICCLLKAQAKIGASVILLSATLPKILRKRFSDSFALGLDTELQDIKSGEYPLVSLVSNRFEVEETPIPTRKEVGRKLNVEFLFDQETVFQKILEMSNQGRCVCWIRNTVSEASQAFFFLHSKLGDRVILFHSRFAMGDRLNIESQILENFGVRSDQKSRKGKVVVATQVVEQSLDLDFDCIFTDLAPIDLILQRAGRLHRHSRDIFGNVKQGLDERGEPLLWIFSPEPIDDPTSNWFSQFSRGGGMVYSDHGKLWLTAKLLHERKGWKMPEDARNLIESVYGVDVKVPHSFRENRSKVENDRKKQESAAVLSTIRLELGYDSTSNETSWDDSKFSTRYGIGNSTKVVLAKFVSDRLVPWISGTSRDWQNSELPVPNYLVEKEFIFENSNVSEVISDCKKNLPDKGKHCVLLPLFYANDFWRGKAFNKKNEVVSFTYDERFGFRKEQLRGIV

SEQ ID NO: 12907 - protein, 750 aa, Leptospira interrogans str. MMD3731; identical to SEQ ID NO: 11551

SEQ ID NO: 12908 - protein, 745 aa, Leptospira noguchii serovar Autumnalis str. ZUN142
MIKEKQSIFLAHVLRKDDGSFVEHLIDDHLYSVAEFTKKFCEKFEAGTVGYLIGFWHDLGKFKLEFQERIRIRSGHIGEEAHLEGKTAKSVKHSVSGAIHCFNKFKKSDIIKKLICLPILCHHSGLKNFGIDVDIQLNDEKEISAWSKTISHIPQQILDGIDLKQLGRSFKDFSLLIRMLFSALIDADRLDTERFMDLSKFQERYSKTINLQDLNIKLDKHLNEIQKQADATKVNSTRKRILEEVQSKTNLKPGFYTLTVPTGGGKTLTSLSFALKHCIANKMDRVIYGVPYLSIIEQTADIFKKILGEDSVLEHHSGIDISKEKENSINRLLTENWDHPLIVTTNVQLFESLFSSKTTKVRKLHNIINSVIILDEAQMIPPQFLQPIVKTLKELVEYYNVTIILCTATQPTLSSIKSTDLNFDGIDTTIELAPEPEKLFQKLKRVIIHKPEEKKLSFIEVATRILNYDQVLTIVNRKSDASGIFNELTGNKYYLTTNLCAEHRRDILKKVKSHLDNKESVYLVSTQLIEAGVDIDFPIVFRAVAGLDSIAQAAGRCNREGKLLDKNGQEKLGEVFLFYPEQDPPSGHLLQTKQASEDCIKNFEELIHPDALKQYFNTLFWLKQNKGLDKEEIEELKINLQFETINEKFKLVDEDSRPVIVPYKEGKDIIIQLQNSAIKNNFLDYKLIRKSQRYTVNLKTNLYNKLLSEGIISEIEGIIRILNFDSYYYNDLGILESPNEQDLII

SEQ ID NO: 12909 - protein, 932 aa, Leptospira santarosai str. ZUN179
MEAEEKSYYKYWGKADQEGNYHLLVYHCLDVAAVGEVYLSQNETLCVHLSQKLGIDPPTFKNLFVFFLVLHDLGKFSDCFQSLIPNIKRILGNSNSPIGPYSVRHDSLGYIFWGEWILKNKRFGNYDGLLTEQNWLGWNGLRSSKEKSYFTEFLDVLIRCVTGHHGRPPSKNGYSGQTAVSPDSHFTEADRSAALAFCKEVNRVFSPNFEGDFKSLFDSTLPMSFWLAGLSVLCDWIGSNSEIFKYHRTPIDLEEYYTTISLINAQKAVLKSGLSSAKIAFNENHFRIFEYLREPTPLQKFCSEVVLPDSPSLFILEDVTGSGKTEAALILTHRLMQKNAYSGFYVGLPTMATANGMYRRMSGVYRNLYTKESLPSLILAHGARNLSDSFQSSVISDNAILADRNYQSDKDPEESATAICNIWLSDNQKKSLLADAGVGTIDQALLSVLSAKFQSLRMFGLSRKVLILDEVHSYDPYMVELICCLLKAQAKIGASVILLSATLPKILRKRFSDSFALGLDTELQDIKSGEYPLVSLVSNRFEVEETPISTRKEVGRKLNVEFLFDQETVFQKILEMSNQGRCVCWIRNTVSEASQAFFFLHSKLDDRVILFHSRFAMGDRLNIESQILENFGVRSDQKSRKGKVVVATQVVEQSLDLDFDCIFTDLAPIDLILQRAGRLHRHSRDIFGNVKQGLDERGEPLLWIFSPEPIDDPTSNWFSQFSRGGGMVYSDHGKLWLTAKLLHERKGWKMPEDARNLIESVYGVDVKVPHSFLENRSKVENDRKKQESAAVLSTIRLELGYDSTSNETSWDDSKFSTRYGIGNSTKVVLAKFVSDRLVPWISGTSRDWQNSELPVPNYLVEKEFIFENSNISEVISDCKKNLPDKGKHCVLLPLFYANDFWRGKAFNKKNEVVSFTYDERFGFRKEQLRGIV

SEQ ID NO: 12910 - protein, 945 aa, Leptospira mayottensis 200901116
MQKEKSIRHSKHRESMKAEEKSYYKYWGKANKKGDYHLLVYHCFDVAAVGEVYLSQNETLCVHFSQKLGIDLLTFKNIFVFFLILHDLGKFSDCFQSLIPNIKNALGNSNSPIGPYSIRHDSLGYIFWGRCILKDERFGNYSGFLTEQNWLGWNELQSPKDKSYFTEFTDVLIRCVTGHHGRPPSKNGYSGQTAVSLDSHFTEADRLAALDFSKEANRILSPNLNFKGDLKTLYDSMFQISFWLAGLSVLCDWIGSNAEIFKYHTTPIDLEEYYTKISLNNALKAVNKSGILPSKIAFNENHFGIFEYLQEPTPLQKFCSEVVLPDSPSLFILEDVTGSGKTEAALILTHRLMQKNAYSGFYVGLPTMATANGMYQRMSGVYRNLYTKESLPSLVLAHGARNLSDSFQSSVISDNAILADRNYSLQSDKNPEESASAICNIWLSDNQKKSLLADSGVGTIDQALLSVLSTKFQSLRMFGLSRKVLILDEVHSYDPYMVELICCLLKTQAKIGASVILLSATLPKILRKTFSESFALGLDTELQNIKSGEYPLVSLISDRSEVEETPIPTRKEVSRKLNVKFLFKQEPVLQKILEMSNQGRCVCWIRNTVSDASQAFSFLHSKLGDQVVLFHSRFAMGDRLNIESQILENFGIRSDQKSRKGKIVVATQVVEQSLDLDFDYIITDLAPIDLILQRAGRLHRHCRDISGNVKQGLDERGEPLLWIFSPEPIDDPKSDWFSQFSRGGGMVYSDHGKLWLTARLLQERKGWKMPEDARNLIESVYGIDVEVPQSFQENQSKVKNDKKKQESSAVLSTIRLELGYSALNETSWDDSKFSTRYGIDNSSKVVLAKFVSDRLVPWISDTNRNWQNSELPVPNYLVEKEFIFENSNIAEVISNCKINLPDKGKHCVLLPLFYTNNSWRGKALNKNNEVVSFIYDERFGFRKEK

SEQ ID NO: 12911 - protein, 745 aa, Leptospira noguchii
MIKEKQSIFLAHVLRKDDGSFVEHLIDDHLYSVAEFTKKFCEKFETGTVGYQNGLWHDLGKFKLEFQERIRIRSGHIGEEAHLEGKTAKSVKHSVSGAIHCFNKFKKSDIIKKLICLPILCHHSGLKNFGIDVDIQLNDEREILALSETISHIPQQILDGIELKQLGRSFKDTSLLIRMLFSALIDADRLDTERFMDLSKFKERYSKTINLQDLNIKLDKHLNEIQKQANATKVNSTRKRILEEVQSKTSIKPGFYTLTVPTGGGKTLTSLSFALKHCIANKMDRVIYGVPYLSIIEQTADIFKKILGEDSVLEHHSGIDISKEKENSINRLLTENWDHPLIVTTNVQLFESLFSSKTTKVRKLHNIINSVIILDEAQMIPPQFLQPIVKTLKELVEYYNVTIILCTATQPTLSSIKSTDLNFDGIDTTIELAPEPEKLFQKLKRVIIHKPEEKKLSFIEVATRILNYDQVLTIVNRKSDASGIFNQLTGNKYYLTTNLCAEHRRDILKKVKSHLYNGESVYLISTQLIEAGVDIDFPIVFRAVAGLDSIAQAAGRCNREGKLLDKNGQEKLGEVFLFYPEQDPPSGHLLQTKQASEDCIKNFEELIHPDALKQYFNTLFWLKQNKGLDKEKIEELKINLQFETINEKFKLVDEDSRPVIVPYKEGKDIIIQLQNSATKNNFLDYKLIRKSQRYTVNLKTNLYNKLLFEGIISEIEGIIGILNFDSYYHNDLGILESPNEQDLII

SEQ ID NO: 12912 - protein, 932 aa, Leptospira santarosai str. CBC1416
MEAEEKSYYKYWGKADQEGNYHLLVYHCLDVAAVGEVYLSQNETLCVHLSQKLGIDPPTFKNLFVFFLVLHDLGKFSDCFQSLIPNIKRILGNSNSPIGPYSVRHDSLGYIFWGEWILKDKRFGNYDGLLTEQNWLGWNGLRSSKEKSYFTEFLDVLIRCVTGHHGRPPSKNGYSGQTAVSPDSHFTEADRSAALAFCKEVNRIFSPNFEGDFKSLFDSTLPISFWLAGLSVLCDWIGSNSEIFKYHRTPIDLEEYYTTISLINAQKAVLKSGLSSAKIAFNENHFRIFEYLREPTPLQKFCSEVVLPDSPSLFILEDVTGSGKTEAALILTHRLMQKNAYSGFYVGLPTMATANGMYRRMSGVYRNLYTKESLPSLILAHGARNLSDSFQSSVISDNAILADRNYQSDKDPEESATAICNIWLSDNQKKSLLADAGVGTIDQALLSVLSAKFQSLRMFGLSRKVLILDEVHSYDPYMVELICCLLKAQAKIGASVILLSATLPKILRKRFSDSFALGLDTELQDIKSGEYPLVSLVSNRFEVEETPIPTRKEVGRKLNVEFLFDQETVFQKILEMSNQGRCVCWIRNTVSEASQAFFFLHSKLGDRVILFHSRFAMGDRLNIESQILENFGVRSDQKSRKGKVVVATQVVEQSLDLDFDCIFTDLAPIDLILQRAGRLHRHSRDIFGNVKQGLDERGEPLLWIFSPEPIDDPTSNWFSQFSRGGGMVYSDHGKLWLTAKLLHERKGWKMPEDARNLIESVYGVDVKVPHSFRENRSKVENDRKKQESAAVLSTIRLELGYDSTSNETSWDDSKFSTRYGIGNSTKVVLAKFVSDRLVPWISGTSRDWQNSELPVPNYLVEKEFIFENSNVSEVISDCKKNLPDKGKHCVLLPLFYANDFWRGKAFNKKNEVVSFTYDERFGFRKEQLRGIV

SEQ ID NO: 12913 - protein, 758 aa, Leptospira santarosai str. CBC1416
MEKLLAKSLSGDPRDNEQELYLVPHLRAAEEAGSAIYESIGERILKAVGLPSIIWSKRLKILLPLACLLHDLGKANNWFQELLRGMKIYQPIRHEFLSVIMILRSTKKIQNYLKEKIHVLETSENKTPFINSIYSGILAHHMKMDIDLKRACPALFANGGTPTEIIAYTNASDFDSLFGPDKPTNDFCFTFLSSHANDKYKPIHRWIDEFQKISCEWEGFLKENNDWHIFSTILKPLVISADVIASALVPKGIEYKDWVIKSLQNYIEQNDINQIVKERLHGKSPREFQRQIANSEERITLVEAGCGSGKTIGAYLWAANNALDSKLFFCYPTTGTATEGYLGYVSDSSYESKLIHSKSQVDLEGIHKTGDEDSTELTDKIHALHSYHPKIIICTADTILSLIKNGRKSILSFPSIATGIFVFDEIHSYNDEMFLVMVRFIQFFKNTKFLLMSASLQPERKNVLKREFINFQEIESPTDLMDIPRYKFEEIRDSKTLSEDIKRHAGHSKILVVVNTVKRAQSIYRDLKSSGLNVKIYHSRYKYKDRVIRHREFIAAFKDEAPPVVGIATQVAEMSLDIDSDILFCELAPIPSIIQRLGRLNRRTAPDNQLPARSVYFSRPEKPLPYDKEELELAEQWIEILRNSKDEISQNDLQEFFLNIKTKTADLFPPVYYDFNKPTFYFTPATEGLRGASSTVNCILRSDLLEIDQSPYNIANYVIPMTMNRKVDFTILDQYKYAFVIPDEKIFYDSLEGAQWLN

SEQ ID NO: 12914 - protein, 745 aa, Leptospira kirschneri str. 200803703
MTKDKQSIFIAHVLRKDDGSFVEHLIDDHLYSVAEFAKKFCEKFGAETFGYLIGLWHDLGKFKLEFQERIRIRSGHIGEEAHLEGKTAKSVKHSVSGAIHCLNKFKQSDIIKKLICLPILCHHSGLKNFGIDVDIQLNDEKEISALSETITCIPQQILDGIELKQLGKSFKDHSLLIRMLFSTLIDADRLDTERFMDLVKFKERYSKTIILQDLNIKLDKHLNDIQKQADATKVNSIRKRILEEVQSKTNLKPGFYTLTVPTGGGKTLTSLSFALKHCIENKMDRVIYGVPYLSIIEQTADVFKKILGENSVLEHHSGIDISKEKENSINRLLTENWDHPLIVTTNVQFFESLFSSKTTKVRKLHNIINSVIILDEAQMIPPQFLQPIVKTLKELVEYYNVTIILCTATQPTLSSIKSTDLNFDGIDTAIELAPEPEKLFQELKRVIIHKPEEKKLSFMEVATRILNYDQVLTIVNRKSDASGIFNQLTGNKYYLTTNLCAEHRRDILKKVKNHLNNGESVYLVSTQLIEAGVDIDFPIVFRAVAGLDSIAQAAGRCNREGKLLDENGQEKLGEVFLFKPEQDPPAGHLLQTEQASRDCIKNFEELIHPDTLKQYFNTLFWLKQDKGLDKEEIEKDKRSFQFETINKKFKLIDEDSRPVIVPYKEGKDLIVQLQNSVIQNNFLDYKLIRKSQRYTVNLKTNLYNKLLSEGIISEIEGIIGILTFGSYYHNDLGILESPNEQDLII

SEQ ID NO: 12915 - protein, 758 aa, Leptospira kirschneri str. 200803703; identical to SEQ ID NO: 12708

SEQ ID NO: 12916 - protein, 932 aa, Leptospira santarosai str. 200403458
MEAEEKSYYKYWGKADQEGNYHLLVYHCLDVAAVGEVYLSQNETLCVHLSQKLGIDPPTFKNLFVFFLVLHDLGKFSDCFQSLIPNIKRILGNSNSPIGPYSVRHDSLGYIFWGEWILKDKRFGNYDGLLTEQNWLGWNGLRSSKEKSYFTEFLDVLIRCVTGHHGRPPSKNGYSGQTAVSPDSHFTEADRSAALAFCKEVNRIFSPNFEGDFKSLFDSTLPISFWLAGLSVLCDWIGSNSEIFKYRRTPIDLEEYYTTISLINAQKAVLKSGLSSAKIAFNENHFRIFEYLREPTPLQKFCSEVVLPDSPSLFILEDVTGSGKTEAALILTHRLMQKNAYSGFYVGLPTMATANGMYRRMSGVYRNLYTKESLPSLILAHGARNLSDSFQSSVISDNAILADRNYQSDKDPEESATAICNIWLSDNQKKSLLADAGVGTIDQALLSVLSAKFQSLRMFGLSRKVLILDEVHSYDPYMVELICCLLKAQAKIGASVILLSATLPKILRKRFSDSFALGLDTELQDIKSGEYPLVSLVSNRFEVEETPISTRKEVGRKLNVEFLFDQETVFQKILEMSNQGRCVCWIRNTVSEASQAFFFLHSKLGDRVILFHSRFAMGDRLNIESQILENFGVRSDQKSRKGKVVVATQVVEQSLDLDFDCIFTDLAPIDLILQRAGRLHRHSRDIFGNVKQGLDERGEPLLWIFSPEPIDDPTSNWFSQFSRGGGMVYSDHGKLWLTAKLLHERKGWKMPEDARNLIESVYGVDVKVPHSFRENRSKVENDRKKQESAAVLSTIRLELGYDSTSNETSWDDSKFSTRYGIGNSTKVVLAKFVSDRLVPWISGTSRDWQNSELPVPNYLVEKEFIFENSNVSEVISDCKKNLPDKGKHCVLLPLFYANDFWRGKAFNKKNEVVSFTYDERFGFRKEQLRGIV

SEQ ID NO: 12917 - protein, 758 aa, Leptospira santarosai str. 200403458
MEKLLAKSLSGDPRDNEQELYLAPHLRAAEEAGSAIYESIGERILKAVGLPSIIWSKRLKILLPLACLLHDLGKANNWFQELLRGMKIYQPIRHEFLSVIMILRSTKKIQNYLKEKIHVLETSEDKTPFINSIYSGILAHHMKMDIDLKRACPALFANGGTPTEIIAYTNAPDFDSLFGPDKPTNDFCFTFLSSHANDKYKPIHRWIDEFQKISCEWEEFLKENNDWHIFSTILKPLVISADVIASALVPKGIEYKDWVIKSLQNYIEQNDINQIVKERLHGKSPREFQRQIANSEERITLVEAGCGSGKTIGAYLWAANNALNSKLFFCYPTTGTATEGYLGYVSDSNYESKLIHSKSQVDLEGIHKTGDEDSTELTDKIHALHSYHPKIIICTADTILSLIKNGRKSILSFPSIATGIFVFDEIHSYNDEMFLVMVRFIQFFKNTKFLLMSASLQPERKNVLKREFINFQEIESPTDLMDIPRYKFEEIRDSKTLSEDIKRHAGHSKILVVVNTVKRAQSIYRDLKSSGLNVKIYHSRYKYKDRVIRHREFIAAFKDEAPPVVGIATQVAEMSLDIDSDILFCELAPIPSIIQRLGRLNRRTAPDNQLPARSVYFSRPEKPLPYDKEELELAEQWIEILRNSKDEISQNDLQEFFLNIKTETADLFPPVYYDFNKPTFYFTPATEGLRGASSTVNCILRSDLLEIDQSPYTIANYIIPMTMNRKVDFTILDQYKYAFVIPDEKILYDSLEGAQWLN

SEQ ID NO: 12918 - protein, 758 aa, Leptospira kirschneri str. 200801925; identical to SEQ ID NO: 12708

SEQ ID NO: 12919 - protein, 745 aa, Leptospira kirschneri str. 200801925; identical to SEQ ID NO: 12707

SEQ ID NO: 12920 - protein, 765 aa, Leptospira kirschneri str. 200801774
MEKLLAKSRTQDGREISLQEHSFDTENAAISIFRKESRFLNNWLRFFKIRKEDEEKFLLNLRVTCLFHDIGKANDDFQKAVREKGFFHQGIRHEHLSAFVLHLPEIRKWLSQNKDLDIPIITSAVLCHHLKATDKNDHQYKWLTDPLRDFVILNLFHEEVKIILKKVNQFLKSDIDIPQLNYKTFSPEDENWKKTFQSGAKESGILGFRLDENRKQLHLAIKAALIVSDSASSGLVRENHLIEKWISKAIHSDEIKENEILKEIIQKRMDDKKILELHQFQKQVATKGDRVLLMAGCGMGKTLAAWNWANEVSKKQKISKVIFLYPTRGTATEGFKDYASWAPEADATLMHGTSDYELDSMFQNPDDEKSKRDFRISEADERLFAIAFWSKKFFSATADQFLSFLQNNYKGICLLPVLSECALIVDEVHSFDKAMFSSLLSFLKYFDLPILCMTATLTPKNKQSLLELDLEQYPKEEDRKELENLINLENHPRYNKTVLENAEQAKEIAIKSFREGKRVLWVLNTVDRCQKTYEELTEELQTEVHCYHSRFKLSDRKTVHENTVNAFQGSNLNSIAVTTQVCEMSLDLDADVLISEFAPVSSMVQRFGRANRHLKKGDEFRAELYLYEVVGSLKPYSSDEINAAKNFLNNLPEKDISQNLLATKLEEWSAQEYKTLPSASFIDGGYFALPSDYRDIEEFTTQAILDKDFPEVSQLLQSKKPIDPYILPVPDKRELNLRNEEHSLLPKYLKIVSRKYYNNKRGFAL

SEQ ID NO: 12921 - protein, 745 aa, Leptospira kirschneri str. 200801774
MTKDKQSIFIAHVLRKDDGSFVEHLIDDHLYSVAEFAKKFCEKFGAETFGYLIGLWHDLGKFKLEFQERIRIRSGHIGEEAHLEGKTAKSVKHSVSGAIHCLNKFKQSDIIKKLICLPILCHHSGLKNFGIDVDIQLNDEKEISALSETITCIPQQILDGIELKQLGKSFKDHSLLIRMLFSTLIDADRLDTERFMDLVKFKERYSKTIILQDLNIKLDKHLNDIQKQADATKVNSIRKRILEEVQSKTNLKPGFYTLTVPTGGGKTLTSLSFALKHCIENKMDRVIYGVPYLSIIEQTADVFKKILGENSVLEHHSGIDISKEKENSINRLLTENWDHPLIVTTNVQFFESLFSSKTTKVRKLHNIINSVIILDEAQMIPPQFLQPIVKTLKELVEYYNVTIILCTATQPTLSSIKSTDLNFDGIDTAIELAPEPEKLFQELKRVIIHKPEEKKLSFMEVATRILNYDQVLTIVNRKSDASGIFNQLTGNKYYLTTNLCAEHRRDILKKVKNHLNNGESVYLVSTQLIEAGVDIDFPIVFRAVAGLDSIAQAAGRCNREGKLLDENGQEKLGEVFLFKPEQDPPAGHLLQTEQASRDCIKNFEELIHPDTLKQYFNTLFWLKQDKGLDKEEIEKDKRSFQFETINKKFKLIDEDSRPVIVPYKEGKDLIVQLQNSVIQNNFLDYKLIRKSQRYTVNLKTNLYNKLLSEGIISEIEGIIGILTFDSYYHNDLGILESPNEQDLII

SEQ ID NO: 12922 - protein, 932 aa, Leptospira santarosai str. AIM
MEAEEKSYYKYWGKADQEGNYHLLVYHCLDVAAVGEVYLSQNETLCVHLSQKLGIDPPTFKNLFVFFLVLHDLGKFSDCFQSLIPNIKRILGNSNSPIGPYSVRHDSLGYIFWGEWILKDKRFGNYDGLLTEQNWLGWNGLRSSKEKSYFTEFLDVLIRCVTGHHGRPPSKNGYSGQTAVSPDSHFTEADRSAALAFCKEVNRIFSPNFEGDFKSLFDSTLPISFWLAGLSVLCDWIGSNSEIFKYRRTPIDLEEYYTTISLINAQKAVLKSGLSSAKIAFNENHFRIFEYLREPTPLQKFCSEVVLPDSPSLFILEDVTGSGKTEAALILTHRLMQKNAYSGFYVGLPTMATANGMYRRMSGVYRNLYTKESLPSLILAHGARNLSDSFQSSVISDNAILADRNYQSDKDPEESATAICNIWLSDNQKKSLLADAGVGTIDQALLSVLSAKFQSLRMFGLSRKVLILDEVHSYDPYMVELICCLLKAQAKIGASVILLSATLPKILRKRFSDSFALGLDTELQDIKSGEYPLVSLVSNRFEVEETPIPTRKEVGRKLNVEFLFDQETVFQKILEMSNQGRCVCWIRNTVSEASQAFFFLHSKLGDRVILFHSRFAMGDRLNIESQILENFGVRSDQKSRKGKVVVATQVVEQSLDLDFDCIFTDLAPIDLILQRAGRLHRHSRDIFGNVKQGLDERGEPLLWIFSPEPIDDPTSNWFSQFSRGGGMVYSDHGKLWLTAKLLHERKGWKMPEDARNLIESVYGVDVKVPHSFRENRSKVENDRKKQESAAVLSTIRLELGYDSTSNETSWDDSKFSTRYGIGNSTKVVLAKFVSDRLVPWISGTSRDWQNSELPVPNYLVEKEFIFENSNISEVISDCKKNLPDKGKHCVLLPLFYANDFWKGKAFNKKNEVVSFTYDERFGFRKEQLRGIV

SEQ ID NO: 12923 - protein, 758 aa, Leptospira santarosai str. AIM
MEKLLAKSLSGDPRDNEQELYLVPHLRAAEEAGSAIYESIGERILKAVGLPSIIWSKKLKILLPLACLLHDLGKANNWFQELLRGMKIYQPIRHEFLSVIMILRSTKKIQNYLKEKIHVLETSEDKTPFINSIYSGILAHHMKMDIDLKRACPALFANGGTPTEIIAYTNASDFDSLFGPDKPTNDFCFTFLSSHANDKYKPIHRWIDEFQKISCEWEEFLKENNDWHIFSTILKPLVISADVIASALVPKGIEYKDWVIKSLQNYIEQNDINQIVKERLHGKSPREFQRQIANSEERITLVEAGCGSGKTIGAYLWAANNALNSKLFFCYPTTGTATEGYLGYVSDSNYESKLIHSKSQVDLEGIHKTGDEDSTELTDKIHALHSYHPKIIICTADTVLSLIKNGRKSILSFPSIATGIFVFDEIHSYNDEMFLVMVRFIQFFKNTKFLLMSASLQPERKNVLKREFINFQEIESPTDLMDIPRYKFEEIRDSKTLSEDIKRHAGHNKILVVVNTVKRAQSIYRDLKSSGLNVKIYHSRYKYKDRVIRHREFIAAFKDEAPPVVGIATQVAEMSLDIDSDILFCELAPIPSIIQRLGRLNRRTALDNQLPARSVYFSRPEKPLPYDKEELELAEQWIEILRNSKDEISQNDLQEFFLNIKTETADLFPPVYYDFNKPTFYFTPATEGLRGASSTVNCILRSDLLEIDQSPYTIANYIIPMTMNRKVDFTILDQYKYAFVIPDEKIFYDSLEGAQWLN

SEQ ID NO: 12924 - protein, 922 aa, Leptospira noguchii str. 2001034031; identical to SEQ ID NO: 12866

SEQ ID NO: 12925 - protein, 745 aa, Leptospira noguchii str. 2001034031
MIKEKQSIFLAHVLRKDDGSFVEHLIDDHLYSVAEFTKKFCEKFEAGTVGYLIGFWHDLGKFKLEFQERIRIRSGHIGEEAHLEGKTAKSVKHSVSGAIHCFNKFKKSDIIKKLICLPILCHHSGLKNFGIDVDIQLNDEKEISAWSKTISHIPQQILDGIDLKQLGRSFKDFSLLIRMLFSALIDADRLDTERFMDLSKFKERYSKTIILQDLNIKLDKHLNEIQKQADATKVNSTRKRILEEVQSKTNLKPGFYTLTVPTGGGKTLTSLSFALKHCIANKMDRVIYGVPYLSIIEQTADIFKKILGEDSVLEHHSGIDISKEKENSINRLLTENWDHPLIVTTNVQLFESLFSSKTTKVRKLHNIINSVIILDEAQMIPPQFLQPIVKTLKEIVEYYNVTIILCTATQPTLSSIKSTDLNFDGIDTTIELAPEPEKLFQKLKRVIIHKPEEKRLSFIEVATRILNYDQVLTIVNRKSDASGIFNELTGNKYYLTTNLCAEHRRDILKKVKSHLYNGESVYLVSTQLIEAGVDIDFPIVFRAVAGLDSIAQAAGRCNREGKLLDKNGQEKLGEVFLFYPEQDPPSGHLLQTKQASEDCIKNFEELIHPDALKQYFNTLFWLKQNKGLDKEEIEELKINLQFETINEKFKLVDEDSRAVIVPYKEGKDIIIQLQNSAIKNKFLDYKLIRKSQRYTVNLKTNLYNKLLSEGIISEIEGIIGILNFDSYYYNDLGILESPNEQDLII

SEQ ID NO: 12926 - protein, 752 aa, Leptospira interrogans str. UI 13372; identical to SEQ ID NO: 12702

SEQ ID NO: 12927 - protein, 745 aa, Leptospira interrogans str. UI 13372
MKRNKQSIFIGHILRKDGGNFVEHLLDDHLYSVAELTEKFCEKFGAGTFGYLIGLWHDLGKFKLEFQERIRIRSGHIGEEAHLEGKTAKSVKHSVSGAIHCFNKFKQSDIIKKLICLPMLCHHSGLKNFGIDVDIQLNEEREILALSETTPHIPQEILDGIDLKQLGKSFKDHSLLIRMLFSALIDADRLDTERFMDPAKFKERYSKTIILQDLNIKLDKHLKNIQKQADTTKVNSIRKRILEEVQSKTNLKPGFYTLTVPTGGGKTLTSLSFALKHCITNKMDRVIYGVPYLSIIEQTTDVFKKILGEDSVLEHHSGIDISKEKENSINRLLTENWDHPLIVTTNVQLFESLFSSKTTKVRKLHNIINSVIILDEAQMIPPQFLQPIVKTLKEIVEFYNVTIILCTATQPTLSSIKSIDLNFDGINTAIELAPEPEKLFQELKRVIIHKSEERKLSFIEIATKISNYDQVLTIVNRKSDSSGIFNQLTGNKYYLTTNLCAEHRRDILKKVKSHLSNGESVYLVSTQLIEAGVDIDFPIVFRAVAGLDSIAQTVGRCNREGKLVDENGQEKLGEVFLFHPQQDPPSGHLLQTKQASEDCIKNFEELIHPDTLKQYFNTLFWLKQDKGLDKEEIEKDKRSFQFETINKNFKLIDKDSRPVIVPYKEGKDLIVQLQNSVVQNNFVDYKLIRKSQRYTVNLKTNLYNKLLSEGIISEIEGIIGILNFDSYYHNDLGILESPNDQDLII

SEQ ID NO: 12928 - protein, 758 aa, Leptospira santarosai str. 200702252; identical to SEQ ID NO: 12917

SEQ ID NO: 12929 - protein, 932 aa, Leptospira santarosai str. 200702252; identical to SEQ ID NO: 12916

SEQ ID NO: 12930 - protein, 932 aa, Leptospira santarosai str. HAI1380
MEAEEKSYYKYWGKADQEGNYHLLVYHCLDVAAVGEVYLSQNETLCVHLSQKLGIDPPTFKNLFVFFLVLHDLGKFSDCFQSLIPNIKRILGNSNSPIGPYSVRHDSLGYIFWGEWILKDKRFGNYDGLLTEQNWLGWNGLRSSKEKSYFTEFLDVLIRCVTGHHGRPPSKNGYSGQTAVSPDSHFTEADRSAALAFCKEVNRIFSPNFEGDFKSLFDSTLPISFWLAGLSVLCDWIGSNSEIFKYHRTPIDLEEYYTTISLINAQKAVLKSGLSSAKIAFNENHFRIFEYLREPTPLQKFCSEVVLPDSPSLFILEDVTGSGKTEAALILTHRLMQKNAYSGFYVGLPTMATANGMYRRMSGVYRNLYTKESLPSLILAHGARNLSDSFQSSVISDNAILADRNYQSDKDPEESATAICNIWLSDNQKKSLLADAGVGTIDQALLSVLSAKFQSLRMFGLSRKVLILDEVHSYDPYMVELICCLLKAQAKIGASVILLSATLPKILRKRFSDSFALGLDTELQDIKSGEYPLVSLVSNRFEVEETPIPTRKEVGRKLNVEFLFDQETVFQKILEMSNQGRCVCWIRNTVSEASQAFFFLHSKLGDRVILFHSRFAMGDRLNIESQILENFGVRSDQKSRKGKVVVATQVVEQSLDLDFDCIFTDLAPIDLILQRAGRLHRHSRDIFGNVKQGLDERGEPLLWIFSPEPIDDPTSNWFSQFSRGGGMVYSDHGKLWLTAKLLHERKGWKMPEDARNLIESVYGVDVKVPHSFLENRSKVENDRKKQESAAVLSTIRLELGYDSTSNETSWDDSKFSTRYGIGNSTKVVLAKFVSDRLVPWISGTSRNWQNSELPVPNYLVEKEFIFENSNVSEVISDCKKNLPDKGKHCVLLPLFYANDFWRGKAFNKKNEVVSFTYDERFGFRKEQLRGIV

SEQ ID NO: 12931 - protein, 752 aa, Leptospira interrogans serovar Pyrogenes str. 200701872; identical to SEQ ID NO: 12702

SEQ ID NO: 12932 - protein, 932 aa, Leptospira santarosai str. CBC1531
MEAEEKSYYKYWGKADQEGNYHLLVYHCLDVAAVGEVYLSQNETLCVHLSQKLGIDSPTFKNLFVFFLVLHDLGKFSDCFQSLIPNIKRILGNSNSPIGPYSVRHDSLGYIFWGEWILKDKRFGNYDGLLTEQNWLGWNGLRSSKEKSYFTEFLDVLIRCVTGHHGRPPSKNGYSGQTAVSPDSHFTEADRSAALAFCKEVNRIFSPNFEGDFKSLFDSTLPISFWLAGLSVLCDWIGSNSEIFKYHRTPIDLEEYYTTISLINAQKAVLKSGLSSAKIAFNENHFRIFEYLREPTPLQKFCSEVVLPDSPSLFILEDVTGSGKTEAALILTHRLMQKNAYSGFYVGLPTMATANGMYRRMSGVYRNLYTKESLPSLILAHGARNLSDSFQSSVISDNAILADRNYQSDKDPEESATAICNIWLSDNQKKSLLADAGVGTIDQALLSVLSAKFQSLRMFGLSRKVLILDEVHSYDPYMVELICCLLKAQAKIGASVILLSATLPKILRKRFSDSFALGLDTELQDIKSGEYPLVSLVSNRFKVEETPISTRKEVGRKLNVEFLFDQETVFQKILEMSNQGRCVCWIRNTVSEASQAFFFLHSKLGDRVILFHSRFAMGDRLNIESQILENFGVRSDQKSRKGKVVVATQVVEQSLDLDFDCIFTDLAPIDLILQRAGRLHRHSRDIFGNVKQGLDERGEPLLWIFSPEPIDDPTSNWFSQFSRGGGMVYSDHGKLWLTAKLLHERKGWKMPEDARNLIESVYGVDVKVPHSFRENRSKVENDRKKQESAAVLSTIRLELGYDSTSNETSWDDSKFSTRYGIGNSTKVVLAKFVSDRLVPWISGTSRDWQNSELPVPNYLVEKEFIFENSNIPEVISDCKKNLPDKGKHCVLLPLFYANDFWRGKAFNKKNEVVSFTYDERFGFRKEQLRGIV

SEQ ID NO: 12933 - protein, 714 aa, Cesiribacter andamanensis AMV16
MVLYPEILAKGDPENLPLHLHLQYVLEAVEQFAQYRGMDLSLARAGAVLHDLGKCHPYFQAQLQGRRREANECPYRHEIGSLFFLHAFEKESHPALIEMVVSHHKSIYEDAGQKGLLDLDNDWAREDLLEVYLKDWDNWQQKGIDFLQAFGYACKPIAKEDAALLLQEIIQYCEDLDAGPSEWKGVLMGGDYFASALAKDTGHYLQNLFQVPDLSFYHSRQNELYPLSLYPSESNKPHTLVEAPTGAGKTDYLVRRCQGRMFYTLPFQASINAMHQRFEDSLRPGNPDISIRLQHATSHMKLVGKKNIKQETALQGLFGASVKVLTPHQLAGLVFGLRGYEALALDLEGCDIILDEIHTYSKVSQSIVLKLVEVLDALNCRLHIGTATMPTVLRNRLIEILGQDRVYTVSLKQEELQAFNRHDVFKLVGLKKALQLLKAHSQKQEKILVVANTVAAAQQCYKYAKKHSGYEKVMLLHSRFKRGERAERENLLTAWNAQEGPCMVIATQVVEVSLDISFDVLFTEAAPLDALLQRFGRVNRKRTKETIGLSKPVYILEARATTRPYEPDIVKRSFEALPDGAVLQENSVRQMLDEVYQKLDEEYSIQDQEIYADGRWQFAKLRHKSKSVLLEALEIDSALCITAEDQEEYERLNFFDRMQFEIPVRYRSIAHLIIGQSKLGSKPFIVSNEIYSSDLGLLVPKKEKQKFNPEQQFF

SEQ ID NO: 12934 - protein, 716 aa, Salmonella enterica subsp. enterica serovar Dublin str. UC16
MVINNIYFIDHYLKKLGIQDKEQAAQFFAWILCWHDIGKFAHSFQQLYRHEALNIFNEPTRHYEKIAHTTLGYMLWNSWLSECPELFPPSSLSVRKSKRVMALWMPVTTGHHGRPPEAIQELDHFRQQDKDAARDFLLRIKALFPLITLPEAWDEDEGIDQFQQLSWFISAAVVLADWTGSASRYFPRTAEKMPVDTYWQQALAKAQTAITLFPSAANVSAFTDIETLFPFIQHPTPLQQKALELDINVDGAQLFILEDVTGAGKTEAALILAHRLMAAGKAQGLYFGLPTMATANAMFERMANTWLALYQPDSRPSLILAHSARRLMDRFNQSIWSVTLSGTEEPDEAQPYSQGCAAWFADSNKKALLAEVGVGTLDQAMMAVMPFKHNNLRLLGLSNKILLADEIHACDAWMSRILEGLIERQASNGNATILLSATLSQQQRDKLVAAFSRGVRRSVQAPLLGHDDYPWLTQVTQTELISQRVDTRKEVERCVDIGWLHSEEACLERIGEAVEKGNCIAWIRNSVDDAIRIYRQLQLSKVVATENLLLFHSRFAFHDRQRIESQTLNLFGKQSGAQRAGKVIIATQVIEQSLDIDCDEMISDLAPVDLLIQRAGRLQRHIRDRNGLVKKSGQDERETPVLRILAPEWDDAPRENWLSSAMRNSAYVYPDHGRMWLTQRILREQGTIRMPQSARLLIESVYGEDVNMPVGFAKTE

SEQ ID NO: 12935 - protein, 724 aa, Desulfotignum phosphitoxidans DSM 13687
MKQFYAHSTDSKDTSDWQLLDTHLDNVAKRAGRFADCFDGKEWAETIGKIHDLGKGSCSWQAYLRHVTGVVDEFCKYFEGHPSHAFTGAQVLYNLSKDTGKLLSYCVAGHHGGLPNWSDTSASALKDRLSQQYPKVDVAYSIPKLPGSCPLVFDQSRLGFQFQFFTRMLFSCLVDADFLDTEESIDGNKAVWRSQYASLDKISQKFWLNFKTLRNTADLKLLVNRQRENVLRDCLAAAEENPGIFSLTVPTGGGKTLASLAFALNHAQKFDKQRIIYVIPFTSIIEQNAKVFRGMVGNDSVLEHHCNFSVDEGDWKTKLASENWDAPVIVTTNVQFFDSFYANKPSKCRKLHNVANSIIIFDEVQAIPVENLKPCLEVIRELSLNYNVTSVLCTATQPAIHFSESFKSGLKDVKEIIQNIPDLFSKLKRTEETYIGQLSVQEIAGRLSGYKQVLCIVNTRQQALDIYNALPESNENFHLSALMYPAHRTKMFEKIKSLLDPSKKMPCRVISTQLIEAGVDIDFPCVFRSVAGIDSIAQAAGRCNRNGLHDQPQKVYIFDVTEAPNQMFFRKAAQSAEKLFERFDLKLTSPECVNEYFLDFFWKNEQHMDRKAILEKCGMAQSLDIPFKEISEFKMIDSPTVPIVIALEDEARKLTDLLPLEKYPGRVLRKLQQYCVQIYPYQLDAIKDWLENPISGVWVLRSDLLYERKTGLKCDPPRGNAFFG

SEQ ID NO: 12936 - protein, 745 aa, Leptospira noguchii str. Cascata
MIKEKQSIFLAHVLRKDDGSFVEHLIDDHLYSVAEFTKKFCEKFEAGTVGYLIGFWHDLGKFKLEFQERIRIRSGHIGEEAHLEGKTAKSVKHSVSGAIHCFNKFKKSDIIKKLICLPILCHHSGLKNFGIDVDIQLNDEKEISAWSKTISHIPQQILDGIDLKQLGRSFKDFSLLIRMLFSALIDADRLDTERFMDLSKFKERYSKTIILQDLNIKLDKHLNEIQKQADATKVNSTRKRILEEVQSKTNLKPGFYTLTVPTGGGKTLTSLSFALKHCIANKMDRVIYGVPYLSIIEQTADIFKKILGEDSVLEHHSGIDISKEKENSINRLLTENWDHPLIVTTNVQLFESLFSSKTTKVRKLHNIINSVIILDEAQMIPPQFLQPIVKTLKELVEYYNVTIILCTATQPTLSSIKSTDLNFDGIDTTIELAPEPEKLFQKLKRVIIHKPEEKKLSFIEVATRILNYDQVLTIVNRKSDASGIFNELTGNKYYLTTNLCAEHRRDILKKVKSHLDNGESVYLVSTQLIEAGVDIDFPIVFRAVGGLDSIAQAAGRCNREGKLLDKNGQEKLGEVFLFHLEQDPPSGHLLQTKQASEDCIKNFEELIHPDALKQYFNTLFWLKQNKGLDKEEIEELKINLQFETINEKFKLVDEDSRPVIVPYKEGKDIIIQLQNSAIKNNFLDYKLIRKSQRYTVNLKTNLYNKLLSEGIISEIEGIIGILNFDSYYYNDLGILESPNEQDLII

SEQ ID NO: 12937 - protein, 745 aa, Leptospira noguchii str. Hook
MIKEKQSIFLAHVLRKDDGSFVEHLIDDHLYSVAEFTKKFCEKFEAGTVGYLIGFWHDLGKFKLEFQERIRIRSGHIGEEAHLEGKTAKSVKHSVSGAIHCFNKFKKSDIIKKLICLPILCHHSGLKNFGIDVDIQLNDEKEISAWSKTISHIPQQILDGIDLKQLGRSFKDFSLLIRMLFSALIDADRLDTERFMDLSKFQERYSKTIILQDLNIKLDKHLNEIQKQADVTKVNSTRKRILGEVQSKTNLKPGFYTLTVPTGGGKTLTSLSFALKHCIANKMDRVIYGVPYLSIIEQTADIFKKILGEDSVLEHHSGIDISKEKENSINRLLTENWDHPLIVTTNVQLFESLFSSKTTKVRKLHNIINSVIILDEAQMIPPQFLQPIVKNLKELVEYYNVTIILCTATQPTLSSIKSTDLNFDGIDTTIELAPEPEKLFQKLKRVIIHKPEEKKLSFIEVATRILNYDQVLTIVNRKSDASGIFNELTGNKYYLTTNLCAEHRRDILKKVKSHLDNKESVYLVSTQLIEAGVDIDFPIVFRAVAGLDSIAQAAGRCNREGKLLDKNGQEKLGEVFLFYPEQDPPSGHLLQTKQASEDCIKNFEELIHPDALKQYFNILFWLKQNKGLDKEEIEELKINLQFETINEKFKLVDEDSRPVIVPYKEGKDIIIQLQNSATKNNFLDYKLIRKSQRYTVNLKTNLYNKLLSEGIISEIEGIIGILNFDSYYYNDLGILESPNEQDLII

SEQ ID NO: 12938 - protein, 823 aa, Thermoanaerobacter thermohydrosulfuricus WC1
MEYYAHYDQKQNLKQYLSEHLLAVKNIGETNFVPSVSFQEISNSELKELIKNILFFHDFGKYTTYFQNYLVKNIHNKYKEHAHISACVAYLWIKKYLFNEKENITKLIWAFLAYVVILRHHMSLEINTFFDNEKWGKLEVQVADLRENIDAIVADLNDRWPVEREKILEILKVNELKEETLFIYMPQYISNRFKNEEWYFASIYLFSLLIDSDKLDSGTVQKKQMCFVEDKRVEDYIKQKHKNDTHTNFVNEKNNARKYMIRTLQELTSEQIKNQHFFTITAPTGIGKTLASLQCALYLRNRIKKEMNYTPRIITAIPFINIIEQTQKDYEAVVGNTAHLIVHHQFADFGNRSNGDEIIPVERKLLEVEAWEGDIILTTFVQLFQSLLTDQNRLLKKINKLAGSIVILDEIQSIPDEYMPLIGAVLRKLAQFYGTRFILMTATQPKILQLGDMLLNEKKEEPIELLKNHDKYFKNKKRTKLFPLFKNEFNDGNEFVEFFMKIWQQNQSALIVVNTIKRSIEIFNLLREKQQKYKEINDNIKIYYLSTNIIPKHREKVIEKIKKNLENKEPVILVSTQTIEAGVDLDFDIGFRDLAPLESIIQTAGRVNREGKKGEGAPLYILKIDRDYEKVYHLHHIDRVKKLLADKECIWESEYKELVEKYYEELIKSGVSDKSQKIWEEGIIGLDFTKLKEFELIKNIGEVVDVFVEIDDEASVLLNAYEDIKRGAWGSETLCRIFPMECKNLDIEPTFFKKRALLQLLLKKMRKYIIQIRINRALKNPPIKFSARNGIEANFYWIPKNQVEEYYDFETGFIDETAAVYIY

SEQ ID NO: 12939 - protein, 726 aa, Anoxybacillus flavithermus AK1
MTFYAKSEGKETIREHTDRLLYNLHLLKDAYGHKFMLMDEKMWKLLEIAVQYHDVGKANTVFQNKIRQIIHESILEKDVETNVPHNYLSVGCIPLKQLDLTKEEERLLIHAVGYHHEREQLPEKEMIRHVLESDIKKLLPQLSEHMGLPMTEKFSYRFVDRLLKRYTYHDGEEFWKYVMMKGLLHRLDHAASAHIDVERDIHQSVYINVSEYMKKKKFHKNDLQQFAERHSDKHVIAIAQTGMGKTEAALLWIGEDKAFFTLPLRVSINAIYDRIKEKMGYDAVGLLHSTSLHYLMEKGEENWEELKQQSEHYAKKLLLTTVDQILKFPFYYKGFEKELAAMANAKVVIDEIQAYEPRIAAMLIKSLEMIHHVGGKFMIMTATLPTLYLEELKQRNVINDDEIAIGEFVDTSINRHRICLRSEGVEEAIGEMSDLGKTSQVLVIVNTVRKAISLYDKLLDNDIQVPIYLLHSQFTQEDRQLLEKRIKQFNENHERGIWITTQLVEASIDIDFDYLFTEMSTLDSLFQRFGRCYRKRALDHDQCNIHIFTENISGVPKVYNEHLVNESIRLLKQYDKQIVDERAKVEMVAQLYDRKRLAGTSFLKEFEDALYMFDNLDPYGMGKREAQQKLRDIQNIQVITREVYDQIEHMFEQYKKEKEWKQRLKLRMELEKKTVSVQRYVAEKYVSERLPKPFDYIYIADVQYDFNRERWKGKGILLDKPSSNFL

SEQ ID NO: 12940 - protein, 768 aa, Brevibacillus borstelensis AK1
MPGIEPPFLAKSLTSSEHDLYAATVAGHLEQVVETAEIIVEKTGWAILQVCQLEEDKLEPIKRVVRVAALLHDLGKLSGDFVNLIEGKDAGPQVVRHELLSCWMLENYEPLLRAVEQYIGDTMWGMLAVKAAILGHHLRFPDGEQTYYGSGELKLYLLHRRADDVRKLIDRTLGEPVDWSQPLSSFPRSRLFAGDYEEKVICEWKENAVGLSASERKLCSIIRGILIAADALGSVRSLSRGDWVERKSVDIRNIFSGIPLQNELGDMIQKKLAKVNTYSPEITQFQETVEAAATYEITVCEAGCGSGKTIAAYRWAKKVNRPFLCFAYPTTATATQGYADYQQYLQSAGKKLHHSRADIDFELLLNQKDGQKEGAFRALEHLLQPVTICTVDTVIGLTQLYYSSLCVLPHILQSAIVFDEIHSYDENLFASLLRFLKEFDLPILLMTASLQQERREALQSLFRELENEGRRAAWCKGPELHQSIPRYRLHAGPSLPKEKLWEALNRNENVLIIMNTTDRAMDLYETLKKEAADKTPGAELFCYHSRFKYRDRLARQQEIVEAFRGRRGICAITTQIAEMSFDVSCDVLMSEIAPFSAVIQRLGRLNRTAKPGDSPGRAYFWMPESISPYEKQRDDVYLTEKILRENAEKPLSQADLSILLATMNTKKREVRQMLSGWEELPETLTGSLRDESSLVDVIVKSDFEKTGGRKQASRSKIMEYVLPVNRGKLPRGDWMKWRHVYIVPDEVIDYDEKRGGMVKGCKSGKSSG

SEQ ID NO: 12941 - protein, 657 aa, Brevibacillus borstelensis AK1
MREYLLYIKVSGGAAQAHITPCFQVDQAFWREREGAQLYVIGKSKSLALAFSLRGELNNALGDHAFTEKSVDSYRALASAHVREATVLYGKQAAGMTPIEKEWLSLESVGGSGEQADTLPLSPSSKDTLEDTDELKRESERLLAWMSGRALLWDEVGVLLNKKGWAPRSLEYCFQWMILSGKAERRPGIEWRIRRSWLRHRMLFTCARCGSEQTIVLTRCHSCRQGCAYCTECLDMGRSKCCTPYFCVPRQKASQAYEAVSPGKLCERTVNRGFTGERMAGTSYERRAALLDWQGTYSPMQKMAAEKARQFVASDRPGLGEFLLWAVCGAGKTELLFPSVAETLRAGGQVLIATPRKDVVLELAPRIAKVFPNARVIAVHGSSTEKWEDSDITIATTHQVMRFYHRFPLVVLDEVDAFPYHNNPVLYRVVSRAVQPGGKILYLSATPPRYLQKRLVPKRAQSHMHSRTHVLLPGRYHGSPLPVPLVCTVRGLHKHLSAGRSIRPLLETLAASLDGGRQVFVFVPRVDQVPVVLGYLQRRLPGYSQAMAGVHAADPEREEKVRLFRAKQLLVMVTTTILERGVTIPRSDVIVVGTEAPVFDEASLVQIAGRVGRSSDAPSGTVLFIEEYRTSASRAAIRQINRMNQLAASLQQAGGQS

SEQ ID NO: 12942 - protein, 730 aa, Escherichia coli BCE034_MS-14
MDELDNFLPEDKAAARDFLLAIKALFPRIEIPAFWDDDEGIELIKHLSWYISATVVLADWTGSSTRFFPRVAQAMDIKHYWQKALVQAQNALTVFPPKAETAPFTGINTLFPFIENPTPLQQKVLDLDISQPGPQLFILEDVTGAGKTEAALILAHRLIAAGKAQGLFFGLPTMATANAMYDRLVKTWLSFYSPESRPSLVLAHSARTLMDRFNESLWSGDLIGSEEPDEQAFSQGCAAWFADSNKKALLAEIGVGTLDQAMMAVMPFKHNNLRLLGLSNKILLADEIHACDAYMSCILEGLIERQARGGNSVILLSATLSQQQRDKLVAAFARGAEGQQEAPLLGKDDYPWLTHVTKTDVHSHRVATRKEVERSVSVGWLHSEQECIARIESAVSQGKCIAWIRNSVDDAIQVYRQLLARGVIPASSLSLFHSRFAFSDRQRIETETLARFGKYCSLQRASQVIVCTQVIEQSVDIDLDEMISDLAPVDLLIQRAGRLQRHIRDINGQLKRDGKDERSPPELLILAPVWDDSPGDEWFGSAMRNSAFVYPDHGRIWLTQRVLREQGAIQMPHAARLLIESVYGEDVVMPEGFARSEQEQVGKYYCDRAMAKKFVLNFRPGYAANINDYLPEKLSTRLAEESVSLWLATCIDGVVKPYATGAHAWEMSVVRVRRSWWKKHRDEFSLLEGEAFRLWCIEQRQDPEMANVILVNDDESCGYSATEGLIGKVG

SEQ ID NO: 12943 - protein, 785 aa, Escherichia coli BCE019_MS-13
MEPFKYICHYWGKSSKSLTKENDIHLLIYHCLDVAAVADCWWDQSVVLQNTFCRNEMLSKQRVKAWLLFFIALHDIGKFDIRFQYKSAESWLKLNPATPSLNGPSTQMCRKFNHGAAGLYWFNQDSLSEQSLGDFFSFFDAAPHPYESWFPWVEAVTGHHGFILHSQDQDKSRWEMPASLASYAAQDKQAREEWISVLEALFLTPAGLSINDIPPDCSSLLAGFCSLADWLGSWTTTNTFLFNEDAPSDINALRTYFQDRQQDASRVLELSGLVSNKRCYEGVHALLDNGYQPRQLQVLVDALPVAPGLTVIEAPTGSGKTETALAYAWKLIDQQIADSVIFALPTQATANAMLTRMEASASHLFSSPNLILAHGNSRFNHLFQSIKSRAITEQGQEEAWVQCCQWLSQSNKKVFLGQIGVCTIDQVLISVLPVKHRFIRGLGIGRSVLIVDEVHAYDTYMNGLLEAVLKAQADVGGSVILLSATLPMKQKQKLLDTYGLHTDPVENNSAYPLINWRGVNGAQRFDLLAHPEQLPPRFSIQPEPIYLADMLPDLTMLERMIAAANAGAQVCLICNLVDVAQVCYQRLKELNNTQVDIDLFHARFTLNDRREKENRVISDFGKNGERNVGRILVATQVVEQSLDVDFDWLITQHCPADLLFQRLGRLHRHHRKYRPAGFEIPVATILLPDGEGYGRHEHIYSNVRVMWRTQQHIEELNGASLFFPDAYRQWLDSIYDDAEMDEPEWVIKGMDKFESAECEKRFKARKVLQWAEEYSLQDNDETILG

SEQ ID NO: 12944 - protein, 684 aa, Escherichia coli 2845650
MTFFDFWGKTRRGEKDGGDDYHLLCWHSLDVAAMGYLMVKRNCFGLADYFRQLGISDKEQAAQFFAWLLCWHDIGKFARSFQQLYLPPELKIQESARKNYEKISHSTLGYWLWNHYLSECQELLPSSSLSPRKLRRVIEMWMPVTTGHHGRPPDRMDELDNFLPEDKAAARDFLLEIKPLFPLIEIPAFWDDDEGIELIKHLSWYISATVVLADWTGSSTRFFPRVAHPMDIKGYWQKTLIQAQNALTVFPLKAKVAPFNGINTLFPFIENPTPLQQKVLDLDISQQGPQLFILEDVTGAGKTEAALILAHRLIAAGKAQGLFFGLPTMATANAMYDRLVKTWLAFYSPESRPSLVLAHSARTLMDRFNESLWSGDLVGSEEPDEQTFSQGCAAWFADSNKKALLAEIGVGTLDQAIMAVMPFKHNNLRLLGLSNKILLADEIHACDAYMSCILEGLIERQARGGNSVILLSATLSQQQRDKLVAAFARGTEGQQEAPFLEKDDYPWLTHVTKSDVNSHRVATRKDVERSVSVGWLHSEQECIARIESAVSQGKCIAWIRNSVDDAIKVHRQLLARGVIPASSLSLFHSRFAFSDRQRIETETLARFGKYCSLQRASQVIVCTQVIEQSVDIDLDEMISDLAPVDLLIQRAGRLQRHIRDINGQLKRDVFPAPAGINRVHGYSV

SEQ ID NO: 12945 - protein, 730 aa, Escherichia coli ThroopD
MDELDNFLPEDKAAARDFLLAIKALFPRIEIPAFWDDDEGIELIKHLSWYISATVVLADWTGSSTRFFPRVAQAMDIKHYWQKALVQAQNALTVFPPKAETAPFTGINTLFPFIENPTPLQQKVLDLDISQPGPQLFILEDVTGAGKTEAALILAHRLIAAGKAQGLFFGLPTMATANAMYDRLVKTWLAFYSPESRPSLVLAHSARTLMDRFNESLWSGDLVGSEEPDEQTFSQGCAAWFADSNKKALLAEIGVGTLDQAMMAVMPFKHNNLRLLGLSNKILLADEIHACDAYMSCILEGLIERQARGGNSVILLSATLSQQQRDKLVAAFARGAEGQQEAPLLGKDDYPWLTHVTKTDVHSHRVATRKEVERSVSVGWLHSEQECIARIESAVSQGKCIAWIRNSVDDAIKVYRQLLARGVIPASSLSLFHSRFAFSDRQRIETETLARFGKEDGSQRAGKVLICTQVLEQSVDCDLDEMISDLAPIDLLIQRAGRLQRHIRDINGQLKRDGKDERSPPELLILAPVWDDSPGDEWFGSAMRNSAFVYPDHGRIWLTQRVLREQGAIQMPHSARLLIESVYGEDVVMPEGFARSEQEQVGKYYCDRARAKKFVLNFRPGYAANINDYLPEKLSTRLAEESVSLWLATCIDGVVKPYATGAHAWEMSVVRVRRSWWKKHRDEFSLLEGDAFRQWCIEQRQDPEMANVILVTDDESCGYSAMEGLTGKVG

SEQ ID NO: 12946 - protein, 730 aa, Escherichia coli 2720900; identical to SEQ ID NO: 12942

SEQ ID NO: 12947 - protein, 752 aa, Leptospira interrogans str. 2002000626; identical to SEQ ID NO: 12699

SEQ ID NO: 12948 - protein, 639 aa, Leptospira interrogans str. 2002000626
MLCHHSGLKNFGIDVDIQLNEEREILALSETTPHIPQEILDGIDLKQLGKSFKDHSLLIRMLFSALIDADRLDTERFMDPAKFKERYSKTIILQDLNIKLDKHLKNIQKQADTTKVNSIRKRILKEVQSKTNLKPGFYTLTVPTGGGKTLTSLSFALKHCITNKMDRVIYGVPYLSIIEQTTDVFKKILGEDSVLEHHSGIDISKEKENSINRLLTENWDHPLIVTTNVQLFESLFSSKTTKVRKLHNIINSVIILDEAQMIPPQFLQPIVKTLKEIVKFYNVTIILCTATQPTLSSIKSIDLNFDGINTAIELAPEPEKLFQELKRVIIHKSEERKLSFIEIATKISNYDQVLTIVNRKSDSSGIFNQLTGNKYYLTTNLCAEHRRDILKKVKSHLSNGESVYLVSTQLIEAGVDIDFPIVFRAVAGLDSIAQAAGRCNREGKLVDENGQEKLGEVFLFHLQQDPPSGHLLQTKQASEDCIKNFEELIHPDTLKQYFNTLFWLKQDKGLDKEEIEKDKRSFQFETINKNFKLIDKDSRPVIVPYKEGKDLIVQLQNSVVQNNFVDYKLIRKSQRYTVNLKTNLYNKLLSEGIISEIEGIIGIIGIIGIIGIIGILNFDSYYHNDLGILESPNDQDLII

SEQ ID NO: 12949 - protein, 846 aa, Leptospira weilii str. Ecochallenge
MGYIFWGKWILKDERFGNYNGLLTEQNWLGWNGLQSSKDKSYFTEFTDVLIRCVTGHHGRPPSKNGYSGQTAVSPDSHFTEADRLAALDFSKEANRILSPNLYFKGNFKTLYDSTLQISFWLAGLSVLCDWIGSNAEIFKYHTTPIDLEEYYTTISLNNASKAVKKSGILPSKITLNGNHFGIFEYLQEPTPLQKFCSEVVLPDSPSLFILEDVTGSGKTEAALILTHRLMQKNTYSGFYVGLPTMATANGMYRRMSSVYRNLYTKESLPSLVLAHGARNLSDSFQSSVISDNAILSDRNYSFQSEKNQEESASAICNIWLSDNQKKSLLADAGVGTIDQALLSVLSAKFQSLRMFGLSRKVLILDEVHSYDPYMVELICCLLKAQAKIGASVILLSATLPKILRKTFSESFALGLDTELQDIKSEEYPLVSLISDRPVVEETPISTRKEVSRKLNVKFFFNQEQVLQKILEISNQGRCVCWIRNTVSDASQAFSFLHSKLGDRVTLFHSRFAMGDRLNIESQILENFGIQSDQISRKGKVVVATQVVEQSLDLDFDCIITDLAPIDLILQRAGRLYRHSRDISGNIKQGLDERGVPILWIFSPEPIDDPKSDWFSRFSRGGSMVYSDHGKLWLTARLLQERKGWRMPEDARNLIESVYGTNVMVPQSFQENQSKVENEKKKRESAAALSTIRLELGYDSTLNETSWDDSKFSTRYGIDNSTKVVLAKFVSDRLVPWISDTNRDWQNSELPVPNYLVEKEFIFENSNLSEVISNCKKIYRIKANIAFYFPCSTQTILGEAKPLTKRTKSYPLLTTKDSVLEKRNKEEPYEFNQGHLDSGPKVFRKI

SEQ ID NO: 12950 - protein, 754 aa, Leptospira interrogans serovar Australis str. 200703203
MKRNKQSIFIGHILRKDDGNFVEHLLDDHLYSVAELTEKFCEKFGAGTFGYLIGLWHDLGKFKLEFQERIRIRSGHIGEKAHLEGKTAKSVKHSASGAIHCFNKFKQSDIIKKLICLPMLCHHSGLKNFGIDVDIQLNEEGEILALSETTPHIPQEILDGIDLKQLGKSFKDHSLLIRMLFSALIDADRLDTERFMDPAKFKERYSKTIILQDLNIKLDKHLKNIQKQADTTKVNSIRKRILKEVQSKTNLKPGFYTLTVPTGGGKTLTSLSFALKHCITNKMDRVIYGVPYLSIIEQTTDVFKKILGEDSVLEHHSGIDISKEKENSINRLLTENWDHPLIVTTNVQLFESLFSSKTTKVRKLHNIINSVIILDEAQMIPPQFLQPIVKTLKEIVKFYNVTIILCTATQPTLSSIKSIDLNFDGINTAIELAPEPEKLFQELKRVIIHKSEERKLSFIEIATKISNYDQVLTIVNRKSDSSGIFNQLTGNKYYLTTNLCAEHRRDILKKVKSHLSNGESVYLVSTQLIEAGVDIDFPIVFRAVAGLDSIAQAAGRCNREGKLVDENGQEKLGEVFLFHLQQDPPSGHLLQTKQASEDCIKNFEELIHPDTLKQYFNTLFWLKQDKGLDKEEIEKDKRSFQFETINKNFKLIDKDSRPVIVPYKEGKDLIVQLQNSVVQNNFVDYKLIRKSQRYTVNLKTNLYNKLLSEGIISEIEGIIGIIGIIGIIGILNFDSYYHNDLGILESPNDQDLII

SEQ ID NO: 12951 - protein, 752 aa, Leptospira interrogans serovar Australis str. 200703203; identical to SEQ ID NO: 12699

SEQ ID NO: 12952 - protein, 750 aa, Leptospira interrogans serovar Copenhageni str. M20; identical to SEQ ID NO: 11551

SEQ ID NO: 12953 - protein, 896 aa, Leptospira weilii serovar Ranarum str. ICFT
MTNSFPHLQLWGKAARRDASDWHPLAYHMLDVAAVAEEVLEREPERTRQLYAEDYCLSWEDAKRWILFFVGLHDLGKATPAFQYKVEERLPQLEKINLTIGKNTLLRWKTKSPISHGELSVKLLKETLLNYGWKFEAAKLIAEAVGIHHGHRTNANKLRGISLEEEGEANWLEIRNVLIQSLLDVFQVNLDSIPALESLHPGGFMRLAGLACFSDWIGSNTDYFKYDRSSDKSLSEYYANARIEKVKTALDSIGWHNRVSLQKTTIKFEDVFSFPPRPLQSLMATIVDNVKKPILILIEAPMGEGKTEAALYAHLRLQEQLQHRGLYVALPTQATGNSMFRRVSEFLESMKHPHPLDLQLLHGASFLNDNFTKLKMRGIYSTNSKSANVLAEEWFTHKKRALLSDYGVGTVDQALLSVMNVKHQFVRIWGLGNRIIVLDEIHAYDMYTSTLIEALIEWFFALGSSVILMSATLPKNKKDSLLRSFGAENMNYAEYPRITYLNNGETESHSISIPKNPDRKMELQLKSAPTDINDLSDLLLKLVGDGGCAVCIVNTVQRAQDIYSCLSEMKSSDIELFLFHARFPAEERTGKENDILKNFGKDSFEQRPKKAILIATQVVEQSLDIDFDVMVSDLAPIDLILQRAGRLHRHKRENRFSHSIPTLYISGLNIQIGSLGFGKPLYWDYVYERHILLKTWWILQNETTIHLPDEIDSLVETVYGETLEFKVPKELLNELEKSKEKMNKTSDEDKSNAIHTVIGSPFDGSWKTPPQLKQEEDDDLNVHPLFIAKTRKGDRSITVIPIFQKENKIHLDYKTEIDFISEIQSDLAKKIFMRSLNLSRKDIVKEISNKKIPENWKENALLRNCYPLILENNKTTIGSLEISYHKELGIVYKSNT

SEQ ID NO: 12954 - protein, 776 aa, Leptospira weilii serovar Ranarum str. ICFT
MRSLRWSACVMEGKLLAKTKTNDGREISLQEHSLDTETAGSAIFKKGSRFLNNWLRFFKVKKEDEEKFLLNLSVACLFHDIGKANEDFQKAINETTFFHQGIRHEHLSAFVLHLPEIRKWLSQNKNLDLPIITSAVLCHHLKATDKNEHPYKWLKKPLRDLVILNLSHGEVKRILEKVNQLLNGSLSIPQLNYKSFRIEDENWNKAIQSGAKESGILVFKLDEDRKQLYLALKAALIVSDSASSGLVRENHLIEKWIPNVIHSDEIKENEILKEIIEKRMNDKKISTLHQFQKQVVTKGNRVLLMAGCGMGKTLAAWNWANEVSKKQKISKVIFLYPTRGTAAEGFKDYASWAPESDVTLMHGTSEYELDSMFKNPEDEKSKKDFGISEENERLFALAFWSKKFFSATADQFLSFLQNNYKGICLLPVLSECALVVDEVHSFDKVMFASLLSFLKHFDLPILCMTATLTPKNKQSLLELGLEQFPKNEDKKELEDLIKLENHPRYNKTILENSKHAKEIAIKSFREGKRVLWVLNTVTRCQEMYKELTEELQTEVYCYHSRFKLSDRKDIHEKTVNAFQGYSQNCIAVTTQVCEMSLDLDADVLISEYAPVSSMVQRFGRANRHLKKGEDFRAELYLYEVVGCLKPYLPSDIASAEKFLKNLPDKDISQNLLATKLEEYSNQEYKTLPSASFIDGGYFALSNDYRDIEEFTVQAILDEDFEEANKLLRSKKPIDPFILPVPFKKNFNLRSEEHSILPKYLWVVSGQNYTNERGFAI

SEQ ID NO: 12955 - protein, 712 aa, Schaedlerella arabinosiphila
MKYLAHMSKNGDEQLLKEHLENSAILCGRFADQFGAYEWGYCCGYLHDLGKYSEKFQKRIHGSEEKVDHSTAGAKLCWDKKGMYQFLSYCIAGHHSGIPDTGGSGDSGMRGTMIGRIKKKTEDYQAYKNEIEIPLLKEPPFQPVKIENVDFFASMLIRMLYSCLVDADYLDTELFMNGESARDSGESIGLLYEKLMAHVSTWMENNDLNTINGRRTEILAHCVEMGKEEKGLFRLTVPTGGGKTISSLAFALKHAKEHGMNRVIYVIPYTSIIEQNAKIFADILGKENVLENHSNIDYESSEELKLMQLAAENWDKPVVVTTNVQFFESIFSNKSSKCRKLHNIANSVIIFDEAQMLPNDYLKPCISALEQLLRYYRSSIVLCTATQPALKSLLSQEIKVTELCPRMEEQFAFFRRTSIENLNKISEEELIQRLEREHQTLCILNTKKRAQKMYQSIKGEGVYHLSTSMYPVHRKKVLNCIRKRLKRHEKCIVISTSLVEAGVDLDFQTVYRQLAGIDSIIQAAGRCNREGKKQAGECFTYIFKLNQKEYVPGQCQQIDITESILADNRNLEDLETIKLYFERLYHFRGESLDKKEILKMFHKGNFQFARVGREFRLIEENTKTILIKREEEAQEIFEQLKLKGFTKGLARKMGQYCVNVYETDFQKMFAVGIIGGISEDMKEDYFVLKDPAKYSDEMGLALDTEYGEAVLF

SEQ ID NO: 12956 - protein, 778 aa, Eubacterium plexicaudatum ASF492
MELYAKSIEKRLTQDTKAKLLRQLEESMEIFTSAEDAEICKLLQKYKESLQQESFRAEQKTLRKHLEETVRCAENFFQIYGDYFEEKHKQLILDACRMHDIGKANYIFQTIVNSDLKKEKQKQIPHGFLSAMVLSKKEYLKQHPLCGPDDFSVLLTAVYYHHTRSDLFDAKAVQDYCRRFYLDAVREYFGDPDIALYLGNRNQLLFSEQTGREYIAIEEELWCEYMLVKGMLNKFDWTVSAGYADAEKTSDRNEKKLCGRIQTAIKQMRPAQQFMMQNTQRSVIMTAPTGSGKTEAALLWLNGEKGFYTLPLKVSSNAIYQRIREKYEYEDVALLHADSMNSYLKAAQELEDGYRNFEQAKLFSYPLTVCTVDQLFRFVYKALGTEIFAATLKYSKVVIDEMQSYSPRVVAALIFGLSEIKRMGGKFAIITATFPPVFEYFMKKSGLLEGTDYISGDFSGSASESRHRIRMAEGDFEWDFIKKEAGEKKILIICNTVSKAQQVYENLKKEGMEPGLLHSRFIRQHRTVLENRILSFSSDEGRAGIWVTTQIVEASLDIDFDILYTEMCTADSLLQRMGRCNRAGKKKTDEPNIIIYQNQSGRGTIYDATLYDRSVELLKHKDGELLSETDKIEYIKAVYDVNQIRKTSYFQQIEENLKHLKTLTAAEYDMKTAQKKFRGIQSICVMPDCVYEDNVRLIESIRSLLQMPHVQTGIRKLLKDKLAGMTLSLTVQYGIPDGIDKDTIAAFDIHRTGLRYEFDGVTGQGLILEKVQDEGLFL

SEQ ID NO: 12957 - protein, 785 aa, Escherichia coli BCE007_MS-11; identical to SEQ ID NO: 12943

SEQ ID NO: 12958 - protein, 785 aa, Escherichia coli 2730450
MEPFKYICHYWGKSSKSLTKENDIHLLIYHCLDVAAVADCWWDQSVVLQNTFCRNEMLSKQRVKAWLLFFIALHDIGKFDIRFQYKSAESWLKLNPATPSLNGPSTQMCRKFNHGAAGLYWFNQDSLSEQSLGDFFSFFDAAPHPYESWFPWVEAVTGHHGFILHSQDQDKSRWEMPASLASYAAQDKQAREEWISVLEALFLTPAGLSINDIPPDCSSLLAGFCSLADWLGSWTTTNTFLFNEDAPSDINALRTYFQDRQQDASRVLELSGLVSNKRCYEGVHALLDNGYQPRQLQVLVDALPVAPGLTVIEAPTGSGKTETALAYAWKLIDQQIADSVIFALPTQATANAMLTRMEASASHLFSSPNLILAHGNSRFNHLFQSIKSRAITEQGQEEAWVQCCQWLSQSNKKVFLGQIGVCTIDQVLISVLPVKHRFIRGLGIGRSVLIVDEVHAYDTYMNGLLEAVLKAQADVGGSVILLSATLPMKQKQKLLDTYGLHTDPVENNSAYPLINWRGVNGAQRFDLLAHPEQLPPRFSIQPEPIYLADMLPDLTMLERMIAAANAGAQVCLICNLVDVAQVCYQRLKELNNTQVDIDLFHARFTLNDRREKENRVISDFGKNGERNVGRILVATQVVEQSLDVDFDWLISQHCPADLLFQRLGRLHRHHRKYRPAGFEIPVATILLPDGEGYGRHEHIYSNVRVMWRTQQHIEELNGASLFFPDAYRQWLDSIYDDAEMDEPEWVIKGMDKFESAECEKRFKARKVLQWAEEYSLQDNDETILG

SEQ ID NO: 12959 - protein, 705 aa, Escherichia coli 2741950
MEPFKYICHYWGKSSKSLTKENDIHLLIYHCLDVAAVADCWWDQSVVLQNTFCRNEMLSKQRVKAWLLFFIALHDIGKFDIRFQYKSAESWLKLNPATPSLNGPSTQMCRKFNHGAAGLYWFNQDSLSEQSLGDFFSFFDAAPHPYESWFPWVEAVTGHHGFILHSQDQDKSRWEMPASLASYAAQDKQAREEWISVLEALFLTPAGLSINDIPPDCSSLLAGFCSLADWLGSWTTTNTFLFNEDAPSDINALRTYFQDRQQDASRGLELSGLVSNKRCYEGVHALLDNGYQPRQLQVLVDALPVAPGLTVIEAPTGSGKTETALAYAWKLIDQQIADSVIFALPTQATANAMLTRMEASASHLFSSPNLILAHGNSRFNHLFQSIKSRAITEQGQEEAWVQCCQWLSQSNKKVFLGQIGVCTIDQVLISVLPVKHRFIRGLGIGRSVLIVDEVHAYDTYMNGLLEAVLKAQADVGGSVILLSATLPMKQKQKLLDTYGLHTDPVENNSAYPLINWRGVNGAQRFDLLAHPEQLPPRFSIQPEPIYLADMLPDLTMLERMIAAANAGAQVCLICNLVDVAQVCYQRLKELNNTQVDIDLFHARFTLNDRREKENRVISDFGKNGERNVGRILVATQVVEQSLDVDFDWLITQHCPADLLFQRLGRLHRHHRKYRPAGFEIPVATILLPDGEGYGRHEHIYSNVRG

SEQ ID NO: 12960 - protein, 785 aa, Escherichia coli BCE030_MS-09; identical to SEQ ID NO: 12943

SEQ ID NO: 12961 - protein, 785 aa, Escherichia coli BCE032_MS-12; identical to SEQ ID NO: 12943

SEQ ID NO: 12962 - protein, 785 aa, Escherichia coli BCE006_MS-23; identical to SEQ ID NO: 12943

SEQ ID NO: 12963 - protein, 621 aa, Escherichia coli P0305260.10
MELSGLVSNKRCYEGVHALLDNGYQPRQLQVLVDALPVAPGLTVIEAPTGSGKTETALAYAWKLIDQQIADSVIFALPTQATANAMLTRMEASASHLFSSPNLILAHGNSRFNHLFQSIKSRAITEQGQEEAWVQCCQWLSQSNKKVFLGQIGVCTIDQVLISVLPVKHRFIRGLGIGRSVLIVDEVHAYDTYMNGLLEAVLKAQADVGGSVILLSATLPMKQKQKLLDTYGLHTDPVENNSAYPLINWRGVNGAQRFDLLAHPEQLPPRFSIQPEPIYLADMLPDLTMLERMIAAANAGAQVCLICNLVDVAQVCYQRLKELNNTQVDIDLFHARFTLNDRREKENRVISDFGKNGERNVGRILVATQVVEQSLDVDFDWLITQHCPADLLFQRLGRLHRHHRKYRPAGFEIPVATILLPDGEGYGRHEHIYSNVRVMWRTQQHIEELNGASLFFPDAYRQWLDSIYDDAEMDEPEWVIKGMDKFESAECEKRFKARKVLQWAEEYSLQDNDETILAVTRDGEMSLPLLPYVQTSSGKQLLDGQVYEDLSYEQQYEALALNRVNVPFTWKRSFSEVVDEDGLLWLEGKQNQDGWFWQGNSIVITYTRDEGMTRVIPANPK

SEQ ID NO: 12964 - protein, 730 aa, Escherichia coli p0305293.6
MDELDNFLPEDKAAARDFLLEIKPLFPLIEIPAFWDDDEGIELIKHLSWYISATVVLADWTCSSTRFFPRVAHPMDIKGYWQKTLIQAQNALTVFPLKAKVAPFNGINTLFPFIENPTPLQQKVLDLDISQQGPQLFILEDVTGAGKTEAALILAHRLIAAGKAQGLFFGLPTMATANAMYDRLVKTWLAFYSPESRPSLVLAHSARTLMDRFNESLWSGDLVGSEEPDEQTFSQGCAAWFADSNKKALLAEIGVGTLDQAMMAVMPFKHNNLRLLGLSNKILLADEIHACDAYMSCILEGLIERQARGGNSVILLSATLSQQQRDKLVAAFARGTEGLQEAPFLEKDDYPWLTHVTKSDVNSHRVATRKDVERSVSVGWLHSEQECIARIESAVSQGKCIAWIRNSVDDAIKVHRQLLARGVIPASSLSLFHSRFAFSDRLRIETETLARFGKYCSLQRASQVIVCTQVIEQSVDIDLDEMISDLAPVDLLIQRAGRLQRHIRDINGQLKRDGKDERSPPELLILAPVWDDSPGDEWFGSAMRNSAFVYPDHGRIWLTQRVLREQGAIQMPHSARLLIESVYGEDVVMPEGFARSEQEQVGKYYCDRARAKKFVLNFRPGYAANINDYLPEKLSTRLAEESVSLWLATCIDGVVKPYATGAHAWEMSVVRVRRSWWKKHRDEFSLLEGDAFRQWCIEQRQDPEMANVILVTDDESCGYSAMEGLTGKVG

SEQ ID NO: 12965 - protein, 943 aa, Schaalia cardiffensis F0333
MWLSLAQHLMDASDVAAVLFDEYAAPEVRSLMASVWDGNEARARSMLRFLAGVHDVGKASVAFSSQVPSLASFLSDFGVDVLHWKDLPDRKSLPHGFLSYFALVDAIEDGGGDRGRATQWASLVAVHHGRYPNPSAMEKARRVLRLVEGRQQQSAWSKGRRELIEWMARRTGIVLNSSEPSELPRLPIAVASAYGALIVMADWLASNEEFFPLFLRDSRAESMSPSAQIQRVRGGMGRAQMPRPLRIEDGAPVDIEASYRRRFSWGEDTHPTKAQLRAVAIAETEDPDLMIVEAPPGSGKTELAFSVAERMVRMRGLQGVMIALPTQATTNAMFERAETWLSNLLGDEPQRLGIHLAHGKNDLNEEFVRLLAKDSAPLEVLDEEEGTSGLFANRWMAARWRSTLSPIVIGTIDQVLLAALKSRHVLMRHLGLLGKVVILDEVHAADAYMEIYLESALAWLGAFGVPVVLLSATLPSARRQALIAAYRRGRTGGEPGEIKELEGDIGYPVLTVLKDKGTNIRSEVVRDEGEEIRKVIRPLEAGNEGLADFIDSRLASGGCAVVIRNTVGDAQRTYDAILQRFGEESTTLLHSRFLACDRAQRDEQMLALFGKGSSRRPKKHVVVATQVIEQSLDVDFDLMITDPAPMDLVLQRIGRLHRHSGRARPAPLQEAECFVLVDQSGDGAWGFSQGTEAVYGKSRVLRMLAILHDHNAEIVLEKAGDFASFTQLAYSNTPVGPSSWQPSLKEASRLDEAETNSVTEKAKVWSFDPARVSTWTGEALLRDFAGEAATGEISDPKTGLAARPAVRDAEDQIPVLIIPVDPEYGGAVTPPPWQEAEGEPTLIDVSVWPSPSMVSRIRTWSVSLPPWQFRETGEKTDNAVDAVACALWDDPCMREWGFLEHPLLRGELVLPMRRVDAHSQRLETTIRGRRVVYTNQRGLEVQG

SEQ ID NO: 12966 - protein, 931 aa, Leptospira borgpetersenii serovar Mini str. 201000851; identical to SEQ ID NO: 12719

SEQ ID NO: 12967 - protein, 752 aa, Leptospira interrogans serovar Valbuzzi str. Valbuzzi; identical to SEQ ID NO: 12832

SEQ ID NO: 12968 - protein, 718 aa, Leptospira interrogans serovar Valbuzzi str. Valbuzzi; identical to SEQ ID NO: 12833

SEQ ID NO: 12969 - protein, 612 aa, Thauera sp. 63
MPPRLTPHKERGSFQFAFLARMLFSCLVDADYLDTEAFYDRVALPGQPNDRSASRAQALPSLQALRERLDTYLSGFTADSHVNRVRADILAHTRQAAQHSPGLFSLTVPTGGGKTFASLAFALDHAIKHGLRRVIFVIPFTSIVEQNAAVFRSALGDLGEAAVLEHHSAFVAAQLPRSDAERYQAREKLRLAMENWDAPIIVTTAVQFFESLFAARPSQCRKLHNIAGSVVILDEAQTLPLKLLRPAVAAIDELARNYRSSIVLCTATQPALNAPDFRGGFDKDQVRELAPNPPELFRKLDRVRVRHVGTLDDDALAAQLRDLDQVLCIVNNRRHARALYQALADRPGARHLTTLMCARHRSQVLAEVRVRLKAGEPCRLVSTSLIEAGVDISLPTVYRAEAGLDSIAQAAGRCNRNGERAAELSEVCVFATANGDWAPPPELRQFAQAAQEVMRQPQFRDDPLSPSAIEAYFRLLYWQKGDKELDKADLLGLCAESRIDSLPLETLAAKFHMIETVQMPVIVPFDDDARDYLKSLHHVEKSGGLARKLQPYLVQLPRNGFDALRKAGAVQPVAPEKWGEQFMELVNMDLYDPRFGLSWDDPAFIKSESLMW

SEQ ID NO: 12970 - protein, 755 aa, Thauera sp. 27
MTYFAHSTSREDKSDWQGLAEHLRAVAALSGEGAAAFGASGLAEVAGLLHDLGKYTDDFQRRIAGDAIRVDHATRGAMVAVERFGPIGMLLAYGIAGHHAGLANGSEGVERTALRDRLKGLGLPPLKDDWRRDIVLPEQVVPPELFRHKDRGMFQAAFLARMLFSCLVDADYLDTEAFYDRVALPGQANDRSASRALEVPSLKALRERLDAHLSGFAADSDVNRVRADILAHTRQAAQHAPGLFSLTVPTGGGKTLASLAFALDHAIEHGLRRVIFVIPFTSIVEQNAAVFRSALGDLGEAAVLEHHSAFVAAPLPHSDAERYQAREKLRLAMENWDAPIIVTTAVQFFESLFAARPSQCRKLHNIAGSVVILDEAQTLPLKLLRPAVAAIDELARNYRSSIVLCTATQPALNAPDFRGGLEKVRELAPNPPELFRKLDRVRVRHVGTLDDDALAAQLRELDQVLCIVNNRRHARALYQALADRPGARHLTTLMCAKHRSQVLAEVRVRLKAGEPCRLVSTSLIEAGVDISLPTVYRAEAGLDSVAQAAGRCNRNGERAAELSEVRVFATANSDWAPPPELRQFAQAAQEVMRQPQFRDDPLSPPAIEAYFRLLYWQKGDKELDAANLLGLCAESRIDSLPLETLAAKFRMIETVQMPVIVPFKVNDKDDGARRAIDGLRYAEKSGGLARALQPYLVQLPRDKFDALRKTGAVQPVAPEKWGEQFMELVTEDLYDPHFGLSWDDPAFVKTESLMW

SEQ ID NO: 12971 - protein, 600 aa, Thauera aminoaromatica S2
MFQFAFFARMLFSCLVDADYLDTESFYDRVALPGQPNDRSASRGLASPSLESLRERLDAYLSGFDADSHVNRVRADILAHTRKAATYAPGLFSLTVPTGGGKTLASLAFALDHAIAHGLRRVIFVIPFTSIVEQNAAVFRTALGDLGEAAVLEHHSAFIAAQPLRSDAERYQAKEKLRLAMENWNAPVIVTTAVQFFESLFAARPSQCRKLHNIAGSVVILDEAQTLPLKLLRPAVAAIDELARNYRSSVVLCTATQPALTAPNFRGGFDKDQVRELAPNPPELFRKLDRVRVRHVGTLDDDALAAQLRDLNQVLCVVNNRRHARALYQALADLPGARHLTTLMCAKHRSQVLAEVRARLKAGEPCRLVSTSLIEAGVDISLPTVYRAEAGLDSVAQAAGRCNRNGERAADQSEVRVFATAHGDWAPPPELRQFAQAAQEVMRQPQFRDDPLSPSAIEAYFRLLYWQKGDQELDATNLLGLCAESRIDSLPLETLATKFRMIDTVQMPVIVPLDDHARRYIESLRFAEKSGGLARKLQPYLVQLPRNGFDALRKAGAIQSVAPEKWGEQFMELVNMDIYSREFGIWWEDPTFMESANTII

SEQ ID NO: 12972 - protein, 791 aa, Thauera sp. 28
MRINHAFVSQIALAAWLVERGWPDELARLVADAVGCHHGSRASPKTLEALEGDRSAIGRDEWADARHALLDTLFEVFQPTALPEKAGLSGPEFMLLAGLTSFADWIGSNTEWFAFGTEADADDPAVWFEARRACADRALDVLGWQPRTPLLTSPLSFHEVFGFSPRPLQGAVAAVLAGLDEPAILLIEAPMGEGKTEAAWFAHLELQRRFEHRGLYIALPTQATGNAMFARTLAFLHARDAGRMLDLQLLHGGTLLNDDFQQLRLASVHDDGDADPRAAQVKAAEWFTHKKRALLSEYGVGTVDQALLPVLPVRHHFVRLWGLANRVVVFDEIHAYDAYTGTLLIHLVRWLHALGSSVLLLSATLPPAIRRELARVVGGDLPATEATYPRLTTFATGSVRQTHFEADPMRRVTIDIQPIGSALEDMRAELQRRLIEGGMGLALVNTVQRAQALYGLFPEGRPLLREGEQIGKLLDDGTEIYLFHARFPASQRQLREQRVLDIFGKAGGEKGEFRTGRKILIATQVAEQSLDLDFDLMATDLAPIDLLLQRAGRLWRHSRPCRPVAAPMLLVAGLAGDVPDDFGQPLWWGAVYAESVLLRTWCLLRQPEHRQIILPDHIDTLVQAVYEESVPIPDTLQARLDKALMASDGDGIAKTQQAHGAIIGLPDDASWADKHDDLYDEDDPYVHPTLVAQTRLGDESLTVIPLGPADGFDAGIAPSFEQARAWSRRTLRVGRKGVVKQLKALGIPESWQQIPLLRNHFPLCLDEEGRWLGDRSVRLDPALGLTYGNET

SEQ ID NO: 12973 - protein, 984 aa, Acinetobacter ursingii DSM 16037 = CIP 107286
MIVTFISQCEKKAIPRTRRVLDAFADRIGDNTWQTVITEDGLIAVKKLLRKTVTKSTAVSCHWIRGRRRSELLWVVGNRNKFNIQGIVPVNSTQKEVFMDVMTMKAKKDEFYANTQLQPLAEHSFAIGYLAQQLFKKVVDNNEYENLSKVAFLAGCLHDLGKLDPHFQDWVKKGKQKDPEEDGQHIDVKFTFEKHPRHNEISLILFNFFEKQCKGLNNRQKECLQHVIYWHHAKPYRSNDEFSGVHKAYDFLAKNISNEQFENIIKQTTSLLKRINSVAKHYEDIDVIEKNLNWEIESFADQLEDFNYIYKGKEFPEFKLYSNNDETSQLRNKIDNNAQHNLLRACVISADRIVSKQTAQDLMDYIVEKRLDELLDDQEILSDLSVHLKNASTKFPDSERTQKQNEVARQLADLKDIAVLAGPAGCGKTKIALEWARLKDAKKIIWVCPRVQVCQGIFEELTQDYLPDAKVEILTGEFKYINENGKIKKEPEPFSGDVVVTTIDQILGSIVTHTNVNSLLPFMDAHVVFDEYHEYIGMEIFNLLFAELIANKNMRKQYEKNTLLVSATPHYYYLENILNVHEDDVVEMSSFNQSHYKIDFIEYDESVIEGNPFYKTYSDQTFIISNTAQTAQLGFVYQKDHENSVLFHSKYKRSDKKRWFDEVFDSFKKKGSQKYDVLRSGPIVQASLNITSKHMLSEMTSPENMLQRMGRLDRFGENQAVNILQVAITENLKNGSCKGSLAYFLNQLNSLQTTKAWYDFLQDRLNEKVFKLAELYKLYREFYKKQVQLDDRSAVIQDMDKALKKSIDLMNKKVTEPTKVMKSKMAERKSKISKNSLRGDSRFVQLAVLNLNDFKQPIFENKYAYTPPVDDTTEYDNLTESLNIIKDLGLINFIAQKHGNVDSTHPVKGIPEKKQQARCAVLENYARDADFPLYLSYIEDDLNKVGGTGVRHPEAIYYAITDKQPIGSISLDKLNFLTTEQEEK

SEQ ID NO: 12974 - protein, 1017 aa, Acinetobacter sp. ANC 3880
MMIVTFISQCEKKAIARTRRVLDAFADRISDNAWQTVITEDGLLAVKNLLRKTASKNTAVSCHRIATRRRTELVWIVGNRNKFNSEGIVPVNWTTKELFMDLPLETKEILANTHGQPLSQHLFAVGYLAYLLIQRLEINNVNLARSAFVAGILHDIGKLDPQFQQWLNKKANKTDDEIQLPDDGVHIDSSVQGFKKFSFEDHPRHHEISWLLAKSLLDGNTQFNQSQLDQVFHGIYWHHTRPYRAAEKEKFFLTAEGIDKLFIKSLTATTIDKVCNQVAAVFSDIKTIGHIFQTDDFSIESLVPVWSYRYKCVKGETPNYKNYEDISIDVVDFVENIKPNALNNLVRMAVIHADRIVSALSAEDLTEYLVEGTLANALNDVIQEGSNLAHEIGLCLNGFNQKYPDSERNLSQAKVAKDLADLRQNAEFDDQANIAVLQGPAGCGKTKIALEWAMNTNVQKIIWVCPRVQVCLGLLYDLTQSDYLPNSRIEIFTGEYKKILTGDITFDQEDETDAEDYFSGDIVITTIDQVVNNIISHQKVTGMTGFMQAHVVFDEFHELISMPAFNLLFSELIEAKKLKKHQANVLLVSATPHDYFVKNVLNIDSNYLVRASSFNQADYQLEFVSYDETVEKNPLTNDAISNGKTTFIISNTAQDAQLGFLKHQNKENSILLHSKYTKNDKVEWFDKVFNSFKQNGSQDYKVLRSGPIVQASLNISCEQMYTDLTCAENWLQRLGRLDRFDKNNAVNIYTTVLPKSAEIGKQTSGKAKFLANMHVWHSTVAWLSYLKRYLLDESVKTIKINQIYQIYQAFYADKSCIAKVEEDLKVALRYSVRMINEKVIDPISMPNRSKKQKDGVAKIASVSLRGDSRFVQMAVCVVNDSLQPTFIEEYAYPENTDHSKVTIGLTEGIDRIQGGRYEMRDSNKNLLAFMHKKHHNVMKAKNPAEDYKASRFDWELLKLARSPEYPIYLSYTPSDLEPIGGERERHQHAMYYVKAVKQPVGMMTIDKLSQSLLTENE

SEQ ID NO: 12975 - protein, 899 aa, Aeromonas diversa CDC 2478-85
MEKLKDPILFSRLHPQATILWAKSGEDQGHPLLAHMLDVAAVAEAILELEPATTHQHLAAQFGLAAETAPRWLATLAGLHDVGKAIPGFQAKWEQGQALAKAQGLTFASTSLRSDRHDWASTAILKKWLSAHTGADVIWCTQVAEAVGAHHGYPLTTKEVGDGLPLREDKAWQQARQALLDAYWKVLTPSGVATTDELTLPAINWLAGLTSIADWIGSNLEWFSLGIRHDDLRQHYLHAKALAHQALATIGWRSFVPMLSEPVSLDRQLGQMLAADQPVTPRALQQQGVALLQQSQGPALLLVEAPMGEGKTELAFMAHLHLQRANGHRGFYLALPTQATGNALFARARQFMDAFAHGPAPDLQLIHGGAARQEMMAALKDVWGEDGKQSEGIEAARWFSRRKRPLIAPYGVGTIDQALFSVLNVKHHFVRLWGLANRVVVLDEVHAYDTYTEGLIEALLRWLKGLGCSVILMSATLPTKRRDGLLKAWRVDPAVLPELAYPRLVLADDRGLDWDDQIESRMMEPVRLAGCGTTPEELLCVALEALTHGGSGAIIVNTVERAQQLYSLLKAKAPEDLILQIFHARFPADERAQREAAVLSTFGKEGKRPARALLVATQVVEQSLDIDFDFLISDLAPVDLLLQRVGRLHRHQRPARPGPHRQPVLTVAGLLPGELPDLATTRWRFVYDPYLLAMTWVRLLGETSLQLPQDIDRLVQAVYGDGELPDPVSEALRQYIEEYSYATYLAAEQHQRQLARNIVIRADADLGTYSNKPRGYEEGEGEEKGLINCTRLGKPSVTVIPLFVSDKGVALTPDAEPFALDVPLSTELACQLCARQLSLSNQVLVKAIKQQPDVQAFAQSPLLRHSYPLLLDSDGRAQLDGRLVVWLDGELGLIYRNRE

SEQ ID NO: 12976 - protein, 788 aa, Clostridium  innocuum 2959; identical to SEQ ID NO: 12526

SEQ ID NO: 12977 - protein, 725 aa, Clostridium  clostridioforme CM201
MQYYAHISDDKARRQTVKEHLTGTARRSELFAEAFRCGAWGYGCGILHDIGKYSQGFRKRLEGGSITDHATAGAQEMMGLYARTNPLAAYCAAYCISGHHSGLLDGGRNGDTAGEATLQGRLKKQLEDYSPYKDEVEMPDFPGLPFRQIGKGGFSLSFFIRMLFSCLVDGDYLDTEQFMLGHDAGRGDHDCMDVLLRRLESHVESWLSNDDLISVNGRRTAILKACLQAGRRKQGLYQLTVPTGGGKTVSSLGFALRHAVEHGLDRIIYVIPYTSIIEQNAQVFKEILGKKNVLENHCNVTYEDNESARELKLEQLAAENWDKPVVVTTNVQFFESLFASRTSACRKLHNIANSVIIFDEAQMLPVKYLMPCIRAVSELICNYHCTAVICTATQPSLQPFFPAKIQELEAAELCPDVKGQYDFFKRTRIHLAGRISQEHLVKELEGRHQVLCILNSRKRVQRIYESIEDRGTYHLSTLMYPKHRKELLKEIRGRLSSGEPCRLISTSLVEAGVDFDFPAVYRELAGIDSVIQAAGRCNREGKRDPEECITQVFTLEEEEDIHIPQELKLPISVAGQIVEKYEDISSPEAIGEYFTRLYRYKGEGLDAKDVVEQFEQGSHSFMFPFASVASEFRLIESNTRTILIDTEPQAAQIAMQIRRGEHNRELIRQAGQYCVNVFEHDFEALNGAGRLEQIDQEFYVLRNKEQYTRERGLVIDVSRGDAVMF

SEQ ID NO: 12978 - protein, 725 aa, Clostridium  clostridioforme 90B1; identical to SEQ ID NO: 12977

SEQ ID NO: 12979 - protein, 756 aa, Clostridium  clostridioforme 90A8
MNEQINFSPLVEDEKEAFKQKLFTTELWDTALARRNQLLKVHSTNVSKLAREFAGKFGMEALLDVAGYLHDYGKATLEWQEYFKKKLLHEDVAIVPHSIHGAKYGFAKANSYHYIAELLGNVIMSHHGMLYDSISPDGETLLNDILTSNTAFIVPRECSIDFSMLNDEFMKIINADKNADKPFYLSMLIKLIYSCLIDADRLDAYLVESGNVFSPASPNWDYLISKLEEKLSKLQAKEQSKISVLRKTVSENCKKAGLRDIGIYKLEVATGGGKTFASLRFALEHAKHHKLDRIIYVIPYLSIISQSAKEIRTALNLDEDTVLEHHSDFLPDDEQYYKLHTNRWDATIILTTQVQFLESIFSAKGSELRKFHSMANSVLIFDEAQSIPIKCIHLFNSAMNFINKVCKSTILLCTATQPPYEEALRRLNFSDNPSLTDYIEPPKRYEIKNELRACGYTYPELADFVTKKLQKATLVILNTKKAVRLLYQELSKRNISAIHLSNSMCPAHLHDKIEEIIKCLEEGKPVLCISSQLIEAGVDISFDCVIRDLAGLDSIYQAAGRCNRHGKSDSKNVYVINIKDEDLSKLPDIRAGANITRRLFDEKRNDDINLYYKYYFYSQKNEMDYNIDGGSIYDLLSGNEQGQRAYQKRKDKQGIEPPKIRSAIRSAADEFFVIDKGHTEVVVHYGKSTELLESYNTTKDIVEKRKLLKQLGRYSISLYSYQLDKLKKNHAIDDESYKGLTVLKNSFYDEIIGLNI

SEQ ID NO: 12980 - protein, 725 aa, Clostridium  clostridioforme 90A8; identical to SEQ ID NO: 12560

SEQ ID NO: 12981 - protein, 725 aa, Clostridium  clostridioforme 90A7
MQYYAHISEDKTRKQTVKDHLTGTARRSELFAEAFRCGAWGYGCGVLHDIGKYSQGFRKRLEGGSITDHATAGAQEMMRLYAGSNPLAAYCAAYCISGHHSGLLDGGRTGDTAGEATLQGRLKKQLEDYSPYKNEVEMPDFPGLPLRQIGKGGFGLSFFIRMLFSCLVDGDYLDTEQFMLGQDAGRGDYDCMDVLLRRLESHVESWLSNDDLTSVNGRRTAILKACLQAGPRRQGLYQLTVPTGAGKTVSSLGFALRHAAEHGLQRIIYVIPYTSIIEQNAQVFKEILGKKNVLENHCNVTYEDKESGKELKMEQLAAENWDKPVVVTTNVRFFESLYACRTSECRKLHNIANSVIIFDEAQMLPVNYLMPCIRAISELICNYHCTAVICTATQPSLQPFFPAKMQELKAEELCPDVKGQYDFFKRTKIQLAGRISQEHLVKELEGRQQVLCILNSRKRVQRVCDSIGGRGTYHLSTLMYPKHRKEILKEIRSRLSSGEPCRLISTSLVEAGVDFDFPAVYRELAGIDSVIQAAGRCNREGKRDPEECMTQVFTLEEEEDIHIPRELKLPISVAGQIAQKYEDISSPEAIGDYFTRLYRYKGEGLDAKDVVEQFEQGSRSFMFPFASAASGFRLIESNTRTILIDTEPEAAQIAMQIRRGGHSRELIRQAGQYCVNVYEHDFEALSGAGRLEQIDREFYVLRNKEQYTRERGLVIDVNRGEALMF

SEQ ID NO: 12982 - protein, 725 aa, Clostridium  clostridioforme 90A1; identical to SEQ ID NO: 12977

SEQ ID NO: 12983 - protein, 725 aa, Clostridium  clostridioforme 90A3; identical to SEQ ID NO: 12977

SEQ ID NO: 12984 - protein, 725 aa, Clostridium  bolteae 90B3
MQYYAHISEDKTRKQTVKDHLTGTARRSELFAEAFRCGAWGYGCGVLHDIGKYSQGFRKRLEGGSITDHATAGAQEMMRLYAGSNPLAAYCAAYCISGHHSGLLDGGRTGDTAGEATLQGRLKKQLEDYSPYKNEVEMPDFPGLPLRQIGKGGFGLSFFIRMLFSCLVDGDYLDTELFMLGQDAGRGDYDCMDVLLRRLESHVESWLSNDDLTSVNGRRTAILKACLQAGSRRQGLYQLTVPTGGGKTVSSLGFALRHAAEHGLQRIIYVIPYTSIIEQNAQVFKEILGKRNVLENHCNVTYEDKESGKELKMEQLAAENWDKPVVVTTNVRFFESLYACRTSECRKLHNIANSVIIFDEAQMLPVKYLMPCIRAISELICNYHCTAVICTATQPSLQPFFPAKMQELKAEELCPDVKGQYDFFKRTKIQLAGRISQEHLVKELEGRQQVLCILNSRKRVQRVCDSIGGRGTYHLSTLMYPKHRKEILKEIRSRLSSGEPCRLISTSLVEAGVDFDFPAVYRELAGIDSVIQAAGRCNREGKRDPEECITQVFTLEEEEDIHIPRELKLPISVAGQIAQKYEDISSPEAIGEYFTRLYRYKGDGLDAKDVVEQFEQGSRSFMFPFASAASGFRLIESNTRTILIDTEPEAAQIAMQIRRGGHSRELIRQAGQYCVNVYEHDFEALSGAGRLEQIDREFYVLRNKEQYTRERGLVIDVSRGDALMF

SEQ ID NO: 12985 - protein, 794 aa, Clostridium  bolteae 90B8
MIAHRRDDGQEQDWKEHSVHVAGLCFQAAEKLRLGKMARLIGLLHDLGKGTADWMSYLRGTGSGHPNHAGLGALYVHRLWWERETDPEKRQAAQLISLCIYGHHTGLPDCLSDSGDSPYLNGLREQPENDYREAVANFYVEVATEEELDELFAEAYKELKEFGLDSRSFNWGMLARLLLSILVDADRWDSACFEYDANPFETSCEAQPDWDKLLIELEAYIEKFPKEGRLAPIRGDISGWCRAAGEYGPGIYTLSVPTGGGKTYSSLRFALAQAKKNEQRRIFYLIPMNTILDQNSGDIREALSDYPSILEHHSNIIPEDETEEKHYRRLTERWESDIILTSLVQFLDTLFKNGNGKARRMYRLVNSVLIFDEIQALPKKCRELFKRALQFLVQYCNCTVLLCTATQPNLELDTKELVPDVAALYQNLKRVRYIPQMKARTYQDAADDIAMFIREKTSVLAIVNTKDAAFNIFRGISDRLNALNYKQVQIQQGLSDEELKECAKGCREDEILSVHLSTLMCPKHRKEILRWIKAWLLGKKLVCCVSTALIEAGINVSFPIVVRSWAGIPSLIQAAGRCNRNCEEDTGRVYIWNLTEESLGPLPDIQKGKEFSMSLLRDVENPDELGNPEMIKKYFAKEEICTKAVENYPYKKWNSDLVTMLSRNCQCRCAAGNLREEDNPLADLSKRFYQSFRTAGTVFQVIDQKTKSVIVPYGKGKELIEKLGNRHTLCEEITLLKEVQQYSVNLYEHIFKRLDGEQALYSLGETGVIILKDEYYDPWAGIKITPQEMIELIV

SEQ ID NO: 12986 - protein, 725 aa, Clostridium  bolteae 90B8
MQYYAHISEDKTRKQTVKDHLTGTARRSELFAEAFRCGAWGYGCGVLHDIGKYSQGFRKRLEGGSITDHATAGAQEMMRLYAGSNPLAAYCAAYCISGHHSGLLDGGRTGDTAGEATLQGRLKKQLEDYSPYKNEVEMPDFPGLPLRQIGKGGFGLSFFIRMLFSCLVDGDYLDTEQFMLGQDAGRGDYDCMDVLLRCLESHVESWLSNDDLTSVNGRRTAILKACLQAGRRRQGLYQLTVPTGGGKTVSSLGFALRHAAEHGLQRIIYVIPYTSIIEQNAQVFKEILGKKNVLENHCNVTYEDKESGKELKMEQLAAENWDKPVVVTTNVRFFESLYACRTSECRKLHNIANSVIIFDEAQMLPVKYLMPCIRAISELICNYHCTAVICTATQPSLQPFFPAKMQELKAEELCPDVKGQYDFFKRTKIQLAGRISQEHLVKELEGRQQVLCILNSRKRVQRVCDSIDSRGTYHLSTLMYPKHRKEILKEIRSRLSSGEPCRLISTSLVEAGVDFDFPAVYRELAGIDSVIQAAGRCNREGKRDPEECMTQVFTLEEEEDIHIPRELKLPISVAGQIAQKYEDISLPEAIGDYFTRLYRYKGEGLDAKDVVEQFEQGSRSFMFPFASAASGFRLIESNTRTILIDTEPEAAQIAMQIRQGGHSRELIRQAGQYCVNVYEHDFEALSGAGRLEQIDREFYVLRNKEQYTRERGLVIDVSRGDALMF

SEQ ID NO: 12987 - protein, 725 aa, Clostridium  bolteae 90A9; identical to SEQ ID NO: 12984

SEQ ID NO: 12988 - protein, 725 aa, Clostridium  bolteae 90A5; identical to SEQ ID NO: 12327

SEQ ID NO: 12989 - protein, 725 aa, Clostridium  clostridioforme 90A6; identical to SEQ ID NO: 12977

SEQ ID NO: 12990 - protein, 725 aa, Clostridium  bolteae 90B7; identical to SEQ ID NO: 12327

SEQ ID NO: 12991 - protein, 725 aa, Clostridium  clostridioforme 90A4; identical to SEQ ID NO: 12977

SEQ ID NO: 12992 - protein, 720 aa, Bacteroides salyersiae WAL 10018 = DSM 18765 = JCM 12988
MSKYDSILAKSTKNGGTTLRVHLESVAQLAMLAARCMGMDPEIARLGALLHDIGKANPLFQQSLEQERTSFFCSEFPFRHEIASLFFLNLVDRALWDPVIDMIIAHHKSVSNDDRKKGILDLEDEYGDEILEYHLSDFSAWSMDALGILGELSFPGVTSETVITEQDARCAYDYALTHCGKKTKGWAVWKGLLMGADHLASATEEQKDRLPDLFTIPDLHFYNRQSELYPLSLIESDVTKRHSFVKAPTGAGKTDFLMKRCRGRIFYTLPFQASINAMYERIAHDLGDCVEDVRLLHSISQLVIEDNRIVEKAIQNKFGAAIKVLTPHQLAAIALGTKGYEAMLFDLQGCDIILDEIHTYSDMVQSIVLKMVEVMNHIGCRIHVGTATMPSVLEQAILQILGGRENVQYVELPEDVSDSFNRHIVHKADSFIELLPVIRQAVDEEQKILIVCNRVAHAQEIFKQIDELYPDTDKMLIHSRFKRKDRNRLEKELKEVYNASPHACVVVSTQVVEVSLDISFDVMITEAAPIDALIQRFGRINRKRNADTIGKYKPVYVIAPPEEDSECLPYSREVLQRSYDVLPQNALLREAELQSLIDRVHPQIKRINIGLDAVFVDGKWRLKELRHLPKSALIEMLDIDSVSCITQQDDESGKYEQAMEKERLLMEIPVRYNSLRWKKLKQLPIGSRPFVVPDAAYSSDKGLDFSKIGTEYYDTNYQML

SEQ ID NO: 12993 - protein, 803 aa, Bacteroides massiliensis B84634 = Timone 84634 = DSM 17679 = JCM 13223
MKETNIATASLPQQCRPAVKELLKEIYGYTDFRDFEVYNDLSSGKDKLKISQGQLIEEVIEESEKSMKTDSVYNFLLTAPTGAGKSLLFQLPAIYLGQEYKLLTIVISPLKALIVDQVENLRDLGYEKVSYASSDLSPEEKNEAYRQVREGETDLFYLSPELLLAYDIKHFIGDRRIGLIVVDEAHTVTTWGKEFRVDYWFLGRHLDNLKKNLGYAFPVFALTATAVWNPRGGNDMVFETIRSLRIDPCRLFVGTVKRENIGFDIRLLTIEEDENYDKAKQRVIIGRTDDFLDEHKTIMYYPFAGSIDTRIKMWVRSTNWRLVSSYYGKKDKAQKAAIVEAFKEGDKRMIIATKAFGMGIDISDIDRVYHVAPSSTFVDYIQEIGRAARDKSIKGIAATDFHERDFYFMKRLHSAGAITQNQLGMILKKLWEIYLMKGKSKEMQVSLSDFEFAVKLPRKQNKLEYESDLGQVIKTALLWIEEDLSSRFGGQPIEINSRTLFTDGYVQEKTGDTAFRETYKKFMTPVVGAEGIYKVSFEALWESCFSEMGYREFKRDLYNGNLFEGVRAAAVGKHEVLLKEDAGDICTKLASLLKRLKDLLTVSLYGNKGKFEEDDLRSIFAEYDMDVPSAKRFLSSLLESRVEEGRSVSYISSTKKKDEDKLVFTVTRGFDLLLSRYQKLCSQRITGVKGDLLLFYTTPFSDLNMLLNLLSMLNVVDFTVEGGVPSVEVTVNMPEVLEKEVTSEAYKNFVLENNEKIFLEQIELFQLFFGNTSLDDEQRWEFIEDYFTGMNVEEMKKKYSPLG

SEQ ID NO: 12994 - protein, 722 aa, Caldisalinibacter kiritimatiensis
MIYAKSNPKETLREHTEKLINNYYLLKEKYGQKIQNDKMWDLLLLAVKYHDTGKIYTHFQNVIRKKIGKEILPEAISYDIPHNYLSPVFVPFKELELNKDEKKILIQAIGYHHERDKEIDRDKIKEVIEKDLKQKVNNLKEELEIEISNKLGTKYVQKLKPRNRIKLNDDNYNLYVLVKGLLHRIDHSASAHQVIELDRNENVAEYTLKYMDKQGFNLREVQRFAKENKERNLIIIASTGIGKTESALFWIDNDKGFFTLPLRVSINALFDRVKKDIEYDSVGLLHSTSLDYLDEEGYENWEEIYEQSKILSSKLNFTTIDQIFKFPFKYRGYEKIYATMSYSKVVIDEIQAYSPNVAAVILKGLEMIHEIGGKFMIMTATLPTIYLDYLKERRIIEEDLQIQYFLSDVIRHKISILDKDINKDIDKMIQMGKEGKVLVIVNTVDKAIELYNYICEKDFSNTFLLHSMFIQEHRAKLENKIKEFAKDKTAKGIWITTQLVEASIDVDFDYLFTELSTLDSLFQRLGRCYRKRKYDLKEPNVYVYTEDVSGIGSIYDKEIFKFSKEMILDYDMKELSEKDKVKMVEKLYSKEKLNGTKFMKDFKTAIKYLDTVEDYDVNSKEAQKILRDIQNITVIPREIYDSISKLIEKYQNEKNSNVKRKIRRKINRKTVSIPVYKAKGKVSSIDIEGLKNIKILERKYDFDEEKELGQGILIEEELENIF

SEQ ID NO: 12995 - protein, 760 aa, Enterococcus raffinosus ATCC 49464
MSDQFWAKSSGETIVHHTQQLLTNYDQLTDHYPEIPVNWDLLRLICQYHDLGKMNHLFQEKIREGVMKKDGEIPHALLSIAFLPLKQLKKIYSNEELKAATYAIALHHERDFSQIESDHYKQEITLLAEPAESFPFSEVKLDKPAVIKRPSATFYKLLHKLSGKDECFKDYVMLKGLLNRIDYAASGDYNVEYPANFLNKNMPKVRESWREKSADPTIDWNDMQKYVQAHQDENLVVIGQTGLGKTEAGLLWIGDNKGFFTLPLRTAINAIYERIREGIADEEDKRYKEQVGILHSDSLAVLLARQDENEEVELDQLESYLTETRGWSLPLTITTLDQTFDFVYHHAGFEQKLATFSYSKVVIDEIQMYSPDLLAYLIKGLKEIQDFGGKFLVMTATLPPYLLDLFKKRKIDWKMNEQPFLNPKLLERHNVQIMKEGITAEAVAELYHSGKLLVICNTVRKAKEIYKQLADLMEDVPIHLIYSQFIRKDRQEKENAIQEFANSNEEGIWIATQVVEASLDIDFDMLITELSELNGLFQRMGRCYRKRALVDRDQPNVYVFDGGDGVTSGVSNSEQAVVQQEIFQLSKSALRDNESGIYNELNKMRLIEKTYTTENMKTTSYYQRVETMLRWLSAVEDDGKNIAEVRKLFRNIQSRAVIPEDVYNKNSEQIDKYLELLPLTNKKLALLGHENPKMYRQRIKSELEDYMMSIPEWLFRKCLKQNQVRVEPVGRFDQVFFVKGEYKKELGFQVLKGEEESNIF

SEQ ID NO: 12996 - protein, 811 aa, Enterococcus haemoperoxidus ATCC BAA-382
MFIAHIRELDGEEQLLKNHLKNSAKLSGHWGKKFNLEKTCYLAGLLHDFGKYSDEFQYYLRQAVKDPNSVNRGSVDHSTAGGKLLFEYLHQEEVNPFQLFLAEIIGDAIISHHSSNGLQDFYKPDDMRSVYLERVVEKTIPEYDLMKERFFKEVKSEAEFQSDLRVANKEIEQFHQNIKTEHAYFFLLKFVYSCLLDADRTNTMLFEAHREEESVEVDTHTLLKNYQQHLEKHIEELKKSVPKTAINQLRTEMSETCKRFAGHPTGIYSLSIPTGGGKTLASLRFALNHALQHSKDRIIFVVPFTTIIEQNAQVVRNILEDDQHILEHHSNVFTEERVDQEDESESLEQTQELMKDNWDSPIIFTTMVQFLNVISSRGTRNPRRFHNLQNAVIIFDEAQGVPIKCTHMFTESLNYLKNHGQTTSVLCTATQPSLDKLPKELEKDGEMIQNLSEIEKSFKRVDLVGKLKNGAWSLNELADFGQEILEEKNSLLMILNTKSAVLKMYQELKERSLSNVKIFHLSTAMCPVHRKDILKELRKQLKNTKKDQKILCITTQLIEAGVDISFESVIRSTAGLDSMAQAAGRCNRNGEAGKQAVYLVNVSSELEKLSRLKEISVGKEVTERMIKDNNEQPRLYDGELLSAKAQTSYFERYYNHEKIENELVYPVKKSSLTLFSLLGNQKNASQQYLDKHRKKLGLVLGSSPQTIGHHFEVIEDFTTSVIVPYKKDNAQGARIIEDLNGELSPNEVVPLIKEAQQYMVNLFDYEITELNKNGAIFPLYNGNIFALTENSYSNEFGTDPTALAASDELIF

SEQ ID NO: 12997 - protein, 358 aa, Enterococcus faecium EnGen0153; identical to SEQ ID NO: 12395

SEQ ID NO: 12998 - protein, 716 aa, Butyricicoccus pullicaecorum 1.2
MKPFTTYLAHIAADGREQTICDHLAGAARLAQNFAQSFQADDQGELVGGMHDVGKYSQEFQKRIHGDSHRVDHATAGAFECYQRGQPFAAFAIAGHHGGLPDGGAQTDCVDAATFYGRMKRAMQGKLPVYDAWKPEINPPQAYIPDFTRKGLAEGMFFTRMLSSCLVDADYLDTEAFMTGNTRSSDRCASIEQLWDRLCAYTAGWFPPVREINRQRCAILERCIKEGENRSRGLFSLTVPTGGGKTIASLAFALSHARQHGLDRVIYVIPYTSIIEQTAAVFREVLGSENVLEHHSNVLYDLEGEADTRNIHLAQATENWDMPVVVTTAVQFFESLYACRSSQCRKLHNIANSVVIFDEAQMMPVPYLRPCVHAIAQLVAHYRVSAVLCTATQPALQPIFQEFLPDHPITELCPQSTCEWEIFHRVTFAQAGGLEWSALANRLNGHKQVLCIVNTRKGAQELFTRLAGDGCFHLSTLMHPAHRRAQLTEIRNRLITGRTCRVVSTSLIEAGVDVDFPAVYREIAGLDSILQAAGRCNREGKRDAKDSVVTIFQSEERTPPLFSKSIGAGQEVMQKYEDLMSREAIHDYFCRLLDLTGTDAQDKQKILHRIQTEFFPFRSIARDFHLIDNQTNTIYIPVGDGEGLIARLLSGEHSRNLFRQLGQYGVSVYQQHFEALDEAGALEIVSDGTAILRDLSLYSEQTGLSLELDFGKGLFI

SEQ ID NO: 12999 - protein, 759 aa, Clostridium sartagoforme AAU1
MEEKLYILDKDTLELIQKYMAKPDKTIKEHTLDLLENLNVLQRLGYIEEGKLFELVEKACIYHDLGKVNCEFQNRVTGKSKKFNESKEVVHNVLSLYLIDSNNFESFEDYLKVAHSVLNHHNYCNNFDEISDKTELIQGLLNDFKTYKIKKSTKSKLKCMVENNEGIKIKGYLHKCDYSASSGNIAEYPNNFLEDSLHGLLEKWKNNNSEASWNKLQKFCMENRDENIIAIAQTGMGKTEAGLLWISDNKGFFVLPIRTAINAIYDRVRNDILDNKSIDEKIAILHSSALEYYIKNIESNNAEKEEIDLLNYHKVGKQLSIPLNISTMDQIFDFVYKYQGYELKATTLSYSKIVIDEIQAYGPDLLAYLICGLEKVVELGGKIAILTATLPPFIKDLLIKNITFKENEVPFTNDMERHNLKVLNKRINSEDIRNKYNENKKLDKNNKILVVANTIKEAQKLYKELKDLVPKEELHILHSKFIRKDRMEKEREIIEFGRTYDENKDLDKQNGIWISTSIVEASLDIDFDYLFTELQDLNSLFQRLGRCNRKGKKDSSEYNCYVYTEIDNTNLTNGDKGFIDKKLYELSKEAIISYEGQISEQEKIKLIETYLTTKKLKESHYMRKYKEIYNYIKVVPPYEFEIEKIDLRNILSEEIIPSPIYEKYLEDIKDIEHKLFNENLSPYERVKWKDEIRKFTVSVHPNDIKNYERARGKGQAINFSKIYLGKHKNDYIKVIECEYDEVGYKKMKYDEIRRGSNIW

SEQ ID NO: 13000 - protein, 738 aa, Thermobifida fusca TM51
MCGLVILADWLVSQEGFLLERLTSLPADGSASALRAHFETSLRRIPSLLDAAGLRPITVPPATFTESFPHLSKPNGLQASLAKHLPCLCTGPGLVLITAPMGEGKTEAAYHVADLLGKATGRPGRFLALPTMATADQMHTRLKEYARYRVENTDLPRSSTLALLHSMAWLNPDYAPADLPGVSKVLSNLGHRDPFAATDWLMGRKRGLLAPWAVGTIDQALMAVLRAKHNALRLFGLAGKVVVVDEAHAVDPYMQVLLEQLLRWLGTLDVPVVLLSATLHHSIANSLVKAYLEGARGRRWNRSEPQPVSEVSYPGWLHVDARIGKVTRSSDVDPLPIATTPRKPLEVRLVDVPVKEGALNRSTVLAKELTPLVKQGGCAAIICTTVAEAQGVYDLLSQWFATLGEDAPDLYLLHSRFPNRQRTEITATIVDLFGKEGAQSGRRPTRGAVLVATQVVEQSLDLDVDLMISDLAPVSLLLQRAGRCWRHEHLGIINRPQWAKQPELVVLTPEQNGDADGAPWFPRSWTSVYPLALLQRTYTLLRRRNGAPVQIPEDVQQLVDDVYDDDSLAEDLEADMERMGEELAQRGLARNAVIPDPDDAEDNLNGLTEFSFDVDEHVLATRFGAGSVRVLCYYVDTAGNRWLDPECTVEFPEQGTGREGRFTMADCRDLVARTIPVRMGPWASQLTEDNHPPEAWRESFYLRDLVLIPQRVTDEGAVLPTETGGREWLLDPCKGLIF

SEQ ID NO: 13001 - protein, 445 aa, Lactobacillus sakei subsp. sakei LS25
MGQQVIACGRQFTAAQLADTQNNNYSLPQIKRRPAFLRVKHRLVCQRCQQVVPPQTCLPDGRHYCAQCLLFGRLVEGDWLYTVPECHLFENNIPKLTWEGQLTPHQEQAAQAVVEVVQTQKRHVLTAVTGAGKTEMLFQGILVALQKGQRVCLAAPRVAVCLELYPRLQAAFATTSIMLMYGEQTEPYRYTQLVICTTHQLLKFYHAFDTVIVDEVDAFPFVDNPVLATAVEQACKPQCALLYLTATPTPAIKRAIAAKQMTVSELPLRFHGHLLPEPQRHVAFNWRAQLKKGRLPKRLERDCQTCLKTQQILLFVPQVRLLQPVANRLSTLLPAVRIETLHANDPDQIKKITAFRAQQIQLMVTTTILERGVTFKNVAVLVLGAEHMVFNEAVLVQIAGRAGRHKDYAQNPVHFYYQDYTRAIKGACRQIKAQNQRGRRLQSTV

SEQ ID NO: 13002 - protein, 721 aa, Lachnospiraceae bacterium A4
MEKYAHKNDRMQLQTIKDHLEETAQLAEQNAVDLFKPVAHAIGLAHDIGKYADAFQDRINGAAAKFEHSACGAIEIRKQMGSNPFAPMMEFCIACHHTGLQDGGSGALEGTLSHRISPMREDEFTDQWDYSAYQDEISLEIPDFTKIQQLFRDLKNRSDYIELYAFFTRYLFSCLVDADFLGTERFCRPEVKRGLRADFQAASERLEEVLSKKPSDSMLQAARSRIQKQAFENAKDSAKLHILNMPTGSGKTLCSLKLALDKVLADKSKERIIYVIPYTGIIEQTAKEFQDIFGDVVEILQHHSNYSFEEEEETQTTMQKLRLACENWDAPFIITTAVQFFESVYHYRTAPLRKMHHMANAVIVFDEIHTLPVECLQPCLRAIGSITAYLHSEAFFLSATMPDYTKLFEKYAPECSISHLIKDTSEFRYFKKAQYIMLGQCSFDTLVQKASGFRQSLIIVNTKKSARELYQMASGNKYHLSALMTPVDREQTIIQIKADIQKGKQITVVSTSLMEAGIDLDFEAVFRELNGLDSILQAGGRCNREGKRDSGEVFIFEKEDEMISKEIRINTAKKLLASHQEITSKECIEQYYNEIFFFREHQIEKNSIDQGKTEFSEIPFRTFAKNFKLIKDNAVGVVINQEEACNRLLERLNTGDRTVLRSLQRYTVSLKCSQWENCEFNTALGKGLLEDCGAGVFVLNNMHYYSRETGLDLTLDDDIIL

SEQ ID NO: 13003 - protein, 754 aa, Enterorhabdus caecimuris B7
MFLAHIAEDGREEAVEDHLCAVAERAADFAARFGSEGWAYNMGVLHDIGKYTDAFQRRIKENGPRVDHSTAGASIMADSGDLGALLAYAIAGHHAGLPDGCPTGENIQRETQDSTLTKRLERFRAENSSGATWLNRASFKRLGLRGSPGTPTPLVGAQKSGGYGAGFWVRMMFSCLVDADFLATEEFMQGHERKSLPSASAAELRDTLEDRLSMFYPPRTPLNELRCRILDDCRAAATGQPGFYALTVPTGGGKTLGSLRFALNQAALSGHLGAKVIYAVPYTSIIEQNADVIRGMIGREQVLEHHSGFDFDSVDEKPEGQEHVVAHNRERPTGLGDALRLAAENWDAPVVVTTNVQLFESLHSNRTSKCRKLHNLAKSVIVLDEAQMLPVEYLKPCLAALEELVAHYGCTVVFCTATQPALDGIIEDLPRPVEISQAGLDSFEKLRRVTYCLEGELDDARLAERLRNEKQVLCILDNRKQTRVVFESLDDDGTYHLSTLMHPEHRRTVISEIRQRLKEGLPCRVISTSLVEAGVDLDFPVVYRAMSGLDSIVQAAGRCNRNDGRSSSESLVHIFEPDDSYRRPREVSQRAAVGRSVLRSVGYADGGGGLIEIDLGSPEIMREYFARLYDIRRDGMDKGGAYKKLANDRGGWGSYPFKSVAEEFKLIESADCSVIVPSEAIEEEIELLREGVAGRNAMRRLRQYSVNVYRANLPSLAGSVEQVAEDAFLLVNADRYSSACGLDLTDRHGEGLMW

SEQ ID NO: 13004 - protein, 852 aa, Lachnospiraceae bacterium MD335
MELMEVLDFTNPVYAHTDSKVYEERETLQEHTQRCQKYFSRLLEKEKMQDAFETMEPVLSGDTAKEYRDWFLQAVRDVITFHDAGKINPVFQQKAMKNKAFENIHIPQLHEQNHSVLSAYIYLDCQMACLEQMHKTTPIDQGKRIYLYEIVCINAYLIMKHHSDLDSFDAFLNAIQAGGKLYNIDQAMQQKSFRQLYRGKYSQMPVSKYVDILERAKTGPKARSFAKYTYARLVFSLLTACDYYATNEYTTGTEIKQFGSVREINDLRETFEKTQRMREIRMFHPEKAVDNGTDINYLRNMLFYEAERNLADHADEDIFYLEAPTGCGKSNVGFHSSFFLAQKGMGKIIYVYPFNNLVEQNKVSLEELFQGSNIFEKAAVVNSVTPIKRDVKTDKENGEFEENWAECNWSKSLLDRQFLNYPIILTTHVSLFQTMFGTQREALFGFHQLVGSVIVLDEIQSYKNAIWTEIMMSLQYFCKYLHCKVLIMSATLPDLAVLTGTHEGVRRLIQNRAFYFNDKRFQDRVRISYELLHREDFDEEALYAHVKAQAGEKKKILIEFIQKEMAYRFFDRLKSDEEIDAVVERMTGDDNCVDRERILRCIKTQKFEQTGYILIATQVVEAGVDIDMDIGYKDISTLDSEEQFMGRINRNAKREGIVYFFDLFSAKRIYGENDYRISETFTLKNEVMQQVLKEKNFSQYYEQVMRVIRKNRNVSSDAEGIDAFVNETGALGFRKISAKMRLIEENDWRMSVFLARTIVLSDGETVDGQDLWNRYKELLMYPPKDYAQFRVQLSEISSKLNLFIYQIKKNSNIAYSDRVGEIYCIENGEEYFSDGRLDKRKLEKEGGLFIEI

SEQ ID NO: 13005 - protein, 707 aa, Paenibacillus barengoltzii G22
MRGSLYAVRTKSGWQLRVSLDLHVDLLWWLDREAHAIYLLSEGLPFGWAVEARDSFKAFREMDRWTEQEWDLFLLQVLQEEIKAEAKLIHPAERLDKAAWIGRHRGWLMKAGQITAWGRMFYHLGNDENHEDLRTELRLMDRGGVRQGKELSADLSGAGLEKQQREDMGGELAELAEAAQRLAAALAGRSLLEAELQQLLAERLPGLAPVWRSALQHAHLQGRVQLTAGVASARPNPGPRWRRARTSRCRRCGSGVHRRTPCGSCGSRGCAYCEACLALGRSRSCALLLRGSSAGVVPPRAGGGTAAGLAPTGSLLDRWGLSPAQRSAAGQALRFLAQAQEAAAQRQVAATAHGRPALLLASRRSPLRRTETRSRPPRFLLWAVTGAGKTEMIFPLLRYALDSGGRVLVATPRRDVVLELAPRVAKAFPEEPMAVLYGGSPQRWEEARLILATTHQLMRFYQAFDLVVIDELDAFPYHNDPMLNYAAEAACKPGGRFILLSATPPARMRREIRAGRLPHAKVPARYHGYPLPVPERITMASVEACLRRRVLPPALFHLLRHSVQRGAQIFLFVTRIRQIAAFTELLRTYFPGLPIEGTSSIDPDRNEKVLAFREGRIRMLVTTTILERGVTVPKSDVYIVDADSDLFDEASLVQMAGRAGRSKDDPKGKVVFAAPAWTKSQRDAIRQIRMMNAAAYKNGFIKVKEVQ

SEQ ID NO: 13006 - protein, 826 aa, Firmicutes bacterium M10-2
MIDNQLVTHLLEDSLYAIAKSDRKDDIFFLPFAIHAVDSMMVASMLLSRYWSDFERNWLMETLQVDEAELKKLVCFLVGIHDIGKLQYEFQKQISGTIANDEIEVYNKWLNFGENITYNPDCNHTVVGEAILKNYEIGNEIFQKMIAFHHARIKGKQDLEIDAYEDEIYGEEIDDVYEIWRMVIQDIQNLAGLKSLEKLKDMSWEVFIYLTGMIQECDWIASDQKLFPLVKSYEEVLSINFDQRVRNGFKTLKYSDPWQSRYFEMDEKDFIDSFGFKPRKLQKELIKIGNNCMDLGLVICEAPMGEGKTEGALALADILASQKGCGGLFIGLPTQTNTNAMFPRIEKWSLHMMEKNNEKSSITLAHSKAKFNQEFAKLKMPKNEEETRLYVQSWTDRSQLALLPNFVVSTVDQFLMSALKYKGLFFRHIGMMGKVIIIDEVHAYDYYMDTYLKRALNWAGLYGIPVILLSATLPSEKRNSFIEAYLLGKQKKSKLDMSISVNTDFLYPVITYTDGEIIKTNSIKQTAMNQKVILKFLNPEDNLSTLLQNKISNGGCAAVIVNTVSRAQELTEQLKNDLPDDYEIVLFHSGFTWHDRKRVEEKILKRVGKNSNKIERERFIVVSTQLLEASLDLDFDVMFSELASADSLLQRMGRLHRHKIHDLLRPKETKKPVFYIMNAQPDTWSQGTKEIYSSWILWRTLENLSEFICIPEDIPYIIENTFKPISEEENKNIKLRELEKEYTNKKKEQEIKATSFLLSFPDQDIEVSNILTRTQSVDNENIAVQSVRDILASIDVIPLKKGIQSVDKLPILKKLNFNKIKVGKKV

SEQ ID NO: 13007 - protein, 719 aa, Anaerotruncus sp. G3(2012)
MDYIAHYREQDQVAQTVKEHLEGTAQLAERFAAPFQSSELAGLCARMHDMGKYSEAFQKRIRGGKLRPDHSTAGAQALFRQNPKIGKLLAYCVAGHHGGLPDGGDQADTEADTTLAGRLLRKLEPHDAFFTENDLPAIPTRPFALQPASRKSIGFTLSFYIRMLYSCLVDADFLDTERFQSNGTIDREIPSDLELLSHRLDQKLETFGHSDRPIDQKRCAILRDCIDASVHPRGLFSLTVPTGGGKTLSSLAFALRHALKNGLDRVIYVIPYTSIIEQNGAVFSELLGAESVLQHHSNFDFSADDEHGILKKQKLASENWDVPLIVTTNVQFFESLFSNRPSRCRKLHNIANSVILFDEAQMLPTEYLRPCTQAISELVRNYRCTAVLCSATQPALGRFFPPSAIQEICKDTDGLYRFFQRTRMVLRGELSNDALCEELQRLSQVLCIVNTRSHARALYHAVGGSDSFHLSTLMCPIHRKAVIDEIRRRLRAGTDCRVFSTQLIEAGVDVDFPVVYRAMAGIDSLVQSAGRCNREYRHSVGDVFVFEPEPAYQPRSHSLRRPAELARNILQKHPDPLSLETIHTYFTRLYEVSGDDSLDIKDICRKLEASVTAYSFPFAEIARSFELIGQATRPVVIPFDQRAEQLIAKLRSGPPQRDLIRAMQPYTVSVYEPEYRALQADGKLEQPCDGLSILADPEGYHPQTGLILSEGSGGQGIFF

SEQ ID NO: 13008 - protein, 723 aa, Lachnospiraceae bacterium 10-1
MIAHINNLGEKQSVKDHLEGTAELAKMFAEEFDCGEIAYYCGILHDIGKCSDEFQKRICDPEHVKKVDHSTAGALEAMKEGNIPVAMAAAGHHSGLMDGGNYNLSMEGDGTFFGRIKKQVPNYSKWKEDITFKNVPLPLFCSKGTKFTMSFFIRMLYSCLVDADYLDTERFMNGGKENRGNYSSINRICSSFDNYINGWLHKTDFTCKDQEELCKRRNFILKNCLEKGKKLNRGLYTLTVPTGGGKTTASLGFALKHMKNNDMRRVIYVIPYTSIIDQNAEVFRDILGDENVLEHHSGISYERTEDQAENFDTYQKALATENWDMPVIVTTAVQFFESLFASKSSKCRKLHNIANSVIIFDEAQTLPMPYLEPCIAAISELVQNYKSTVILCTATQPALDGIFRKYGFHGEIQEICDSVEELYQKFKRTKISNSGVLSFLELSQKIKEKEQVLCIVNKRKTAQELYTNVNKEGTYCLTTLLYPAGRKQQIQEIRYRLDKGMPCRVIATSLVEAGVDLDFPEVYRQETGLDSLIQAAGRCNREGKRKVEDSNVYLYKIDGENNSFNSQNVDALFETLRFYEDPTDLKAITHYFMLYRGLLGKENLDQKKIMDAWERGIDGRLFPFSTVSEKFHLIETQTNTIYIPVDEGESLIGKIYDGQMNRELLRKLGQYSVNIFPDHFKRLVEYGCLEMVSNAIYVLRDMNQYRKDIGLQMDVETGFGFYI

SEQ ID NO: 13009 - protein, 866 aa, Dorea sp. 5-2
MNLLAHITDAGDGRVEQGLKEHCLHTGEYAARGIGSVGLYHTAYLAGILHDAGKAKTEFVDYIEKAYQGEKVDRGSVNHTFAGVIWILERYHTDTSSIWEKLASEIIGYAVGSHHGMFDCVDLNGENGFLHRLKKDKKEIFYQEAMHNYFTHVLEEDVLDWIFQRSVQEIKLFFRSVKETYSKDSKSVFFQISMLVRLILSAVIYGDRRDTSEFMGGKGNADIRESMGGEEYQYPGGRKDTDTSVWQSAKVGDHRADWKRRREYFEQKIERLRKDSPINCVRNAISNQCMEAAGREPGIYRLNVPTGGGKTLCTLRYALAHAEKYNKKRIIFIIPLLSILDQNVKVIKDFVPDEREVLEHHSNVVREREMNGEELDHYEYLTDSWNYPIVVSTLVQLLNILFSHQTSAVGRLQALCDSVIVIDEVQSLPKKVTAMFNMAMNFLCQFCNATIVLSSATQPCFEELKWSLRPAKEPDLVRLNQEQLQVFKRAAVIDHTDKYGMDWEECAAFCNEIMEQQDSLLIICNTKSEARRLFEKLKERSEDLDWDIYHLSTAMCQEHRWNVIEEMKESLRKVQHSAMDGEETLKGDGACKRGGDLKGACLRKVVCVSTQLIEAGVDISFASVVRVMAGLDNLAQAAGRCNRSNEYGREGKVYLIKLKYENLSMLPEIKKAQDSTRKELDTRKSLDTGDEWEGGLLDEPSIRRFYRYLFRETEKEIRYPIQDCGRTIYLADLLSNKNDDAEQGVNKSKNEAYVLRQPFKTAGKNFRVFSQDTTDILVPYGDGAQIAGQLESMQDEWFDFGKFKEIMKQAKKYTISIYEWQKEKLYQAGLLSAVLDGRALVLDEKAYDECFGLTVVEEQAVDNYIL

SEQ ID NO: 13010 - protein, 743 aa, Enterococcus saccharolyticus subsp. saccharolyticus ATCC 43076
MEGKKFLAKSDGETIIQHTKLLLKNLDILKEIYPDINVNWALLKLACIYHDLGKLNEKFQYKVDKNLRTTAGEVPHGLLSTAFIPAKELIHKGFSKEEVEILAYAIGRHHERDFSKVSIADIKREVSTLDVTDFPYQQLGIDELHIRVLSKKYFEHDVHMSVIQFGDAYFDYVMLKGLLNRLDYAASGHIEVEHPNDFLIDSMGNLGYQWNDLQEYMLTHQKENLVITAQTGLGKTEAGLLWLGNNKGFFTLPIKAAINAIYNRIVTKVVKDTQEQKIGLLHSSIHQEYLRAKDEGIFEELLDVDNYVNRTRQLSLPLTVCTLDQLFDIVFRYPGYEQKIATLSYSKVIIDEIQMYSADLLAYLIYGLKMITDYGGSFAVLTATLPPYITDLMMKEGLRFKQPKEGFVDENLMIRHSVEILHETMNTSKIIRVFSKNKILVICNTIKQAKQMYQQISDEVGTECVHLMHSAFIRRDRTQKEKDILDFAQNGNTDAGIWISTQIVEASLDIDFDILFTELSDLSGLFQRMGRCYRKRPWIPEIGINVYVYDGGSKNCSGIGTVIDKEIYELSKNALLQVSGPLTESEKIKLISQMFTTDKVKTSTFYQSINDHLEFLELLFEGEKTKNEVLNEFRNIHNLSVIPSSIYEENKKIITKLVQLLKIPSKIATSQEKIEKKKGRILLNEYKVDLPMYALKGLEIEELEINDYEKISILISCNYDSNNGIELHKRQKKADIDVEDQFF

SEQ ID NO: 13011 - protein, 811 aa, Enterococcus haemoperoxidus ATCC BAA-382; identical to SEQ ID NO: 12996

SEQ ID NO: 13012 - protein, 743 aa, Enterococcus saccharolyticus subsp. saccharolyticus ATCC 43076; identical to SEQ ID NO: 13010

SEQ ID NO: 13013 - protein, 760 aa, Enterococcus raffinosus ATCC 49464; identical to SEQ ID NO: 12995

SEQ ID NO: 13014 - protein, 710 aa, Indibacter alkaliphilus LW1
MKPKLFAKSVHYGAIPLEDHLRAVGDTAFAFAETFGLDKEIAKTGGLLHDLGKAHPYFQNVTLGDQLPTPTQQRRFGSRPPFRHEISSLLFLPLFIKDLWPPLTEMIVGHHKSIDADRGILTLDSNLDEALTELHLGEWEEWSPAALEVLAKLGIATKKVSREEAENALEWVIDYCDQTDTGWSEWRGLLMAADHFISATEGKLNKKELPLFKSPDTTAFKRTSSLFPLSLLPADIPEKHTLLVAPTGAGKTDYLLRRCKNRLFYILPFQASINSMYDRLKAAMPSDDIRIQHGSSKLVDLEQGDEYAAILQPHCGAGAKVMTPFQLASIVFGSFGFEAQILDVRGTDVILDEIHTYSDGAQAIVMALVDRLVKLECRVHIGTATMPSALYNELKKVLNRGGGVAEVSLSPKDLSTYDRHIVHKISNEDWLDVLKEAMSMEEKEKVLIVFNTVKGAQDAYKIVEKEFSTVNKLLIHSRFKRQDRNDREAQLMAMESSDDRCILVSTQVVEVSLDISFDRMITEAAPIDALIQRFGRVNRRRTNAEKRLLKPVHVLEPSENTLPYKKKIVAESFELLPSGGSLKVTELQCMLDQVYPEVDMQGIETYIAWREEDFRYKKLSNVHGQPLLDILEMDSDVCILGADQKAYEEANWIERTKLEIPVNGKSLRPYRQHYPRLENVGNAPLVIHDEGVLELYQNLGLVLKDPDNIW

SEQ ID NO: 13015 - protein, 845 aa, Fusobacterium nucleatum subsp. polymorphum F0401; identical to SEQ ID NO: 12376

SEQ ID NO: 13016 - protein, 897 aa, Actinotignum schaalii FB123-CNA-2
MRTHPNVWAKQRGTETSYPLLAHLLDTATTAGVLYEVWLRPGLREVLGAAGKREVVEWVAGSHDIGKACPVFQYQQTQKGPQWDEIRAALRTKEPQLGDISTWSRNFCEDYAPDIRHHQKMSALLLHRKAIIPDAYAVTSWKYLPALGHHGHFEAPSWSKQETNYLFEDIESTGWLALADDLLTCLEEGIGITRADLPAELSPTATILLSGLTVLADRIASGTEWVAAQQELLAAGKLTLDDPDGWITACRARARARIEETVGVYHGWESAEQSQRAILGNRTPRPLQEEATRVGGGLWNVMAATGVGKTEAALLRHATANERLIFLLPTQATSNALMRRIQRYYAGTPNVASLAHSLASTEDFYNQPVTMGNDRSEAPGKASTTSAEHGASTAGLFPTDFVRSGSSRLLAPVCVGTVDQALLGALPAKWTHLRLLALANAHVVVDEVHTLDQYQSGLLSNLLLWLRATNTRVTFLSATLASAQRATYLEAYTGQPPQGEAHFPLLENLDTTGTQLRSIRPDGPPRTLTIDRSTEKYCKLVSSHRDWVRDQRRRYPQARIGVMCNTVARAQELTRALAAEGNVVILHSRMTAEHRRRNAELLEHEIGSGSTGAALTVIGTQAIEASLDIDLDLLRTELCPAASLIQRAGRLWRSADPNRATRVPGLSGPRVSVVAINGTEGEQLPYLASELARVEKWLKEHNNIRIPEDCQEFVDTGTLLLADIEEDKPDELNEFAKKSLAAIRARNATYDMKYCLSKSSQVQSFTAMTQRDKNLGDERSTRLIEVETTRLIVCGDPDIIPGAWTGDPEDLGKLRGSDREGIRRALRASVPVTVTGRAKTLFTDATSLENAPSLLCRYHVLNDGAAHYDPLIGLVVPGSIPDPHCSGAPAQPATGKE

SEQ ID NO: 13017 - protein, 747 aa, Delftia acidovorans CCUG 15835
MGDFFAHSTANVSKADWQSLPDHLKGVGTLARQFAQAFGAGELAEIQGWLHDLGKYTEPYQLRLQGGALRVDHSTWGARIAARHYPGIGHLLAYGIAGHHAGLANGDGQGERSALRQRLDDGYELPALDSAWKRDIALPAKLPMVDLKPCDGKRKNFQLAFFTRMMFSCLVDADFLDTERFYLKTESRPDHRSAGKPAPSLQALREQLDHFLAGLPTGGDVNPIRSGILQHVRAQAELAPGLFSLTVPTGGGKTLASLAFALDHAIRHGLSRVIFVIPFTSIVEQNAAVFRNALGPLGDAAVLEHHSAFVQTEPLRDDPEKYQAQKKLQLAMENWDAPIIVTTAVQFFESLFAARPSQCRKLHRIAGSVVVLDEAQTMPLKLLRPCVAAIDELARNYRASVVLCTATQPALVAPDFEDGLNEMRELAPDPDRLFTQLERVRVRHLGVLDDEALAGHMRSREQVLCIVNNRRHARAVYQAMADLPGARHLTTLMCARHRSEVLAEVRQMLKEGKPCRLVSTSLIEAGVDVDFPTVLRAEAGLDSIAQAAGRCNREGRRARDTSELLVFLPGNPDWAPPPELKQYAEKAREVLRQFEAQPLAPEAIQRYFSLLYWQKGSQALDVPDLLGQLTASRFDSLPMETLAAKFRLIDSVQMPVIVPYDDKARDALRALEHAQGSVGLARSLQPYLVQLPRQGFDALRKAGAVVPVAESKWGDQFMVLAHEGLYDPRHGIHWDEPALIQTEHLCW

SEQ ID NO: 13018 - protein, 800 aa, Actinomyces sp. HPA0247
MEASDDGQQWGQARSDILRWMAARSGFPLVAPGTALPELPIAVASAYASALVIADWLASNEDYFPLRPRPVGETGKQSIEGYSELTADQQRERVERAWKRAGFPTPLRIPEAPPGEVAEFYRHRFGWPDTYRPTEAQSAAIEIATCEDPDLMIVEAPPGSGKTELAFAAAEVLMRSRGLQGVFVALPTQATTNAMFERVTAWLTSILGDEPQKLGIQLAHGKNSLNESFVKLLERGKSPLEVYDDGEDLGLHASRWMGQRWRSTLSPVVVGTIDQVLLAALKSRHVLVRHLGLMGKVVVIDEVHAADEYMETYLEAALTWLGMYGIPVVLLSATLPPARRSALLEAYRRGRGSSGAGAESVDGMIGYPAISTVSATGVRVHEIQGEAEVPKRIIPTPLESTRKIAELLDRELADGGCAVVIRNTVREAQETYEAVRSVFGREQVTLLHSRFLAAERAVRDRRMLELFGKDSAQRPFRHVVVATQVIEQSLDVDFDLMLTDPAPMDLVLQRIGRLHRHDRAERPVRLREARCLVLVEDLFAVPWAYSIRTDHIYSRYSVLRTLGILADRREVRVCEPRDYAQLTALAYSDAQSVGPAEWTEAFGIAQVAKTDAMTTSRRNANTWCLNGANITEWTASRLEESFAGNAATGEEVGGVGRAAVRDGEDQIPVIVVAVDPESCGSVMAPPLSDKSSPGEKLDVRDYAARGRIAEICSWTLSLPPWSFRERGRSIEDTVDAVEHALREDLSTEGWLCRKHPLLAGQLILVMSKAADGERLTRNLCGRTLTYTTETGMEIWVNEEP

SEQ ID NO: 13019 - protein, 823 aa, Atopobium sp. oral taxon 199 str. F0494
MSILWAHSKDEDEAEWQPLSEHLVNVSELSAEFASTFGYEQWGRALGLLHDAGKSCDRFQNERLHNRPVSVDHAAFGAKRALELYGGRGDKDDACGSGAYVGELLAYAILGHHGGMKTSIDMENRIERLGTPPSPGKAIDDYSPYYVMIDEFPDVVPPDRVDLEPTMLSRIMRSSPEALQDNAVRQIFQQHLSFSGQALTRMLFSCLVDADWIDTESFMSPEVAEKRGHDYDSIPMLLDRLENHLERLAGKAGNTPVNEARAAVLADCREGAVSKPGLFTLTVPTGGGKTLSSMEFALRHAAENDLERVIYAIPFTSIVEQSATIFRDIFGADNVLEHHSNYDFEEAAKEGREYERLAVQNWDAPIVVTTNVQLLESLFSNKPGKCRKLHNIANSVIVLDEAQTIPIELIHPTLAALEELALDFGASIVLCTATQPAVQNEWPFGSCPHELCRAHEELFSKAFDGRVHYQIVGEILEKDLVDKLIQLHQALCVVGKKAEALTLYRDVVARARESALIEDNREPYEEGFFHLSAHMIPVHRSQMIAKIRNRLDAGKRCVVISTQLIEAGVDVDFPIVWREMAGLDSIVQAAGRCNRNGGRTDEVGEKVPGDVFIFEFAERDEAFVRSGTRSFLGKTRSIASELLNVDGLGIDANTVDLYFRRCYQTEGLDAKCIVGDDGKGHRKYGSSGLYEDMSDQKHLSFSKGLLSRYMDYCYDFEMYARTYRVIEDSGESVFVPWNEKGMKLFSRLHSHEAFREEASLIRQLQPYSVSVYPQLMRELEQEGLIEHLGLVNVLRMEDDCRTVYSEETGLLPPDEEVLNVMVL

SEQ ID NO: 13020 - protein, 534 aa, Exiguobacterium sp. S17
MQHAKQPSGIYTLSIPTGGGKTLASLRYALHHAVHYHKRRVIYVVPFTTIIEQNAQVARTVLKTEEIVEHHSNVVQLDDASEDEMNLQAKLNLAKDNWDAPIIFTTMVQYLNTFYAKGNRNTRRLHHLSEAIVIFDEVQKVPTKCVSLFNESLNFLKNGLSSSVILCTATQPALDFVKHRLTSDREMIHELPAVIEAFKRTEIEVVSDDLDTERLGSFVQDKSATNQSVLIILNTKTVVRKLYESLKQSFSEDEVYHLSTSMCAAHRKCILKEINGRLDQGKRVICISTQLIEAGVDVSFQCVIRSFAGLDSIAQAAGRCNRHGEVERQTVYLINHIEENVSKLTDIAKGQEIVKRLVVDLERDPNAYGGELLSPLAMKRYFQEFYQLREVDLDYPLKGSAETLAPMLFKGTANQHQVSDTPLLLVARHRTVADNFHVIEQLTDDVLVPYGDKGNELIALLNGDVNWDDARKWLKESQQYTISIYNHERQILERSGGLVSLLEGRLLVLQPSAYDEQYGLNLSQDSEMQDLLIG

SEQ ID NO: 13021 - protein, 475 aa, Exiguobacterium sp. S17
MRHLYEKTLKRVFGHETFRTGQRDVIEAVAEGQDVLAIMPTGAGKSLTFQLPSYLKNEGLTIIVSPLLSLIEDQMLHIRERGERGVARLTSMETLEEKQDILNHLKQYRFLYLSPEQLAVPHVTRALARTPIQMLVIDEAHCISQWGHEFRPEYARLGELRKQLGSPQCMAVTATAPENVKRDIIEKLALFSPSQFVHSANRPEIRLIVERLETERKMPRLIELVREVPTPAVIYTATRREAEALALQLDDALFYHGGMSTEDRRLVQSQFLRDEVAIMVCTSAFGMGVNKDNVRSVIHFQLPATLEAYMQEIGRAGRDGEPAFAVLLYADGDERIQQFLIDQQYPKDKDIRMAYLERDNGTSLSQLPRLLKMNEEDPRWGLLNQMLAERTLADAIDWVKERKRARYRQLGQMIDYALIKKCRRDYLLNYFSEQPVKQADCCDVCGKILFPPSVQVVSKNVTDWKHRLARIFSFD

SEQ ID NO: 13022 - protein, 922 aa, Leptospira noguchii str. 1993005606; identical to SEQ ID NO: 12866

SEQ ID NO: 13023 - protein, 745 aa, Leptospira noguchii str. 1993005606; identical to SEQ ID NO: 12865

SEQ ID NO: 13024 - protein, 765 aa, Leptospira kirschneri serovar Cynopteri str. 3522 CT; identical to SEQ ID NO: 12729

SEQ ID NO: 13025 - protein, 745 aa, Leptospira kirschneri serovar Cynopteri str. 3522 CT
MTKDKQSIFIAHVLRKDDGSFVEHLIDDHLYSVAEFAKKFCEKFGAETFGYLIGLWHDLGKFKLEFQERIRIRSGHIGEEAHLEGKTAKSVKHSVSGAIHCLNKFKQSDIIKKLICLPILCHHSGLKNFGIDVDIQLNDEKEISALSETITYIPQQILDGIELKQLGKSFKDHSLLIRMLFSTLIDADRLDTERFMDLVKFKERYSKTIILQDLNIKLDKHLNDIQKQADATKVNSIRKRILEEVQSKTNLKPGFYTLTVPTGGGKTLTSLSFALKHCIENKMDRVIYGVPYLSIIEQTADVFKKILGEDSVLEHHSGIDISKEKENSINRLLTENWDHPLIVTTNVQFFESLFSSKTTKVRKLHNIINSVIILDEAQMIPPQFLQPIVKTLKELVEYYNVTIILCTATQPTLSSIKSTDLNFDGIDTAIELAPEPEKLFQELKRVIIHKPEEKKLSFMEVATRILNYDQVLTIVNRKSDASGIFNQLTGNKYYLTTNLCAEHRRDILKKVKNHLNNGESVYLVSTQLIEAGVDIDFPIVFRAVAGLDSIAQAAGRCNREGKLLDENGQEKLGEVFLFKPEQNPPAGHLLQTEQASRDCIKNFEELIHPDTLKQYFNTLFWLKQDKGLDKEEIEKDKRSFQFETINKKFKLIDEDSRPVIVPYKEGKDLIVQLQNSVIQNNFLDYKLIRKSQRYTVNLKTNLYNKLLSEGIISEIEGIIGILTFGSYYHNDLGILESPNEQDLII

SEQ ID NO: 13026 - protein, 931 aa, Leptospira borgpetersenii serovar Javanica str. UI 09931; identical to SEQ ID NO: 12719

SEQ ID NO: 13027 - protein, 932 aa, Leptospira santarosai serovar Shermani str. 1342KT; identical to SEQ ID NO: 12749

SEQ ID NO: 13028 - protein, 948 aa, Gardnerella vaginalis JCP8070
MSCNHVVNPELWGKKREANGAMQWLPLAQHLEDTGNVIGQLCDHWLSDGQRKLIEASLSKHVDAKKLSQFLGCIHDIGKATPVFQFRKSYSNSEDLDIALKNKLTTVGFTNIDDFIDKPEGWSSSHHTITGQFILSNAGVPGGICAIVGAHHGKPLDNDYVCKSNKSEYPDNYYQSETESENSKLWQKLQNDILDWALERNDFSNVDDLPEISEPAQVLLCGLVIMADWIASNEHYFPLIPIEKDLIENQEERYKKGWEKWLQHGSKDVWESLNCYSDVSQIYKHRFGFLPNNIQSALHNVISHCEKPGIFILESAMGSGKTEASLIAAEQLANLTGRSGVFFGLPTQATSNGMFRRVENWLKSVNSDFQGEIGLRLVHGKAELNADYAHLPHGMQNMNDGCENASSNNEANNNGVILNDWFTGRKTAMLDDFVVGTVDQFLLASLKQKHLMLRHLGLSKKVVIIDEVHAYDAYMNKYLEESLIWMAAYGVPVVLLSATLPAKRRKELIKAYMCGLFGFNWRECDKSNVDFETNNYPLITYSDKNCVKQKFIENDVRDNKSISVRKITDDNLHESLVGELKSLLNNGGIAGIIVNTVKRAQEIYNACVDEFSDDEVIVIHSQFIATDRVRKEQQICNMIGKNAHRPARAIIIGTQVLEQSLDIDFDILFTDLAPIDLLLQRAGRLHRHTIERSETFAEPILYVLGTSDRYEFDKGSESIYSKYLLMRTQYYLPNVINMSQDISRLVQIVYGDNPLELQEDLKDVYAVAKREHDSVRNSNESAAKTYRIENPESEIGERSIVGLLTNSITNESDEFACAQVRNSGESIEVIAVKKVGSGYGTFHDCKDISQNIDIAEVAMKLAQETVGLPWMFTLNSDRVDETIAELERIRKQNQFKNWDNQPWLRGSLVLLFDENNICELSKYRVVYSEKSGIVCINSSEEDRKELRR

SEQ ID NO: 13029 - protein, 716 aa, Salmonella enterica subsp. enterica serovar Dublin str. DG22; identical to SEQ ID NO: 12934

SEQ ID NO: 13030 - protein, 760 aa, Pseudomonas stutzeri B1SMN1
MPAIKTPPCNKCEVDMDDHTRAFYAHSTPNPDKSDWQPLREHLEAVAEIAARNASAFSGDTLAHLAGLLHDLGKYTDEFQRRVTGDAIRVDHATRGAIIAVERYGTLGHLVAYAIAGHHAGLANGSEGIERTALKERLLGTGLPALLAQWQTEIQLPALNELKPPALIQREGRNFFQLAFLGRMIFSCLVDADYLDTEAFYDRTQGRSSLRDHAYPNLANLRQQLDKHLNGFEANTPVNQLRGEILAGVRSKAGLPPGLFSLTVPTGGGKTLASLAFALDHALAHGLRRVIYVIPFTSIVEQNAAVFRRALGELGEKAVVEHHSAFADDLGKSLEARKKLSLAMENWDAPIIVTTAVQFFESLFADRPARCRKLHNIARSVVILDEAQTLPLHLLRPTVAAIDELALNYNSSLVLCTATQPALTDGPRFPGGLPNVRELAPEPEHLFQQLQRVQIRSIGPISDEALSGQLREREQVLCIVNNRRHARALYEAIADCPGACHLTTLMYAKHRSQVLSEARQRLRDGLSCRLVSTSLIEAGVDVDFPTVLRAEAGLDSIAQAAGRCNREGRRALVDSQVLVFAPENEQWSPPHELKQFAQAAREVMRQHPDDCLSMAAIERYFHLLYWQKGSRALDERNLLGLIEKGRLDCLPFETLAREFRMIDSIQMPVIIARDDEAQAALDDLEFADGCAGIARRLQPYLVQVPRKAYDALLQVGAIQPAMAERYGEQFMVLVNPDLYHDQFGLRWDNPAFVSSERLLW

SEQ ID NO: 13031 - protein, 525 aa, Pseudomonas syringae pv. actinidiae ICMP 18886
DRLVCGDVGFGKTEVAMRAAFIAVHGGRQVAILVPTTLLAQQHYNSFRDRFADWPVTVEVMSRFKSAKEVSAAVANLAEGKIDIVIGTHKLLQDDVKIKNLGLVIIDEEHRFGVRQKEQLKALRSEVDILTLTATPIPRTLNMAVSGMRDLSIIATPPARRLSVRTFVMEQNKPTIKEALLRELLRGGQVYYLHNDVKTIEKCAADLAELVPEARIGIGHGQMRERDLEQVMSDFYHKRFNVLIASTIIETGIDVPSANTIIIERADKFGLAQLHQLRGRVGRSHHQAYAYLLTPPRKQITSDAEKRLEAIANTQDLGAGFVLATNDLEIRGAGELLGDGQSGQIQAVGFTLYMEMLERAVKSIRKGEQPNLDQPLGGGPEINLRVPALIPEAYLPDVHTRLILYKRIANAADEDALKDLQVEMIDRFGLLPEPTKNLVRITLLKLQAEQLGIKKVDGGPQGGRIEFATETPVDPLTLIKLIQSQPNRYKFEGATLFKFMVPMERPEERFNTIEALFERLTPKTA

SEQ ID NO: 13032 - protein, 701 aa, Megasphaera sp. BL7
MAERFASIFDAAEWGKMAGLYHDIGKYSAAFQQRILEEGPRVDHSTAGALLMKKIKNVPLAFCIASHHSGLLNTGTRLSKADDGTLKGRLKKELKGKLDYSAYRQELPEPLPIRKAPAFLYGKDRFYYSFFIRMLFSCLVDADFLDTEQFVNAGKVQRGGFATMQELHDLFFAYYATFGEPTTPINQKRQEIYQQCLDAAEKEPGMFSLTVPTGGGKTLSSLAFALKHAVKYKKQRIIYIIPYTSIIEQTADIFRNILGDGNVIEHHMNVDYDKDDNKEDNDKKEDDGLNRKKLATENWDAPVIVTTNVQFFESLFAAKTSRCRKVHNIANSVLIFDEAQMLPEPYLRPCIRSIGELVANYRCTAVLCTATQPSLETYFSQIGEGLKVREICPDTQGLYEFFRRVTYRFMDVDSLESLAAQLKEHEQVLCVTNSKKDARDLYQMMAGDGCYHLSTFMYPAHRRRVLAIIRQRLKDGLPCRVISTSLIQAGVDVDFPVVYREIAGLDSIIQTGGRCNREGKQRTEDSTVYIYDLHKPMNRIPAFVRRPIEITQMVAKHHADIASAESIKAYFDQLHYTIGEDQLDSKNILKRLEGNTPDFTEIAKDFKLIEEDSRPVFIPVDDDLDNQKILTQLIASVCNRSILRKANQYMVSVYENQFEKLWETNKLDALDLGLYVLKDPAAYDPDTGLVVNMEDGIGIFL

SEQ ID NO: 13033 - protein, 701 aa, Megasphaera sp. NM10; identical to SEQ ID NO: 13032

SEQ ID NO: 13034 - protein, 766 aa, Desulfovibrio alkalitolerans DSM 16529
MLTYYARFIGEGDQVRWQRLREHLLMVARLAAAFAREANPGDRGFVRAARRAGLLHDLGKYGDAFQQRLRDAEAGRPAAAAPHARFGAALLDRDGRWDQALAVLGHHAGLHAASDFTNKVRPEDGDTGDTLLRRALDDGLRLAGRDGPVTIREGTTDRLALELRERMLFSCLVDADRSDCVRFEVGMLPTGPALDAQKLLSKLLGFIAEKARECPPGVVKECRAAVLDACLDSASLPGRLLTLAVPTGGGKTLSGMAFALKRATLRPDAVRRVVVVVPYLSIIEQNAAEYRAALGDDAILEHHSGDFASLRTVRREHDERMFSENEGDEAYAVADEDEDAHLGGLRVPDLARENWDAPVIVTTSVRFFETIFSNRPSDLRRLHNIARSVVILDEVQTLPRHLLAPLLSVMQGLAHDWGVHFVFSTATQPAFERPETAPPEDIRWAPGSLTPIIPSELYARLVRDLQRVAEPVWASSGESWSVARQAEAVRNEPRALCILNTKRQVRDLFQCLRSEADGWLVHLSTRMCAAHRLAVIRRIQEHLRQTDEPCRVISSQLVEAGVDLSFPAVMRAMGPLDAIVQAAGRCDRDGRLTAALGAPAGRLTIFEPEDGASPYPGPTSITRSMLGHLGMSLHAPAVMRRYFNELYEGELDGPGIQGLRLKFDFPAVAEAFSLIDDRTRAVLVPYGKGTGIIACLERGESPSRDLLRLAGRYQVGLYPNEFHEAERLGAIYSLDSDGRLWACRKSCYDDELGLDLRPPAAGEHVV

SEQ ID NO: 13035 - protein, 768 aa, Desulfococcus multivorans DSM 2059
MEDKILAKSVRNPGKPEHAETLMGHTQMVVRSFQILFGPGTSTQFSKDWIRFFRLEKSALKAFYLHGLAACGLHDTGKANNGFQEMVSRKKGIQVIRHEHLSGLFLYLPAVGSWLKQFPGLDARILFAAVAGHHLRTSFENFAQPLDADLKIFRVYPNAIMEILNFTGKMIDPSVAEIELEIPDVWDFDGSMTFDPVRLRDDIKKKELMKFTRELKKNPSLNGMVMAVRAGLILADSAGSAVAREGKNLDSWLKDAFGAKLSCEDIQLKVIAPRIEQIRAKKGYFDWNGFQDAAENLPRRSLLLAPCGSGKTLAAWRWVKAQLNRKPAARVLFLYPTRATATEGFRDYVSWAPESDAALIHGTSDYELENMFSQPEDVRFGRDYTTEDRMFALGYWYRKIFSATVDQFLGFMQQSYRSICLLPLLSESVVVFDEVHSFDRSLFSALKRFLNNFDVPALCMTASLPPARRKDLLQDCGLTLFPSESGQFDDLEGLAGMPRYTLHRIEGQEEAESIAVSACGMGKRVLWVVNTVSRCQMLAKKLGAVCYHSRFKLEDRKQMHDTVIQAFQKERNPILAVTTQVCEMSLDLDADVLISEVAPITSMIQRMGRCNRHARLEEKRMGQVYVYTPEDEAPYTMGDLVGVRAFLQEIEGGVISQRKLEALLEKHGPSDVEVEKYSAFLESGTWAMSREYSLREESHFTVNAILDNDLSTYFDLRTHKKPIDRLLVPVPRRFAYNHPKLQRFPMLAPSTYYSPEFGFLEYPLEEIL

SEQ ID NO: 13036 - protein, 763 aa, Desulfovibrio sp. X2
MYHARFVGEGERIRRQRLREHLLMVARLAADFAREARPGDGEFIRAARRAGLAHDLGKYRDAFQQRLHDAEAGRPAAAAPHAVFGAGALGTAAWDQALAVLGHHAGLHAASDFMNKVRPEDVDMGRELLLRARADGLRLAGREVPASSPGATDRLALELRERMLFSCLVDADRSDCMRFETGALPTGPALAAQALLDSLLAHISQKAGECPPGTVKDCRAAVLDACLASASLPGRLLTLAVPTGGGKTLSGMAFALRRAALRAGEVRRVIVVVPYLSIIEQNAAEYRAALGADAVLEHHSGDFACLRTVRRAHDPHAFSENEGDEAYVIASEDEDAHLGNDDGARTLARENWDAPVIVTTSVRFFETIFSNRPSDLRRLHNIARSVVVLDEVQTLPRHLLTPLLSIMEGLARDWGVHFVFSTATQPAFERPASAPSEDGRWEPGSLVPIVPPDLHERLVRDLRRVAEPVWPQKGETWSVARQAEAVLAEPRALCILNTKRQVRELYEQLRERVDGWLVHLSTRMCAAHRLTVIRRIKEHLRTTDEPCRVVSSQLVEAGVDLSFPAVLRALGPLDAIVQAAGRCDRDGLLTAALGAPAGRLTVFEPEDGASPYPGPTSITRAMLGREGMSLHSSAVMRRYFNELYQGDLDGPGIQGLRLKLDFPAVSEAFALIDDRTRSVLVPHGEGADIIARLARGEPPTRELMRLAGRHQVGLYPHEFRTAEGLGTIYPLDDAGRLWACRVSCYDPELGLDLRPPDAEEHIF

SEQ ID NO: 13037 - protein, 86 aa, Penicillium oxalicum 114-2
MDAHLTVVLAHGGTGLRIMHGWSSIITWASDAVFMIPTRPCPLDTSTRYGKRSCRAHRNWREPDIYIRRVSLSDVRLPSRAEVAQS

SEQ ID NO: 13038 - protein, 827 aa, Bacteroidetes bacterium oral taxon 272 str. F0290
MVFDINEIRSHPNKKLLSHVEGVRKNVELLTHSKLADLVAIFHDLGKINPNFQAKLNPNTNMRNGYANHAYLSAYVFFCVFGDSLENQKKLKHFLKWDRELNKNDIVAIAVLIAKHHGNLPDFEPKDHSGTGAVILSKDENNELFSFLNTIELPVNEYVRAFMEVDDFAQFIKNPKVQEIYLKTNVFKEDENRFPLDFFLDFQFAFSAVIQADKADAANFDNFIERQQNELYSFCVHFKVQLENYLSRLKQDSELNKFRTRIREEAVSNLINQISVKRVFELTAATGSGKTLMLLSLASEIINRTGAKRIIYGLPFLSITEQVEAEVLKIFKGQENYIQRIDSKSENSRFESLQQKLDDNPEPEIIEELNLLEFQENTFGYPFVITTFVRFFETLLSNRNSELLKLPNFSNCIFLLDEIQSLPPRLYGFFVAYLTKFCEKFNSYAIISTATQPNFSLPDGNDDAKKFFSDYEKPIPLLPLSYFENELFNRYCIDIQKEEISLCGLKKKILSENSSALVILNTIDDTKELFKLLQNDLDSSELLLLNTHFTPQHRKLKIYLAKRRLREKKRIIVISTQLIEAGVDVDFPVLFRDFATVSSIVQSAGRCNRNGRLEAKGKVYLFTLRNRNRIRSKLIYHGFDKDLLRFTKESFERVPINNYQEKELLPIQQEFFNRIQSEWHFAKHWKKNNQDPRKPDFDFLKDIRQCMFEKIGKFQLIDKLNFGEEFQFYVPQRANDENFEILLNKQEELLGLYKAKSDFSIIKRKKKEIETHLKRMSNQIVQIRLKDSSQREYLRGSDDNYFSLYKINFNNYSFEKGVDLKENECLI

SEQ ID NO: 13039 - protein, 727 aa, Salipiger mucosus DSM 16094
MSSAFDKLARPVQKWIRLQGWRELRDIQARSIQTICETDADLIVAASTAGGKTEAAFLPLISQVFDEPFDGTGFDLLYIGPLKALITDQAMRLEGICQEAELPVVPWHGDVSQSIKTRALKSPKGILLITPESLEALFIRRGLEISRLFGATRAVVVDELHTVLDSERGVQLRSLLTRLELTIKRPIRRIGLSATLGDMDLAKAYLRPDAANAVQLIEADGGEAELRLQLRGYVSGDEDENSPSATHAIAAHLFKHLRGSDNLVFAGARQRVEIYADRLRELCEREHLPQEFYPHHASLSREHRDFVERRLKDAAKPTTAVCTSTLELGIDIGDVTCVAQIGAPFSVAALRQRLGRSGRREGQPAVLRQYAVETQLTPESSFVDRLRLGLIRSIAMIDLLLEGWCEPARPQALHLSTLVHQILSVIAQRGGASASVVYSILCREGPFRKVTTEVFADVLRSIGHTETGLIEQSGSGLLLLGPAGEKLVEHYSFYAVFKTPEEFRLVAEGRDLGTLPIDNVLAPGMLLIFSGRRWVVQEIHDREKVIMVKPAKAGVPPVFGGDPGDIHDKVIDRMFAVLEGGTQPAYMDAASLKMLAEARAHYDQLGFRATNIQALGERTSIIATRVGTVKTSTLALALRSEGFSVEQHDGFLLVEVGDETPDLRGLLADIRSGEPVDLFAGAGNLMSEKFHPYLSSALLVLDAASSKLSVQALPDVVAAIVRKGSFN

SEQ ID NO: 13040 - protein, 726 aa, Phaeospirillum fulvum MGU-K5
MIDHARGTTALAADFATPFKADRAAAIAGLLHDLGKYCPQFLARLNGADIRLDHAIAGAAEIRARGAAATSQWDRMMAELVSYAIAGHHAGLPDWQEFSERLTRARPALDPIWQDEISVDLTGLAPSLIPHPSKTRTAFQLGFLGRMLFSCLVDADFKDTEQFYAQAAGSEIDRDWPRLGDILGDLTARFDAHLATKAGDSPVNRLRREVLTHVREKAATPPGLFTLTVPTGGGKTLASLGFALDHARRHGLERIVYAIPFTSVIDQTAQVFRDVLGDDVVLEHHSAIEEEKPSHKEQRDKLRLAMEDWAAPVVLTTNVQLFESLFANRSSRCRKLHHLAKSVIVLDEAQTLPLPLLIPCIAAIDELTRNYGASVVLCTATQPALDLRHFRGGDGTGLALEGRELAPNPDSLAAQLVRVKIRHGGVMSDDDLVAELERHPQGLVIVNSRKHALALYRKAGEAGLSGLIHLTTRQYAADRRRILAEVRQRLKKGDPCRLIATSLVEAGVDLDFPRVWRAEAGLDQIAQAAGRCNREGLRPVEDSIVTVFNAPDNPPPREVAQLVKAYGRMAAKHDDPLVPAALRDYFGEVYWSKGTNLDQHKILGKFEVDRGGLAFAYKTVATDFQMIDSGMVPVIIALEEKAQQAVRQLGIDGISPGKVARALQSFVVQIPPLARARLLAEGHVRFEREKIFGDQFAVLQPGSLYRQETGLLWEDADYLELEQSIF

SEQ ID NO: 13041 - protein, 762 aa, Mannheimia haemolytica D35
MEEHTIQSFYAHSGKLSDHSDWQTLLSHANNVGLLAAEFAAPFASQEIARCTGLLHDLGKYSERYQKRLHGGERVNHSTAGAKIAVERWGPLGKMMAFCIAGHHAGLANGSGEGKNRSTLTQRLQEQFGYGHKDLPVLDAIWQQELNLPEKLPLPPLKPSKNEPFFSYAFFIRMLYSCLVDADFLDTEAFYANLEKRPLERGNYPNLTALHQQFNQFIAQFRERIATQTPNTQEAQRKAEVNRLRSEILDYAVSQTKQETGLFSLTVPTGGGKTFTSMAFALEHAKQYGLCRIIYVIPFTSIIEQNAAEFRKAFGELGTEAVLEHHSTFDHDSLPDKSSRDKLKLASENWDTPVVVTTAVQFFESLFADRSSRCRKLHNIAGSVIILDEAQMLPLNLLRPIMAAIDELARNYQCSVVLCTATQPAIHQANGFYKGFENVREIAPNPTALFEKLKRTTVKHIGIQTDVELQSKLADNPQMLIIVNNRRHARALYDSAKQLEGAYHLTTLMCAKHRSQTLTEIRLRLKQNLPCRVIATSLIEAGVDVDFPLVMRAEAGLDSVAQAAGRCNREGKRLSVESNVWVFQPEEQWKAPPELGLLSGCMRSTVQVHADDLLNPKAINHYFQAVYEAKGKELDKPNILKACHDAGQSLNFPFQKIAEDFRMITSHLIPVIIPFDQEAENLIDRLRYADQVGGILRKLQPYTVQVPEKALAELYNAGRVETINETNFGKQFYCLIGMDLYDEVAGLSWENVDFLESEKLVL

SEQ ID NO: 13042 - protein, 762 aa, Mannheimia haemolytica D38; identical to SEQ ID NO: 11977

SEQ ID NO: 13043 - protein, 762 aa, Mannheimia haemolytica MhBrain2012; identical to SEQ ID NO: 11977

SEQ ID NO: 13044 - protein, 762 aa, Mannheimia haemolytica MhSwine2000; identical to SEQ ID NO: 11977

SEQ ID NO: 13045 - protein, 762 aa, Mannheimia haemolytica D193; identical to SEQ ID NO: 11977

SEQ ID NO: 13046 - protein, 725 aa, Anoxybacillus ayderensis
MVFYAKSEGKETIREHTDRLLYNLHLLKDAYGHKFMLMDEQMWKLLEIAVQYHDVGKANTVFQNKIRQIIHESILEKDAETNVPHNYLSVGCIPLKQLDLTKEEERLLIHAVGYHHERDQHPDKEMIRHVLENDIKQQLSELIEHMRLPMTEKFSYRFVDRLLKRYTYHDGEEFWKYVMIKGLLHRLDHAASAHIDVESDVEKSIYTNVNEYMQKQGFHKNDLQQFAEQHSDKHVIAIAQTGMGKTEAALLWIREDKAFFTLPLRVSINAIYDRIKEKMSYDAVGLLHSTSVNYLVDKEENWEELKQQSEHYAKKLLLTTIDQILKFPFYYRGFEKELSAMANAKVVIDEIQAYEPRIAAMLIKSLEMIHRVGGKFMIMTATLPTLYLEELKQRNVINDDQIAIEEFIDTSVNRHRICLRSEGIEEAIGEMLDLGETSQVLVIVNTVRQAMSLYDKFLDCDTQVPIYLLHSQFTQEDRQLLEKHIKQFNEKNERGIWITTQLVEASIDIDFDYLFTEMSTLDSLFQRFGRCHRKRALDHDNCNIHIFTENISGIPRVYNEHLVNESIRLLKPYDHQIVDERAKVEMVKQLYDRERLKGTSFLKEFEDALYMFDNLDPYGMDKREAQQKLRDIQNIQIITRQMYDQIEHLFEGYKKEKEWKKRLELRMEIEKKTISVQRYVAEKYVSERLPKPFDHIYIAEVEYDFNRERLKGKGILLDKPSSNQH

SEQ ID NO: 13047 - protein, 776 aa, Leptospira inadai serovar Lyme str. 10
MEKIYAKSPVPGGEGLLKHSYRVADRIIQLKSRIPALAVDLKIPNFWQILFWAGFFHDFGKIAVGFQKMLRTLNRPETQPVRHEIFSLAFVHWVFDSDTPEFERVTSAIASHHRDFKQTSDRYITDHSEDSGIQEYWQREILRENISLLAEWTLKFPEKIADKCGLDLGPVRPKKIDIERTYSNGPKKIREALSSYKSYYEKQNPSRIVKKDPAIKIELQNFRKEAICVRGILLQADRLASSNAPRLTSPDFENVKIGTKQRLYEHQKKSGEISGSAILSAPTGSGKTEAGLFWAHRQQREGRPGGLYYILPYQASLNAMYFRMRERYKISDQDISLLHSRTIPAIYRELVQETGPEEATRQAKRKKSLGKLHQQPFCIGTPYQLLRAAFRLPGYEGQWAMMQGAQMVVDEIHGYEPKRLGLLLGFFSDLRDRWDVRFFFMSATFPTWLAKEVEKTIGDSHRIQADSALFQEFRRHRLCVKDGTLKNEDLIEEIINRMNAGERILVVANLVSTAKELALRLKQAIPPRAGPSEQEKVLLLHGRFHSKDRLELESKLMKRMEDENTQEGFVVVATQVVEVSLDLDFDCLYTEPAPLEALLQRFGRVNRWLRFPEKPVYVMKEAVDWKKPYDKESLLRNTVELLCKLNDTLIDESAAGEYLDRLYSSEVDTILEEVEEGRELYRKIAGPETLKAFDSDPMAIQEFEQLFDGTEVLPESCLEEFERLLDEEKIVEAYSMLVPISKKRYYFLCQTGKIRERKGPDISIACCEYDSFSGLQ

SEQ ID NO: 13048 - protein, 761 aa, Leptospira broomii serovar Hurstbridge str. 5399
MNPERLLAKRLSNDPRDNSAEMYLVPHLRAAERVGLIIYESIGEKILKSFGLSSEIWSKRLQKILPLSCLLHDLGKANNWFQELVKGNSVKRQPIRHEFLSVLMILRSKNKLQAYLKTEISSIENEEFYTPLINSIYSGILAHHLKMDIDLKRACPGLYSNGGIPTELISYANAPDFDILFGKDKPTNAFYFSFLSSHTEQRFKSIQTWIDEFQKISSEWEAFLKENEDWYIFSMILKPLVISADVIASALVPKGIEYKNWIIESLQNYIEQNDINRIVLERLNGKSPREFQSQIANSRGRITLVEAGCGSGKTVGAYLWAANNALDSKLFFCYPTTGTATEGYLDYVGDSVYEAKLIHSRSQVDLEGIQKTGEEEENEIADRINALHSYHPKIIICTADTVLSLMKNSRKAILSFASIATGTFVFDEIHSYNDEMFLVLIRFMQLFKNTKFLLMSASLQPDRKELLKRELLNVQEVESPADLMNLPRYKFNEVQESEFLLDGIKKHAGSGKILVVVNTVKRAQTIYRNLITSVLNVKLYHSRYKYMDRVIRHREFISAFKEDSPPVVGVTTQVSEMSLDIDSDILFSELAPIPAIIQRLGRLNRRTTPDNQLPSRGVYFFKPEKPFPYDKADLQLTEKWIENLRMANVEISQNQLQNYFLKLTPESENLYPPIYYDFNKPTFYFMPAIEGLRGPSNTILCILESDFASIKESPKEITNFTIPMTINSAFNFKTANFYKHVVILPDSIIRYDKMEGAKWQN

SEQ ID NO: 13049 - protein, 949 aa, Leptospira alexanderi serovar Manhao 3 str. L 60
MAQTQKEKSICHLKHRESMKAEEKSYYKYWGKANKEGNYHLLVYHCFDVAAVGEVYLSQNETLCVHFSQKLGIDPLTFKNLFVFFLILHDLGKFSDCFQSLIPDIKNTLGNSNSPIGPYSIRHDNLGYIFWGKWILKDERFGNYSGFLTEQNWLGWNGLQSSKDKSYFTEFTDVLIRCVTGHHGRPPSKNGYSGQTAVSLDSHFTEADRLAALDFSKEINRILSPNLNFKGNLKTLYDSMLQISFWLAGLSVLCDWIGSNAEIFKYHTTPIDLEEYYTKISLNNALKAVKKSGILPSKIAFNGNHFGIFEYLQEPTPLQKFCSEVVIPDSPSLFILEDVTGSGKTEAALILTHRLMQKNSYSGFYVGLPTMATANGMYRRMSNVYRNLYTKESLPSLILAHGARNLSDSFQSSVISDNAILADRNYSFQSEKDPEESASAICNIWLSDNQKKSLLADAGVGTIDQALLSVLSAKFQSLRMFGLSRKVLILDEVHSYDPYMVELICCLLKAQAKIGASVILLSATLPKILRKTFSESFALGLDTELQDIKSGEYPLVSLISNRSVVEETPIPTRKEVSRKLNVKFFFNQEQVLQKILEMSNQGRCVCWIRNTVSDASRAFSFLHSKLGDQVILFHSRFAMGDRLNIESQILENFGIQSDQISRKGKVVVATQVVEQSLDLDFDCIITDLAPIDLILQRAGRLYRHSRDISGNIKRGLDERGVPILWIFSPEAIDDPESDWFSRFSRGGSMVYSDHGKLWLTARLLQERKGWRMPENARNLIESVYGINVVVPQSFQENQSKVENDKKKRESAAVLSTIRLELGYDSTLNETSWDDSKFSTRYGIDNSTKVVLAKFVSDRLVPWISDTNRDWQNSELPVPNYLVEKEFIFENLNISEVVSNCKKNLPDKGKHCVLLPLFYANNSWRGKALNKKNEVVSFTYDERFGFRKEK

SEQ ID NO: 13050 - protein, 745 aa, Leptospira noguchii serovar Panama str. CZ214
MIKEKQSIFLAHVLRKDDGSFVEHLIDDHLYSVAEFTKKFCEKFETGTVGYQNGLWHDLGKFKLEFQERIRIRSGHIGEEAHLEGKTAKSVKHSVSGAIHCFNKFKKSDIIKKLICLPILCHHSGLKNFGIDVDIQLNDEREILALSETISHIPQQILDGIELKQLGRSFKDTSLLIRMLFSALIDADRLDTERFMDLSKFKERYSKTINLQDLNIKLDKHLNEIQKQANATKVNSTRKRILEEVQSKTSIKPGFYTLTVPTGGGKTLTSLSFALKHCIANKMDRVIYGVPYLSIIEQTADIFKKILGEDSVLEHHSGIDISKEKENSINRLLTENWDHPLIVTTNVQLFESLFSSKTTKVRKLHNIINSVIILDEAQMIPPQFLQPIVKTLKELVEYYNVTIILCTATQPTLSSIKSTDLNFDGIDTTIELAPEPEKLFQKLKRVIIHKPEEKKLSFIEVATRILNYDQVLTIVNRKSDASGIFNQLTGNKYYLTTNLCAEHRRDILKKVKSHLYNGESVYLISTQLIEAGVDIDFPIVFRAVAGLDSIAQAAGRCNREGKLLDKNGQEKLGEVFLFYPEQDPPSGHLLQTKQASEDCIKNFEELIHPDALKQYFNTLFWLKQNKGLDKEKIEELKINLQFETINEKFKLVDEDSRAVIVPYKEGKDIIIQLQNSAIKNKFLDYKLIRKSQRYTVNLKTNLYNKLLSEGIISEIEGIIGILNFDSYYYNDLGILESPNEQDLII

SEQ ID NO: 13051 - protein, 773 aa, Leptospira alstonii serovar Pingchang str. 80-412; identical to SEQ ID NO: 12845

SEQ ID NO: 13052 - protein, 773 aa, Clostridioides difficile CD13; identical to SEQ ID NO: 12088

SEQ ID NO: 13053 - protein, 802 aa, Clostridioides difficile CD13; identical to SEQ ID NO: 12087

SEQ ID NO: 13054 - protein, 784 aa, Clostridioides difficile CD17; identical to SEQ ID NO: 12177

SEQ ID NO: 13055 - protein, 802 aa, Clostridioides difficile CD21; identical to SEQ ID NO: 12087

SEQ ID NO: 13056 - protein, 773 aa, Clostridioides difficile CD40; identical to SEQ ID NO: 12208

SEQ ID NO: 13057 - protein, 802 aa, Clostridioides difficile CD40; identical to SEQ ID NO: 12207

SEQ ID NO: 13058 - protein, 773 aa, Clostridioides difficile CD41; identical to SEQ ID NO: 12210

SEQ ID NO: 13059 - protein, 802 aa, Clostridioides difficile CD41; identical to SEQ ID NO: 12200

SEQ ID NO: 13060 - protein, 802 aa, Clostridioides difficile CD39; identical to SEQ ID NO: 12087

SEQ ID NO: 13061 - protein, 802 aa, Clostridioides difficile CD43
MKNIMQKEILAKSYNLRTNQQEQTLVEHIKDLFEVLESILELNLYSDKDVEILKICCALHDLGKINSIMQQKMEINNKISYSCSEEERKKLESDKKSLKKIARHNIFSGAFLKDILEKMNLSEEDKLYIYKSIMLHHGNYEDYMRLSISKVQEEIYEYIEKGILEKEEFNLKDIESYINNILNVDFKFGEDVLDYDYIDKLSESMFIDSDYNNGQIDDSVLNYRKFKYILYKGMLNLIDHSASSRQKGIKFYNDFTDEEIDNMILNEIYKSQGNLEKNNIEFNTIQKRLRELSGRNVLTVAFTGSGKTAADYRKTFKRKFFLVPNKISAESFYRKNIFQNKNDLDTRSSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDVDFHLMTATLPKSYKEQMINKGIIFQEESNENVTDKGEIVFIESNKEEEICEGKDVKVSFIKEKEIKSIVEDALENKQKILIIKNTIDSVNRTYEFLKENLSDKYGGVDIDVLHSRFKFKDKKEKYSKILNGEGDIWISTQSVEISLDLDFNIIISDLATMDSLIQRMGRCNRNNKYEYGNFYILPSEDKIYDNKLKSTTKNILKDILKTNSIFTMGIRKTILDDYYDNSVVKKYFEENFISCDKEIKNIYGVNKEIFDGLDLIFNFEPYKNIVDSKKEAAKIFRDVDVSYKIILEEDFYKEDRELQQDSIQVSGFIFNRLYYYGLISKVEGYMVLKSSSKFEYNSTVGLILK

SEQ ID NO: 13062 - protein, 773 aa, Clostridioides difficile CD47; identical to SEQ ID NO: 12208

SEQ ID NO: 13063 - protein, 802 aa, Clostridioides difficile CD47; identical to SEQ ID NO: 12207

SEQ ID NO: 13064 - protein, 802 aa, Clostridioides difficile CD49; identical to SEQ ID NO: 12087

SEQ ID NO: 13065 - protein, 773 aa, Clostridioides difficile CD104; identical to SEQ ID NO: 12210

SEQ ID NO: 13066 - protein, 802 aa, Clostridioides difficile CD70; identical to SEQ ID NO: 12087

SEQ ID NO: 13067 - protein, 802 aa, Clostridioides difficile CD131; identical to SEQ ID NO: 13061

SEQ ID NO: 13068 - protein, 802 aa, Clostridioides difficile CD132; identical to SEQ ID NO: 12087

SEQ ID NO: 13069 - protein, 802 aa, Clostridioides difficile CD129; identical to SEQ ID NO: 12207

SEQ ID NO: 13070 - protein, 802 aa, Clostridioides difficile CD144; identical to SEQ ID NO: 12087

SEQ ID NO: 13071 - protein, 802 aa, Clostridioides difficile CD149; identical to SEQ ID NO: 13061

SEQ ID NO: 13072 - protein, 802 aa, Clostridioides difficile CD159; identical to SEQ ID NO: 12087

SEQ ID NO: 13073 - protein, 802 aa, Clostridioides difficile CD165; identical to SEQ ID NO: 12087

SEQ ID NO: 13074 - protein, 802 aa, Clostridioides difficile CD166; identical to SEQ ID NO: 13061

SEQ ID NO: 13075 - protein, 802 aa, Clostridioides difficile CD169; identical to SEQ ID NO: 12200

SEQ ID NO: 13076 - protein, 802 aa, Clostridioides difficile CD178; identical to SEQ ID NO: 12200

SEQ ID NO: 13077 - protein, 773 aa, Clostridioides difficile CD181; identical to SEQ ID NO: 12208

SEQ ID NO: 13078 - protein, 802 aa, Clostridioides difficile CD181; identical to SEQ ID NO: 12207

SEQ ID NO: 13079 - protein, 802 aa, Clostridioides difficile CD200; identical to SEQ ID NO: 13061

SEQ ID NO: 13080 - protein, 773 aa, Clostridioides difficile CD196; identical to SEQ ID NO: 12088

SEQ ID NO: 13081 - protein, 773 aa, Clostridioides difficile CD206; identical to SEQ ID NO: 12210

SEQ ID NO: 13082 - protein, 773 aa, Clostridioides difficile CD201; identical to SEQ ID NO: 12210

SEQ ID NO: 13083 - protein, 773 aa, Clostridioides difficile CD212; identical to SEQ ID NO: 12210

SEQ ID NO: 13084 - protein, 802 aa, Clostridioides difficile CD212; identical to SEQ ID NO: 12200

SEQ ID NO: 13085 - protein, 773 aa, Clostridioides difficile 342; identical to SEQ ID NO: 12208

SEQ ID NO: 13086 - protein, 802 aa, Clostridioides difficile 342; identical to SEQ ID NO: 12207

SEQ ID NO: 13087 - protein, 802 aa, Clostridioides difficile 842; identical to SEQ ID NO: 12087

SEQ ID NO: 13088 - protein, 802 aa, Clostridioides difficile 840; identical to SEQ ID NO: 12087

SEQ ID NO: 13089 - protein, 773 aa, Clostridioides difficile 6041; identical to SEQ ID NO: 12208

SEQ ID NO: 13090 - protein, 802 aa, Clostridioides difficile 6041; identical to SEQ ID NO: 12207

SEQ ID NO: 13091 - protein, 802 aa, Clostridioides difficile DA00044; identical to SEQ ID NO: 12087

SEQ ID NO: 13092 - protein, 802 aa, Clostridioides difficile DA00062; identical to SEQ ID NO: 12087

SEQ ID NO: 13093 - protein, 802 aa, Clostridioides difficile DA00114; identical to SEQ ID NO: 12087

SEQ ID NO: 13094 - protein, 802 aa, Clostridioides difficile DA00129; identical to SEQ ID NO: 13061

SEQ ID NO: 13095 - protein, 784 aa, Clostridioides difficile DA00128; identical to SEQ ID NO: 12177

SEQ ID NO: 13096 - protein, 802 aa, Clostridioides difficile DA00128; identical to SEQ ID NO: 12207

SEQ ID NO: 13097 - protein, 802 aa, Clostridioides difficile DA00131; identical to SEQ ID NO: 12087

SEQ ID NO: 13098 - protein, 802 aa, Clostridioides difficile DA00134; identical to SEQ ID NO: 12200

SEQ ID NO: 13099 - protein, 802 aa, Clostridioides difficile DA00141; identical to SEQ ID NO: 12200

SEQ ID NO: 13100 - protein, 802 aa, Clostridioides difficile DA00149; identical to SEQ ID NO: 12087

SEQ ID NO: 13101 - protein, 802 aa, Clostridioides difficile DA00154; identical to SEQ ID NO: 12087

SEQ ID NO: 13102 - protein, 802 aa, Clostridioides difficile DA00160; identical to SEQ ID NO: 12087

SEQ ID NO: 13103 - protein, 773 aa, Clostridioides difficile DA00167; identical to SEQ ID NO: 12208

SEQ ID NO: 13104 - protein, 802 aa, Clostridioides difficile DA00167; identical to SEQ ID NO: 12207

SEQ ID NO: 13105 - protein, 802 aa, Clostridioides difficile DA00183; identical to SEQ ID NO: 12087

SEQ ID NO: 13106 - protein, 802 aa, Clostridioides difficile DA00174; identical to SEQ ID NO: 12087

SEQ ID NO: 13107 - protein, 802 aa, Clostridioides difficile DA00189; identical to SEQ ID NO: 12087

SEQ ID NO: 13108 - protein, 802 aa, Clostridioides difficile DA00193; identical to SEQ ID NO: 12087

SEQ ID NO: 13109 - protein, 802 aa, Clostridioides difficile DA00203; identical to SEQ ID NO: 12087

SEQ ID NO: 13110 - protein, 802 aa, Clostridioides difficile DA00210; identical to SEQ ID NO: 12087

SEQ ID NO: 13111 - protein, 773 aa, Clostridioides difficile DA00238; identical to SEQ ID NO: 12208

SEQ ID NO: 13112 - protein, 802 aa, Clostridioides difficile DA00238; identical to SEQ ID NO: 12207

SEQ ID NO: 13113 - protein, 802 aa, Clostridioides difficile DA00232; identical to SEQ ID NO: 12087

SEQ ID NO: 13114 - protein, 802 aa, Clostridioides difficile DA00216; identical to SEQ ID NO: 12087

SEQ ID NO: 13115 - protein, 802 aa, Clostridioides difficile DA00245; identical to SEQ ID NO: 12087

SEQ ID NO: 13116 - protein, 773 aa, Clostridioides difficile DA00273; identical to SEQ ID NO: 12208

SEQ ID NO: 13117 - protein, 802 aa, Clostridioides difficile DA00273; identical to SEQ ID NO: 12207

SEQ ID NO: 13118 - protein, 802 aa, Clostridioides difficile DA00256; identical to SEQ ID NO: 12087

SEQ ID NO: 13119 - protein, 773 aa, Clostridioides difficile DA00305; identical to SEQ ID NO: 12208

SEQ ID NO: 13120 - protein, 802 aa, Clostridioides difficile DA00305; identical to SEQ ID NO: 12207

SEQ ID NO: 13121 - protein, 802 aa, Clostridioides difficile DA00306; identical to SEQ ID NO: 12087

SEQ ID NO: 13122 - protein, 773 aa, Clostridioides difficile DA00307; identical to SEQ ID NO: 12208

SEQ ID NO: 13123 - protein, 802 aa, Clostridioides difficile DA00307; identical to SEQ ID NO: 12207

SEQ ID NO: 13124 - protein, 802 aa, Clostridioides difficile DA00310; identical to SEQ ID NO: 12087

SEQ ID NO: 13125 - protein, 802 aa, Clostridioides difficile DA00313; identical to SEQ ID NO: 12087

SEQ ID NO: 13126 - protein, 802 aa, Clostridioides difficile F152; identical to SEQ ID NO: 13061

SEQ ID NO: 13127 - protein, 802 aa, Clostridioides difficile F249; identical to SEQ ID NO: 12087

SEQ ID NO: 13128 - protein, 661 aa, Clostridioides difficile F253; identical to SEQ ID NO: 12099

SEQ ID NO: 13129 - protein, 773 aa, Clostridioides difficile F253; identical to SEQ ID NO: 12098

SEQ ID NO: 13130 - protein, 802 aa, Clostridioides difficile F253; identical to SEQ ID NO: 12097

SEQ ID NO: 13131 - protein, 802 aa, Clostridioides difficile Y21; identical to SEQ ID NO: 12087

SEQ ID NO: 13132 - protein, 802 aa, Clostridioides difficile Y165; identical to SEQ ID NO: 12087

SEQ ID NO: 13133 - protein, 802 aa, Clostridioides difficile Y184; identical to SEQ ID NO: 12087

SEQ ID NO: 13134 - protein, 802 aa, Clostridioides difficile Y202; identical to SEQ ID NO: 12087

SEQ ID NO: 13135 - protein, 802 aa, Clostridioides difficile Y247; identical to SEQ ID NO: 12087

SEQ ID NO: 13136 - protein, 773 aa, Clostridioides difficile Y266; identical to SEQ ID NO: 12088

SEQ ID NO: 13137 - protein, 802 aa, Clostridioides difficile Y266; identical to SEQ ID NO: 12087

SEQ ID NO: 13138 - protein, 802 aa, Clostridioides difficile Y381; identical to SEQ ID NO: 12200

SEQ ID NO: 13139 - protein, 773 aa, Clostridioides difficile P1; identical to SEQ ID NO: 12208

SEQ ID NO: 13140 - protein, 802 aa, Clostridioides difficile P1; identical to SEQ ID NO: 12207

SEQ ID NO: 13141 - protein, 802 aa, Clostridioides difficile P2; identical to SEQ ID NO: 12087

SEQ ID NO: 13142 - protein, 802 aa, Clostridioides difficile P3; identical to SEQ ID NO: 12087

SEQ ID NO: 13143 - protein, 773 aa, Clostridioides difficile P6; identical to SEQ ID NO: 12208

SEQ ID NO: 13144 - protein, 784 aa, Clostridioides difficile P8; identical to SEQ ID NO: 12177

SEQ ID NO: 13145 - protein, 802 aa, Clostridioides difficile P8; identical to SEQ ID NO: 13061

SEQ ID NO: 13146 - protein, 802 aa, Clostridioides difficile P19; identical to SEQ ID NO: 12087

SEQ ID NO: 13147 - protein, 802 aa, Clostridioides difficile P21; identical to SEQ ID NO: 12087

SEQ ID NO: 13148 - protein, 661 aa, Clostridioides difficile P23; identical to SEQ ID NO: 12099

SEQ ID NO: 13149 - protein, 773 aa, Clostridioides difficile P23; identical to SEQ ID NO: 12098

SEQ ID NO: 13150 - protein, 784 aa, Clostridioides difficile P25; identical to SEQ ID NO: 12177

SEQ ID NO: 13151 - protein, 784 aa, Clostridioides difficile P24; identical to SEQ ID NO: 12177

SEQ ID NO: 13152 - protein, 773 aa, Clostridioides difficile P29; identical to SEQ ID NO: 12208

SEQ ID NO: 13153 - protein, 802 aa, Clostridioides difficile P38; identical to SEQ ID NO: 12087

SEQ ID NO: 13154 - protein, 661 aa, Clostridioides difficile P45; identical to SEQ ID NO: 12099

SEQ ID NO: 13155 - protein, 773 aa, Clostridioides difficile P45; identical to SEQ ID NO: 12098

SEQ ID NO: 13156 - protein, 802 aa, Clostridioides difficile P45; identical to SEQ ID NO: 12097

SEQ ID NO: 13157 - protein, 773 aa, Clostridioides difficile P51; identical to SEQ ID NO: 12208

SEQ ID NO: 13158 - protein, 802 aa, Clostridioides difficile P61; identical to SEQ ID NO: 12200

SEQ ID NO: 13159 - protein, 773 aa, Clostridioides difficile P59; identical to SEQ ID NO: 12098

SEQ ID NO: 13160 - protein, 802 aa, Clostridioides difficile P78; identical to SEQ ID NO: 12087

SEQ ID NO: 13161 - protein, 802 aa, Clostridioides difficile P69; identical to SEQ ID NO: 13061

SEQ ID NO: 13162 - protein, 802 aa, Clostridioides difficile P72; identical to SEQ ID NO: 12087

SEQ ID NO: 13163 - protein, 802 aa, Clostridioides difficile P71; identical to SEQ ID NO: 12171

SEQ ID NO: 13164 - protein, 802 aa, Clostridioides difficile P74; identical to SEQ ID NO: 12171

SEQ ID NO: 13165 - protein, 802 aa, Clostridioides difficile P77; identical to SEQ ID NO: 12087

SEQ ID NO: 13166 - protein, 802 aa, Clostridioides difficile CD90; identical to SEQ ID NO: 12087

SEQ ID NO: 13167 - protein, 773 aa, Clostridioides difficile CD92; identical to SEQ ID NO: 12208

SEQ ID NO: 13168 - protein, 773 aa, Clostridioides difficile CD113; identical to SEQ ID NO: 12208

SEQ ID NO: 13169 - protein, 802 aa, Clostridioides difficile CD113; identical to SEQ ID NO: 13061

SEQ ID NO: 13170 - protein, 802 aa, Clostridioides difficile CD92; identical to SEQ ID NO: 12207

SEQ ID NO: 13171 - protein, 802 aa, Clostridioides difficile CD111; identical to SEQ ID NO: 12087

SEQ ID NO: 13172 - protein, 661 aa, Clostridioides difficile P31; identical to SEQ ID NO: 12099

SEQ ID NO: 13173 - protein, 773 aa, Clostridioides difficile P31; identical to SEQ ID NO: 12098

SEQ ID NO: 13174 - protein, 802 aa, Clostridioides difficile P31; identical to SEQ ID NO: 12097

SEQ ID NO: 13175 - protein, 802 aa, Clostridioides difficile CD88; identical to SEQ ID NO: 12087

SEQ ID NO: 13176 - protein, 802 aa, Clostridioides difficile CD86; identical to SEQ ID NO: 13061

SEQ ID NO: 13177 - protein, 910 aa, Pseudomonas stutzeri MF28
MTAPSFFAYWGKASALSEEGERFHLLPFHSLDVAACGHALIELPHFSLQALARELDWPLRQVESLFVLFLALHDLGKFARSFQGLVTDLSPDLVPADCDKPYTKRHDTLGWMLWCEDFATDSEASFLPDATNEFWGIWLRAVVGHHGKPPLERESGGLVAFDASEHFLRSDRRAARAFVDEVAGWLCPVEIPTPGRSQLVALKRHAWRLAGLAVLADWLGSNQAHFPYCSRPMVLSDYWPHAQQQARKSVACAGLEWHAIRHWPHPQQLFDYLADPTPLQQYAATVELEGGPQLLLLEDVTGAGKTEAALILSQRLMQQGQAHGLYFALPSMATANQMYQRVGRVYRRLYDPGARPSLVLSHGARELVEGYRQRVLHASDQPDDRRYQPDEGSASAQCNAWLADNRKKALLADVGVGTLDQALLAVLPARHQSLRLLGLAGKVLLVDEVHAYDPYMLSLLKNLLVAHARQGGSVILLSATLPLDVRDQLLHAYRSGLGCGDGEALDDSRYPLAVQAGQQLRSHACATRPQVRRVVQIHALHEEEAVLTLIAEQARAGRCIAWIRNTVSDARRAHALLAERMQASDVTLFHSRYAMGDRLEIENDVLARFGKHSSAAQRKGRVLVGTQVLEQSLDFDVDLMVSDLAPIDLLIQRAGRLQRHARQANGDPAGDGIEQRAAPKLYLLTPEPVDEPKADWYAAMFAKGCFVYPDAGKLWLGARALLAAGHLVTPGEAGQPGAVRELVEAVYGVDEQSVPEALQKSSRDQIGEGMAMQSQAHFNALKLDMGYCIDSSARWYEDHQVPTRLGDETQTLYLALWRDGELQPLCGGGLHCWERSAVSVRSEQARALAPEWQQRFGDAVERLRKGYRLLEEPSFVVPLAMEGGDLMAKVQDARGRLVELRYDRESGLSW

SEQ ID NO: 13178 - protein, 713 aa, Escherichia coli HVH 91 (4-4638751)
MPASLASYAAQDKQAREEWISVLEALFLTPAGLSINDIPPDCSSLLAGFCSLADWLGSWTTTNTFLFNEDAPSDINALRTYFQDRQQDASRVLELSGLVSNKRCYEGVHALLDNGYQPRQLQVLVDALPVAPGLTVIEAPTGSGKTETALAYAWKLIDQQIADSVIFALPTQATANAMLTRMEASASHLFSSPNLILAHGNSRFNHLFQSIKSRAITEQGQEEAWVQCCQWLSQSNKKVFLGQIGVCTIDQVLISVLPVKHRFIRGLGIGRSVLIVDEVHAYDTYMNGLLEAVLKAQADVGGSVILLSATLPMKQKQKLLDTYGLHTDPVENNSAYPLINWRGVNGAQRFDLLAHPEQLPPRFSIQPEPIYLADMLPDLTMLERMIAAANAGAQVCLICNLVDVAQVCYQRLKELNNTQVDIDLFHARFTLNDRREKENRVISDFGKNGERNVGRILVATQVVEQSLDVDFDWLITQHCPADLLFQRLGRLHRHHRKYRPAGFEIPVATILLPDGEGYGRHEHIYSNVRVMWRTQQHIEELNGASLFFPDAYRQWLDSIYDDAEMDEPEWVIKGMDKFESAECEKRFKARKVLQWAEEYSLQDNDETILAVTRDGEMSLPLLPYVQTSSGKQLLDGQVYEDLSYEQQYEALALNRVNVPFTWKRSFSEVVDEDGLLWLEGKQNQDGWFWQGNSIVITYTRDEGMTRVIPANPK

SEQ ID NO: 13179 - protein, 656 aa, Treponema socranskii subsp. socranskii VPI DR56BR1116 = ATCC 35536
MMQMTDIIMIPELKDIRNVPLPASIPFGFNKLTSNRFEHYHLWVRMLYSCLVDADFLDTERFMNPEQFELRGNYASLAELKNRFDAYISEKTAYAKPSKINEVRAAILKSCREKAHLKSGFFSLNVPTGGGKTLSAMAFALEHALAHTKKRIITAIPYTSIIEQAAKVYKYGTDVDALIEEYKKQDKYLFGEENVLEHHSNFDFDKDEEKNNTNSPLRRQKLAAENWDAPIVVTTDVQLFESLFNAHSAPCRKLHNIVNSIIILDEVQMLPPEYLKSILSVLRGLTACFGVTVVLCTATQPALEGRIGLDTAAFEGIPCDAITPIIDNPEELAKELKRVKINTDYVREKIPDWQGVADKLCSFERVLCIVSTRKDCRALYTLMPEGTIHLSALMCAEERSEIISDIKNKLRNGGTVRVVSTQLVECGVDMDFPVVFKALSGMDSIAQAAGRCNREGSIKDLGVVYVFSPPSRIPPGLLRKGTDATKSLFEKYDYDIEFSPEIFREYFTKYFSLIEDFDKPCFETMMEIKSNEEAGKEQVDGIFQFRTLSDNYHLIDNSYQLSVIIRYKSPKTGKDNSVLINKLIAAGPDRKLLRALGRYSVNLPLKEISELVKKGRLIRPFDDADIYIQAPNDECLYQPGLGLVADSLESFGTYIF

SEQ ID NO: 13180 - protein, 715 aa, Endocarpon pusillum Z07020
MEAFKLLSRSTNLKPAQTLRRERRIVHVPSEGQTHASVDEENEVASAASVAGRKRKRDIFPAAHDPDEAFPSNGVDSHKSSSNGAGKANETSGHGILSQGRPTAGDPTAPQLPSSDECRSIFISHKIKMAALTGALNIDDSRRPSSRRSPSVKTLGQKRKKKASSLYTHPLTSFALLPTLYKVSRTLLNNLREQGYTTPTEVQLATIPVLLDPVAAGLCLPPDCPHIDLLTVAPTGSGKTLAFLIPLINHLIHDHHRNTEHESSRHVRALIVAPTKELVNQIVNEGRKLCTNSGVSITAMRKGMHLSARSAECTLESGDENDHMTRPLDGPLIVKADILVTTPLLLANTLSQDKTKLSSVQYFVFDEADVLLDPLFRDQTLSLWKACTNPSLRTSLWSATVGSNIEELVIDLIDERQARLELQSRSSLLRCIVGLKDSALSTISHKLIYAATEPGKLLGLRQLLHPSTTLTSKYAAPPLRPPFLVFTQTIERAVALHAELLYDIPTEAGGSSRVAVLHSDLSESKRSEIMARFRKGQIWVLVTTDLLSRGIDFRGVNGVVNYDIPTSSAAYVHRVGRTGRAGREGGIAVTLYTKDDIKYVKAIANAIAASEKARGRTKATSGEDGVQKWLLNALPDISKKDRQELKKRGVNVRRPLREGDDDKDVKAKRTSRISSKSGYERRLENNRKGAIAARQDRLEDESEGSESDAWSGFDG

SEQ ID NO: 13181 - protein, 682 aa, Gallibacterium anatis 12656/12
MDHATAGAKFVLNKYPNLLGKVLAFCIAGHHAGLANGAREEKLSTLQQRLASDTPEADPVWQQELTLPEQFQPPKLQILNKNEGCFALSFFTRMIYSCVVDADYLDTEAFYSKVENKSVERGNYPDLNTLQQRFIHYIQNKFQPTDDPLKTEEAKKAEANQELNQIRSHIFDYAVQQAALPPGLFTLTVPTGGGKTFTSMAFALEHAKLHHLRRIIYVIPFTSIIEQNAAEFRKAFEDLGEQAVLEHHSNFDDSHFVDKSSKDKLRLASENWDMPVVVTTAVQFFESLFANRSSRCRKLHNIAGSVIILDEAQMLPLNLLRPIMAAINELAHNYRCSVVMCTATQPAIHQQNGFYNGFKNTRELAPEPEKLFEKLARTTVQYVGEKTDADLLADLTNHAQILVIVNNRRHAQSLYQSAKELESVFHLSTLMCAAHRTQVLNEIRSRLKEGSPCRVIATPLVEAGVDIDFPRVMRAEAGLDSVAQAAGRCNREGKRKTEESLVLIFKPEDQWQPPAELKTYAACMRSVVRQHQQNLLSPQAISDYFSQVYALKDEELDKEGILKDCHNSAYDFPFDTMAKNFRMIQSHLVPLIIRFDDEAKAAVEALQTADKIGGILRNLQRYTVQIPENVLAKLYSARMVDTINDDKFGKQFYYLINDDLYDNNMGLTWENPEHLGAKQCSI

SEQ ID NO: 13182 - protein, 631 aa, Ascaris suum
MDRHNRWTDKADHHRWGDYYLSGGRKGKKSWALEFVHTVNQMIPSFNELFDEETFYAFAFIVVISSILVAVFLSKVVGIRIREYPLNRQAAKLLIERKDVIVQAPTGSGKTLAYLLPVVTILRATKQDWTLNEIGSLIVVPSRELAIQVSGVCRRIAEPLHLNVATIIGGKKVQEQVEKLKRNGAAIIVATPGRFEQILSLDAELKRRLKALEVLIIDEADRLIDMGFKKSITEILAALPKQRRTGLFSATQTKAMEELMKFGLRNLVRVTVADSKRSASTDAEECEGGTVLPGTLHCFYCVIKAEEKLSALIELIRNEPQAKVLVFFSTCSCVQYMKKILTHFLRKRQIFAIHGKKKRNREQQVEMFEKKQRAVMLCTDVMSRGIDITSIDFVVQFDIPRQSSWFIHRSGRCARNGREGKSVLLLTPEEEAYINFIQNYEKISLSRIKIPTSNAAKAEQLRQRIVKIASSDRDILECGSKAFVSFIESYARHDCAIVCSVQDLDVVGHAHAYGLLRMPRMNELRGRDLSAFRRCDIDTATIAFKEKFREKQRQEKLQRRNESLDQLAEEEREKEKVERKSSIPAVMKKRKRRIDAEKRKEWEELASDVTLLKKFKCGRIGKKELFEHLSA

SEQ ID NO: 13183 - protein, 499 aa, Haloquadratum walsbyi J07HQW1
AAGLDIPSVSGHSPDLIDSHINSLPSSTTDSKQQLNALREKARQGVAHRLSEFEHSETNLGTITLPTGFGKTLTGVQAALTLADEASRVVYAFPYTSILDQTDEVLQTALNIQPTEPGYTVHHHLSDTRTLPRSNAREHAIDDAAAELLAETWHAPLVLTTFVQLFESLAGPTNSQGVKLSSLQDAVVLLDEPQALPERWWRFIAWTVDLLNREFNTTVIFMTATQPRLLEYLPYTDNPFELVPDHTQYFDFLTHSPRVRYRLDNSVQRYLESPQTASSRPLTDAISEVVSADEKHVLSVGNTVASVAEQGSQLLTRLDGAVSLNSCLGSVYDEFTSAHAYHEQITDRLLARVSVDSPTVVAILTSRLRPLDRSILLSAIRRLLNSEIPIYVVSTQLIEAGVDVSFEQVYRDFAPLPSLIQTAGRCNREFGDNVSDVVVWRLQSPEHGTATADIIYRDGYNLLSPTRETLQSMANSGMISEQKMAVDASEAYFRRLHTD

SEQ ID NO: 13184 - protein, 990 aa, Actinomyces graevenitzii F0530
MIRKPAPAFPLPQPQLEADELSELARSFWAKSGSAETWLSVVQHLLDSADIAGYLFDEYLSEHHRQLMASVWGGDQAKARAAFVFLAACHDCGKVSPQFSCQCTDLAELIRNQGLTVMRKRDYPERSYLPHGLVSQFALWDEISEAGGNRLAARQWAILVGVHHGRYPSADAVALAQQQYRYQEGSSQDDPRWGQARSEILRFMARRSGFPLIAPDTALPELPIAVASAYASALVIADWLASNEDYFPLRLRPVDDSGKLSISGYPELNARQQHERVRRAWKRAQFPTPMRIPSYHSENVADFYRHRFSWPASYQPTKAQREVIKIAAAENPDLMIVEAPPGSGKTELAFAAAEVLMRERGLQGIFVALPTQATTNAMFERVTSWLTSILGDEPQKLGVHLAHGKNNLNKSFMELLESGHSPLEVYDDDADSKDNGLHASRWMGQRWRSTLSPVVVGTIDQVLLAALKSRHVLVRHLGLMGKVVIIDEVHAADAYMQTYLKAALTWLGLYQIPVVLLSATLPPERRRELLDAYRRGQSGDTIANTELDKAIGYPVISTVTAGQVRIHEIEGEAEVTKQIIPTQVASAEEIAKLLEKELADGGCAVVIRNTVREAQETYAAVKKVLGRQQTTLLHSRFLAVERSARDSSMLELFGKNSTKRPQRHVVVATQVIEQSLDVDFDLMLTDPAPMDLVLQRIGRLYRHAGRNRPQGLQAARCLVLVNDLASAPWNYSSGTDYVYARYTNLRTLGILADRGQITVSEPNDYAQLTALAYNTAEPVGPQQWAASLDAALEKYLHDNQRSQAKADDWCLDGMNLPKWKAPALESKFMGNAATGEESNGPAVAASRAAVRDGEDQIPVFVVALDPELNNVPVAPPISGTQPDGTPLAVSEYNARGRIADICSWSISLPPWAFRASGQDLDEAVDAVAQEIWDDPITQDWACRQHPLLAGELILAMYLSPDGTRLTRDLYGHKLTYSIENGMEVQGNETP

SEQ ID NO: 13185 - protein, 939 aa, Actinomyces sp. oral taxon 172 str. F0311
MDAADVAGYLFDEYVSEHHRRLMASVWEGDQAKARATFVFLAGSHDVGKVSPQFACQSAELAPFIRAQGFGIMRKADYPERKFLPHGLVSQFAFQEAIVRGGGDAARAVHWAVLVGIHHGRYPDAGAVNVARQQYRTQEGSEQDDPRWGQARAEILRWMARRSGFPLEVPGTALPELPIAVASAYASALVIADWLASNEDYFPLRPRPDKGDEECAIRFYPELDAGQQCKRAERGWKRAAFPAPMRLPATLEEPIADFYRHRFGWPTSYRPTCAQRNAVEIASTEDPDLMIVEAPPGSGKTELAFAAAEVLMRARGLQGVFVALPTQATTNAMFERVTSWLTSILGDEPQRLGIQLAHGKNSLNESFMRLLESGQSPLEVHDDEEDQGLHASRWMGQRWRSTLSPVVVGTIDQVLLAALKSRHVLVRHLGLMGKVVVIDEVHAADEYMETYLEAALTWLGMYEIPVVLLSATLPPARRRALLDAYRRGRGSSGEGAQLVEGMIGYPVISTVSATGVHVHEIDGEAEVPKRIVPISMGSAREIAQMLDRELADGGCAVVIRNTVREAQETYDAVKAVFGREQTTLLHSRFLAAERAARDRRMLELFGKGATQRPQRHVVVATQVIEQSLDVDFDLMLTDPAPMDLILQRIGRLHRHERADRPAGLHEARCLVLVEDLFAVPWAYSTGTDHVYSRHAVLRTLGILSDRGEITVREPIDYAQLTALAYSDAEAVGLAQWADAFDTALDERERNTAQSRMRASTWCLDGANLPRWQAPELEEKLQGNAATGEETKGPGVAAARAAVRDGEDQIPVLVVAIDPELGNVPVPPPLTGGATDDEELEVGEYNARGRIADICSWSISLPPWALRARGQSVDQAVDAVAGAIWDDPITAEWACREHPFLAGELILAMYKTPGGERLTRDLCGHTFTYSTEKGMEVQGQ

SEQ ID NO: 13186 - protein, 823 aa, Aggregatibacter sp. oral taxon 458 str. W10330
MPKDAIAHVRKLDGLQQLLIDHLLETSSISGQLAAKLNLGVVGELLGLMHDFGKYSRKFQKYIHDKTGLFNPDLDDEESTPNGSKVDHSTAGAQWVYRELRKFGAAQGIGELFGQMLGLCIASHHGEGLIDCLNGEGNPKWIERFNKTDELTHLAECEQNADEAVLQKAKELAGENLIRSLLKAVKPILSDPVSNDKIKEFYLGCLTRFLFSCLIDADRINSSDFEREAQKEVRRLTEKPDWQTAIDQLEAKLAGFENRYPIDEIRRRISDDCLKRAADSQGIYTLTVPTGGGKTLASLRYALHHAQKHNLDRIIYIIPYTSIIDQNAQAVREILGEDWVLEHHSNLEPEKQSWQDKLLSENWDKPIVFTTMVQFLDAWFGGGTRGARHIHPMTNAVLIFDEIQTLSVKCVHLFCNVLNWLTTFGKSTAILCTATQPLLGESGLQDFPEGKRESIAARGLLRLPAHAEIMGTDEQREELYKKLSRVEIRFNEKAGGWNVEEAGVFLLEQFQTTQSCLFIVNTKKWAQELYQYCKTQNVPPEALFHLSTHQCAAHRKAIFNTIKARLENKQPVICISTQLIEAGVDISMACVIRALGGLDSIAQAAGRCNRHGEKKGKGQVWVLNLQEQDFTQILPDIQAGKKHAERVFRDFAGQDILQPAAMERYFEYYFYQRSDEMAYSIKNSTTGSLLDWLSDNALNPYGEKNNKRSKPLPLLMQSFKSAGRAFQAIDAPTHAVIVPYGEGAELIAKLCGAWDPKEMYDAKKKAQRYSVNVFPNVWGKLQKENALYETIEGSGIYYLNERYYNDEFGLSLDETSEMTFYDL

SEQ ID NO: 13187 - protein, 763 aa, Aggregatibacter sp. oral taxon 458 str. W10330
MSQSVMRYAHSAQDELGNLLPYEHWQTLQSHSVNVGEMAAEFARVFGAQEIACQTGKLHDLGKYSEPFNHRLHGGSSVDHATAGAKIAVERWGNVIGKLMAFCIAGHHAGLANGNGEGDNRRTLKDRLALRFGADIPALDNLWQQEIKLPQNLSAPSLKADAHHPFFSYAFFTRMLYSCLVDADYLDTEAFYSNLENKAVERGGYPDLNALQHNFNQFINAFRRRVAQAPEQTEAEKRNAALNRLRSEILDHAVEQAAQAQGLFTLTVPTGGGKTFTSMAFALEHAKQHGMRRVIYVIPFTSIIEQNATEFRKAFGELGEQAVLEHHSTFDDDKLQNEATKDKLRLASENWDAPIVVTTAVQFFESLFADRSSRCRKLHNIAGSVIILDEAQILPLNLLLPIMQAIKELAQNYRCSIVMCTATQPAVQAENGFYRGFENMREIAPKPTALFDKLRRTTVQHIGTQTDADLLAKLGEHLQMLVIVNNRRHASSLYDQAKHLDGTFHLTTLMCAKHRSQKLDEIRGRLKNGEPCRVIATSLIEAGVDVDFPLVMRAEAGLDSVAQAAGRCNREGKRPSENSFVWIFAPEEQWKAPPELAAQAAVMRLTADSFSDDLLSTQAVAAYFKDLYDQKGKELDYKQILQMHHNAGQSLDFPFQTIADKFRMIESHMQPLIIPFDGGAENLISSLHHADHIGGLLRKLQPYIVQIPEKALAALYKAGRIEPINEKNFGKQFYTLIGLDLYDEVAGLSWEDVEFLKGESLVF

SEQ ID NO: 13188 - protein, 696 aa, Bacillus thuringiensis T01-328; identical to SEQ ID NO: 11934

SEQ ID NO: 13189 - protein, 802 aa, Atopobium sp. oral taxon 810 str. F0209
MLYAHSKDDDQTQWQPLHEHLENVAELCGEFAKAFGYEQWGRVLGLLHDAGKSCDRFQKERLRNRPVSVDHAAFGAARALELYGGRADKDDPYGSQAYMGELLAYAILGHHGGMKTSIDVEDRVKQLGMPPAPGKAVDNYSPYHVMIGEFPDVVPPARLDLEPMMHSCIMRSCSESVQDEEARNIVQQRLSFSGQALTRMLFSCLVDADWIDTERFMSPEVAEQREHGYDSIPVLLDRLENHLDGLASEVEDTPVNEARAAVLADCREGAASKSGLFTLTVPTGGGKTLSSMEFALRHAAENGLERVIYAIPFTSIVEQSVAIFRDILGAENVLEHHSNYDFEEAAKEGREYERLAVQNWDAPIVVTTNVQLLESLFSNKPGKCRKLHNIANSVIVLDEAQTISIELMRPTLAALEELTLDFGVSVVLCTATQPAVQNEWPFGSCPRELCGAHKELFSKAFDGRIRYQLVGEIPEDDLVDKLASSHQVLCVVGKKAEALALYRDIVARAKESALLDDAKEPYEEGLFHLSAHMIPVHRSKMIVKIRERLDAGERCVVVSTQLIEAGVDFDFPVVWREMAGLDSIVQAAGRCNRNGKRTDKMGEKAPGDVFVFEFTERDGVFARPDERSFLGKTRSIASELLNEDGLDIDESLVSRYFGCCYQSTELDAKNLYKEMSSSKHLQSSDTCLFKRYISYDFEKYSSAYMIIEDEGTPIFVPWGEKGRKLLNRLYLSTHDEASLIHKLQPYSVSIYPRLMRELEREGLVEHLGLVNVLSMEDDCRTVYSEETGLLPPGEEVLNVMAL

SEQ ID NO: 13190 - protein, 695 aa, Aneurinibacillus aneurinilyticus ATCC 12856
MDYHDAGKAHEPFQLKILKALGEEVTLMKDLEVPHNYLSPFLLPEAVFALPKQDYQALIQAIAFHHERNVEPDSQLIKKALYEDLWPKLTDINEHLATEGANLEERFNRILKQMKKRIKYSDHKTNYVDYVLLKGLLHRLDHAASAHVPIEVDAEQDFKQLVDQGFAKIASDKGVPVEQVYRELQKYAHKHRKENVIIIAQTGMGKTEAALLWASNSKTFFTLPLRVSINALFDRIYSKMNYKNVGLLHSSSMDYLTENLEEDWEVVSEQSRHFASKLLFTTIDQILKFPFLYREYEKELATMAYSSLVIDEIQAYDPKIAAVLIRALEMIYLVGGRFLLMTATLPSIYLETLRESGIIPPEAFQVKTFVDDTVIRHRIELVEKSIVDDVEEMIRLAETKKVLVIANTVKQAMELYGRIKEKTEKVRVFHSMYIQKHRAIIEKELLAFDENEQATGIWVTTQLVEASIDIDFDVLFTEAATLDSLCQRFGRCYRRRQYKKTVPNIFIYTVEPSGTGYIYDKEILERSITLLKSFSGEILPESEKVRLVSELYKRDNLKGTEFLKKFDGALEQLNTFDDYTLSNKDAQRLLRDIQAELVIPCDVYDNHSCLFEQLEQADKEKRTELRRKITRLTVSLRKTAARGRTRKLPHKGKKQNGEEYDLLPWIQILDLKYEFNEVSKTGAGVLLDQEIDNQI

SEQ ID NO: 13191 - protein, 801 aa, Clostridium sp. KLE 1755
MDLIKGEYIAHIRRSDKCRQTVTEHNDGVARLAKRSGAMFGLENLASFSGRYHDIGKNTMSYYNYINDAADGKPVVRGSVLHSIYGACFADHLAKDTDLFSKLAAEMIRVSIMSHHGLRNSLTKDGTSTFSRAAERISDSYKQVEYIVYEIYGERVILEEFAQACAEARNIRDEINKFRSKGNGLGSAHIYLALYVRLLTSILIDADCTDTACFEDNVKIPEQKSAKELTAIWRRYRVNCENEIQKMLREKESSPLDFFRNEISEACDKFEGKSCGIFRLVVPCGAGKTISALRYALQTAERYEKRRIFYIAPYNSILEQNADEIARYIGDDSAVLRHHSNMVFKQDDGEKETKYKLLTENWLQSPVIATSAVQFLDTLFASKTSAVRRMQALGNAIIIVDEIQALPIKVLKLFNAAMNFLSSFCNTSILLCSATQPLLDELNDYRICPPRDIIQDVDRYNEAFRRVEIVDCIRGNGFSSDEAADFIFGLAQKVKSMLAIVNTKATARRIAERILKLSCGDSEYKVFHLSTNMCPAHRSTVIREMRRYLSDEKSSKKIICVSTTLIEAGVDLSFEHVVRSLTGLDSIVQSAGRCNRNRETICGTLSLIYINDEKIGKLDHIKEAQEITREILYHIHMNADRYPGGALSKAAMDGFYSKYYRPLKREMAFPLKDDPEHTIIDLLTNSPVGSERKQTTGGILLKQAFREAGEAFEVIDNTGKHSVIVEYNDDARKHIHILLSSHFIYEQKKQLRYLQQYTVQLPTYTIEKIGAGIVQENEIGVMILSNEFYDKVYGIDDELKI

SEQ ID NO: 13192 - protein, 774 aa, Clostridium  symbiosum ATCC 14940
MAILCFLTAEKLGLGKLAKLMGLLHDFGKGTADFQNYLRGAGSRHHNHAGLGALYVHRHWWQREAAKERRQTAQLISLCIYGHHAGLPDCLTASGRSPYLDGLREQPENYYIEAMENFYAEVASAEKLDKLFDDACKELKEFGLDSHSFNWGMLARLLLSILVDADRWDSACFEYDEDPFEMAQEAQPDWEKLLIKLEAYVEKFPREGELATIRRNISAWCRAAGEYGPGIYTLSVPTGGGKTFSSLRFALSQAEKYRQRRIFYLIPMNTILDQNSRDIRDALSDYPSILEFHSNVIPENEAEEENYRRLTERFDSDIILTSLVQFLDTFFQKGNGKVRRMYRFANSVLIFDEVQALPKKCRELFKLALQFLVRFCNCTVLLCTATQPNLGLEAKELVPDVDALYQKLKRVTYISEMGPRKYQEAADDIAGFIGKKTSVLMIVNTKDAAWNIFQGISEQLETLNYRQVQIRQDLTDEELEKCAGGCAEDEILCVHLSTLMCPIHRKEILRWIKVWLSKKKLVCCVSTALIEAGINVSFPTVIRSLAGIPSLIQAAGRCNRNCEADMGNVYLWNLAEERLSRLPDIQKGKEISMSLLSNVENPDELGNPEMIKRYFAKEEIYTQEVEKYQYKEWNSDLVTMLSTNRECRCTAGNLRDENNPLPDLSKRFYQSFRTAGTVFQVIDQKTKSVIVPYGKGKELIERLGDRHTLSEEIRLLKEAQQYSVNLFEHIFNRLAGEGALVSLGETGAVILKDEYYDPWAGVTITPQEMKELIM

SEQ ID NO: 13193 - protein, 718 aa, Clostridiales bacterium oral taxon 876 str. F0540
MIYAKSNPVETLRQHTNELIKAYKLIKELYGETIEKSISMDPKRFWELLEMACYYHDLGKANTPFQNIIRSAIGEKELEDEIKINIPHNYLSPAFLPWQELTKEERRLLVQVIGYHHERDISPDKEMIKHIIDNDLKERVEELCSEMSLNIDKLTKLYTKDIDDKNRIKEDEDIYKDYILMKGLLHRIDHAASAHHSIEDNVSVGVGKVTRWYLETEFKGGLREAQSFAFANRNKNVLLVASTGIGKTESALLWIDDSKGFFTLPLRVSINALYTRVIDDIQYNNTGLIHSTSRDYLDSIEHKNSSEVYEQSKLLSKKLSFSTIDQLFKFPFKYRGYEKIYATLAYSKVVIDEIQAYSPEITAVILKGLEMIHKIGGRFMIMTATLPRIYKDYLMDRGIHPVEGEYLSEMKRHKVKVVDKNINDAVEDIVERGKNNRAIVIVNTVKKALELFNIINEEKNSENCYLLHSMFTQGDRAELEKQIKDFVDDRKNKGSKGIWITTQIVEASLDVDFDYLFTEISTLDSMFQRFGRCYRKRLFDRNEPNVYIYTKDPTGYGSIYDKAILDKSTELIRKYDNVLMEEKDKVNLVDFLYSRENLRETEFYDKFVEAIRLLDNVIDYDLDSSEAQKVLRDIDSTRVIPRSIYDENINIFEEYTSSASKRRLQILTAINKLSINVPKYKLPKNLSEHKDIKNLYILDAEYSNKKGLLLDSASDNIF

SEQ ID NO: 13194 - protein, 818 aa, Clostridium sp. ATCC 29733
MYIAHKTGDEREQPLKAHLSAVAESCRTVGLDIGLPITFYLVGLLHDMGKYSREFQDYIRKALPALRGTVNHSAAGGRWVEHCNPMTGVDGLLSELMVAAICGHHSGLPDCLDLNGDLPLRNRLAPRKPPDWDEVFARFFSDCLEKGEWDRLFAQARGEWQLHKKVLVDIAKKAGASANALYAFLFGMTQRFLESALVDADRYDAYLFEAGLPPSPEVDVAPLWEQMVDNLEKQMQDFARMPDRNAIEIARGEIADACLAFAQRVPGIYRLYVPTGGGKTLSSVRYALACARRWKMRRIFYIAPYKSILTQNAGVLGKTLKAGDALLEHHGDAVVPEGKEVGEDDGRARHQLLTERWNAPMILTSAVQFLNTLFSGKSASVRRFHQLAGSVILLDEVQSIPIKCLHLLNGTLDYLAGVCGCSVVLCTATQPNLDDREIPLLLGPNAQMVEGVEEIFEQFRRVDVIDETRQEHTADTLAQRLEQQLEEADSILAVVNTKAAAQALYEALCRRREEGEGRSDYLLSNWLCSQHRQDKLDVLCEQLSKKEKLERPQKVICVSTQLIEAGVDISFDCVFRSLAGLDSIAQAAGRCNRHGKGGRGKVFIVKYGAERLGPLPDIRRAQEACIPILEQVARKIARGEADGGTYLAPATIHAYYREYYARQDGQLNYPVSAKKSDCPFDVELFDLLSANRAGEEVWKDRREGEGITVLAHHAYHTAGRLFEAIEDRGGIDVLVPYGGAKELIDWFANCPDIRQLPAKLREAQRYLVHISDYEKNLLTEKQALEYRPEAGVWTLDERFYDSELGLQKEPGELSLLNF

SEQ ID NO: 13195 - protein, 755 aa, Salinisphaera shabanensis E1L3A
MFYAHSTECSDARDWQGLADHLQAVADLAAKRAARFGWENAGRAAGLLHDLGKYSPAFQRRLSGSGERVDHSTAGALEAKTRFPDGLGHLLAYAIAGHHAGLANGRDAGTRTPLSDRLVADLPTLSSRWREELVLPDSLHPDGAFHQRRDRPFFQMAFLTRMLFSCLVDADFIETETFYTVVAGDAPPERGNPTSLSTLRDALNTHLDELAAKARKSPVNERRADILHHVRAAAPEPPGHFSLTVPTGGGKTLASLAFALDHAIAHGMDRVIYVIPFTSIVEQNAAVFRDALGAFGEDAVLEHHSAFDDDSRRGRQDRHSRDKLKRASENWDMPIVVTTAVQFFESLFAAKTSKARKLHNIANSVVVLDEAQTMPLALLRPSVAALDELALNYRASIVLCTATQPALEETDNPAHSFAGGLRDVRELAPDPHSLAQQFERVTVRHIGTLDDDGLTEELLDCEQVLCIVNNRRHARALYESIADSPGAYHLTTAMCAVHRRQILAEIREVLASGSPCRVVSTSLIEAGVDIDFPRVLRAEAGLDSIAQAAGRCNREGRRESDQSEVRIFATANQDWAPPPELKQFAQATRAVLRAHGEAPLAPAAITAYFRLLYWQKGPQELDKHDLLGQIETAQLDGLPFDMLEQKYRLIENTQRSVIIPYDDRARRAIADLSHAERVGGIARTLQPYTVQVPIKGFHALEQAGVIAAIEPDRFGDQFVLLIDEHPSELNTNSYDPNMGLNWSDPTYRSAESNLW

SEQ ID NO: 13196 - protein, 732 aa, Campylobacter concisus UNSW1
MKESILFDEFWSHPNKLLENHIKNMISPDDDELSKQVKLYHDIAKLKNNFQIYIRDTSNDKLDKNHSLLSAYFFLLNSKFDEVPTIFGFLAIVSHHGDVVNLMTLAREANKFFKNQKELEQWDEVAGVAKNIKIYSGLSTKKDEFLDRAEKLRQYLVLSQYRHKFTYEDFINFKSLYSNLIYSDKFEAIFSMPKQESKDIPIDVLESNIQNLPPNEKRDAFRNFVLNNFDENYKLFTLTAPTGYGKTLTALNFALKFNKPRIIYALPFTTIIDQTYDIVAKIYKNSDILVSKAHHKTTIGEENLTDEDRYSKIKFLMESFSGEINVTTLYQLIFALFGNKNKDNVKFNQLKNSVVIIDEAQAIPYNFRKDFIQLCEIISQRLGTIFIFMSATMPVIKGENFKEISNLDYFSKQDRYVIKWLDIGGEDELLEKICEAASDKNTLVVVNTIKKAQELFTKLRDKFSCFCLNGYMYDDHKRATIEAVRCVIDKNKVDPLASKILLISTQSIEAGVDIDFDIGFREVSPISSIIQTAGRINRHFGATRGELYVFPEISKFTNLIYGDLYKVSGAILGDLKQKEVRESEILEISNLYFQKISNQLENLYVKSEIEKLEFENINQKIEDIMNDNHKQTLIIEPEENFIKDFEAKIFEIKNSPNEKFTIRDLFKNHIRKLSKFSINVALKDMNKLMPNLKQINGLKDMFYLPFGSSYFYSTECGLKKDTNLDIEDEVFD

SEQ ID NO: 13197 - protein, 748 aa, Campylobacter concisus UNSWCS
MRPKNLSMHICMMQISDVFNSHPQKPYNSHIKNTANSFDDDEHKEAASFHDLAKISQKFQDYINLDAKNFNSADEFEKARQKLKTTHTLESAFIYFFARANKDINFLANFFAILKHHSDLPDIDYFLSSIGSTKAKLIDRLKKIDEVAQRANLDIDIDIYDFVDYFLDLENELSKYYGLESFFIFKKRYSRLILADKFEAIFSESYQNLAVLNAKKIDHYIDRIKSLIADKKQDDYKDKAREIIFKNFNSNKDKKTFLIKAPTGIGKTFLALNLALEIARNGNKRRIITAIPFTSIIDQTHTEYQKIIADQDVLKYHHLTSYKSQNDDEQEQFMQKVFLADIWHENFIVTTFNQLFFTFFSNHNKDNLKLETLRDSVIIIDEIQNIPRVLLKSIAAAFNEFSKRYNIHFIIMSATMPHIAAELESFTELSEPILYKREKDRYEIIYEPDIKGLDDLVSKILKHQDESALCVVNTISKAKKLYETIKNSGKKGVYLLTTHQIPLHRIQIIDEIKEKLKSGEKITLVATQLIEAGVDLSFDVGFREFAPIGAIIQAAGRVNRNATSSKPAKVVVFDYIDGETFPYHDIDLQEEKVKEILSRSIKESEIYQILESYFQSTKDETTSIDLLSLAKELKFQTLFDKFNANFMPKQDYKVSLFIEQYNGHFNEFLEKREALLTSGKDKFIILANIKELEKELALYTIAVGKNMLGDIKSYTRELFGRYVLAPSDFYNKFDGFLPELTVADEVFD

SEQ ID NO: 13198 - protein, 737 aa, Campylobacter concisus ATCC 51561
MMQISDVFSSHPQKSYNSHIKNIANSFDDDEHKEAASFHDLAKISQKFQDYINLDAKNFNSVDEFEKARQKLKTTHTLESSFIYFFARANKDINFLANFFAILKHHSDLPDVDYFLSSIGSTKAKLIDRLKKIDEIAKRANLDIDIDLYDFVDYFLDLENELSKYYGLESFFIFKKRYSRLILADKFEAIFSESYQNLAVLNVKKIDHYIDRIKSLIATKKQDDYKDKAREIIFKNFNSNKDKKTFLIKAPTGIGKTFLALNLALEIAKNGNKRRIITAIPFTSIIDQTHTEYQKIIADQDVLKYHHLTSYKSQNDDEQEQFMQKVFLADIWHENFIVTTFNQLFFTFFSNHNKDNLKLETLRDSVIIIDEIQNIPRVLLKSIAAAFNEFSKRYNIHFIIMSATMPHIAAELESFTELSEPILYKREKDRYEIIYEPDIKGLDDLVNEILKHQDESALCVVNTISKAKKLYETLKNSGKKGFYLLTTHQIPLHRVQIIDEIKEKLEGGEKITLVATQLVEAGVDLSFDVGFREFAPIGAIIQAAGRVNRNATSSKPAKVVVFDYIDGETFPYHDIDLQEEKVKEILSRSIKESEIYQILESYFQSTKNETTSIDLLGLAKELKFQTLFDKFNDNFMPKQDYKVSLFIEQYNGHFNEFLEKREALLTSGKDKFIILANIKELEKELALYTIAVGKNMLGNIKSYTRELFGRYVLAPSDFYNKFDGFLPELTVADEVFD

SEQ ID NO: 13199 - protein, 737 aa, Campylobacter concisus UNSW2
MMQISDVFNSHPQKSYNSHIKNIANSFDDDEHKEAASFHDLAKISQKFQDYINLDAKNFNSVDEFEKARQKLKTTHTLESAFIYFFARANKDINFLANFFAILKHHSDLPDIDYFLSSIGSTKAKLIDRLKKIDEVAQRANLDIDIDIYDFVDYFLDLENELSKYYGLESFFIFKKRYSRLILADKFEAIFSESYQNLAVLNAKKIDLYIDRIKSLIATKKQDDYKDKAREIIFKNFNSNKDKKTFLIKAPTGIGKTFLALNLALEIAKNGNKRRIITAIPFTSIIDQTHTEYQKIIADQDVLKYHHLTSYKSQNDDEQEQFMQKIFLADIWHENFIVTTFNQLFFAFFSNHNKDNLKLETLRDSVIIIDEIQNIPRVLLKSIAAAFNEFSKRYNIHFIIMSATMPHIAAELESFTELSEPILYKREKDRYEITYEPDIKGLDDLVSEILKHQDESALCVVNTISKAKKLYETLKNSGKKGVYLLTTHQIPLHRVQIIDEIKEKLKSGEKITLVATQLIEAGVDLSFDVGFREFAPIGAIIQAAGRVNRNATSSKPAKVVVFDYIDGETFPYHDIDLQEEKVKEILSRSIKESEIYQILESYFQSTKDETTSIDLLSLAKELKFQTLFDKFNANFMPKQDYKVSLFIEQYNGHFNEFLEKREALLTSDKDKFIILANIKELEKELALYTIAVGKNMLGNIKSYTRELFGRYVLAPSDFYNKFDGFLPELTAADEVFD

SEQ ID NO: 13200 - protein, 706 aa, Porphyromonas gingivalis F0569
MSRYEHIFAKSDGTPLLQHLQDVAKAAEVMAQHWGLSTDMARKGAHLHDIGKASPIFQSRLKAEDNLGGDVFRHEIASIFFISLLPDEVDRRAIIEMIAAHHKSICNDSRELGLLDLDENESRCFKLHSKGFEQWSQEALGILHELGWETHPITMDEARSNYQEAVDYCSSLGRNCSQWKGLLMAADHFASGLDGQTEDTLRKLFVTPDLSYYRNRRSELYPLSLLSADDERQHTLVTAPTGAGKTDFLLRRCRGRVFYTLPFQASINAMYDRLKADLRDTDAQIYPLHAASILKLNGGYERILSRHVGASIKVLTPHQIAALAFGLKGYEVTALDIRGCDVILDEIHTYRKETQAMVLKIVEILVALGCRIHIGTATMPTDLYTGLLRLLGGETAVYEVKLPKEVLKGFDRHTIHKAGSTEDVEPVIQKAIEQSQKILMVCNQVKRAQQLYQEVVGKYPAIPTLLIHSRFKRGHRAQLEQELKERYNQCQGPCIVVSTQVVEVSLDISFDMMLTECAPIDALIQRFGRINRKRSLETIGQTKPIYVIAPPENEKEALPYELEILQRSYSSLPHCEVLHEADVQQLLDAVYPEVMALDINMHTIFQDGEWVMKELKHNSKSALFKILDINSACCIMESDREEYENGNYINRTPLEIPVPQSIRFKQLVATNCGAHPFVIPDRAYDSKLGLMEEFADSRYYKSFEIF

SEQ ID NO: 13201 - protein, 710 aa, Porphyromonas gingivalis F0570
MNDLRLILAKSDGTPLIQHLKDVAMVAEVLAHHLGLSVEIARKGAHLHDIGKTSCIFQQKLVGINPPFKKSFRHEIASLFFLSLLQDKEERCAVIEMVAAHHRSICNDMPKRGLLGLLDLEDKYPHCFELHSEGFEQWSQEALGILHELGWETHPITMDEARSNYQEAVDYCSSLGRNCSQWKGLLMAADHFASGLDGQTEDTLRKLFIIPDLSYYRNRRSELYPLSLLSADDERKHTLVTAPTGAGKTDFLLRRCHGRVFYTLPFQASINAMYDRLKADLQDTDAQIYPLHAASILKLNGGYERILSRHVGASIKVLTPHQIAALAFGLKGYEVTALDIRGCDVILDEIHTYRKETQAMVLKIVEILIALGCRIHIGTATMPTDLYTGLLQLLGGETAVYEVKLPKEVLKGFDRHTIHKVGSMEDVGPVIQKAVEQGQKILMVCNQVKRAQQLYQEVIGKYPAIPTLLVHSRFKRGHRAQLELELKERYNQCQGPCIVVSTQVVEVSLDISFDLMLTECAPIDALIQRFGRINRKRSLETIGQTMPIYVIAPPENEKEALPYELEILQRSYSSLPHCEVLHEADVQQLLDSVYPEVMALDIDMLTVFQEGKWVMKKLKHNPKSALFETLDINSACCLMEKDREVYENGSFAERTLLEIPVARSITQRNNLTPITCGVHPFLIPDQAYDSKLGLLEEFAAPRYYNSFEII

SEQ ID NO: 13202 - protein, 706 aa, Porphyromonas gingivalis F0568
MSRYEHIFAKSDGTPLLQHLQDVAKAAEVMAQHWGLSTDMARKGAHLHDIGKASPIFQSRLKAEDNLGGDVFRHEIASIFFISLLPDEVDRRAIIEMIAAHHKSICNDSRELGLLDLDENESRCFKLHSKGFEQWSQEALGILHELGWETHPITMDEARSNYQEAVDYCSSLGRNCSQWKGLLMAADHFASGLDGQTEDTLRKLFVTPDLSYYRNRRSELYPLSLLSADDERQHTLVTAPTGAGKTDFLLRRCRGRVFYTLPFQASINAMYDRLKADLRDTDAQIYPLHAASILKLNGGYERILSRHVGASIKVLTPHQIAALAFGLKGYEVTALDIRGCDVILDEIHTYRKETQAMVLKIVEILVALGCRIHIGTATMPTDLYTGLLRLLGGETAVYEVKLPKEVLKGFDRHTIHKAGSMEDVEPVIQKAIEQSQKILMVCNQVKRAQQLYQEVVGKYPAIPTLLIHSRFKRGHRAQLELELKERYNQCQGPCIVVSTQVVEVSLDISFDMMLTECAPIDALIQRFGRINRKRSLETIGQTKPIYVIAPPENEKEALPYELEILQRSYSSLPHCEVLHEADVQQLLDAVYPEVMALDINMHTIFQDGEWVMKELKHNSKSALFKILDINSACCIMESDREEYENGNYINRTPLEIPVPQSIRFKQLVATNCGAHPFVIPDRAYDSKLGLMEEFADSRYYKSFEIF

SEQ ID NO: 13203 - protein, 776 aa, Porphyromonas sp. oral taxon 278 str. W7784
MPDPIIAHTREDGSLQTLPEHIEGVAHHCALFLEEAGLPELAPLGRLLSQLHDAGKAQSAFQRYILGESEHKAPHSAAGALLATCMLYKLSEELQLKKLPRTSQLLAYAISGHHRGLYDYIELQKELKKEEIKKRYAKTTEALPNIKSELQTWIEKHAEATETSLKELAKKVGATEQAQALIRLLFSCLVDADFLDTEAFMDEERKGRRQEATSGYVPLETLRDRLTKHMEGFSTEGKINEARRAFLNQCRAHGQSCPKGYYSLFLPTGGGKTLSSMAWALETALKHEAKRIIYVIPYTSIITQTAGIFREIFGEENVLEHHSDISFSGDEASQEAERYERTRLLAENWDAPIIVTTNVQFFESLFSHKVSRSRKVHSIANSVVVFDEVQMFPTEFLHPMLRLLEDLRHIYGTQLLFCSATLPPFDKDHSSSFKRVNDFHQLSEDIQPIIPEDPELFKVFDRVIYHLEEKEYTTKELAEELARHDSALCIVNSRRDASQLYRALLEMGKKPQDVIHLSRNMCSAHLKERIAEVRQRLKAGIPTLVISTQLVEAGVDIDLPIVYRAMSGLDSIVQAGGRCNREGKQPVPGEVHIFTLNDYGKASKATTKEQEATRFLLNNYKEHTRPSMPLELIEAYYDCYYAFITSFDTKNIAKSLYDKDEAKRWRFDFQQASEDFQLIDNVDRDLFVPYGRGKELLEGLEKHTLYLNHRTLRELQQYHVSISKWRYEELKEARLLSEMVIDKETGKSILVLEPQGYDEALGVCTTNPLLDEPLFG

SEQ ID NO: 13204 - protein, 927 aa, Streptococcus sobrinus W1703
MDCCFWAKKKEENGQLLWLPLTQHLKDTSDIAGLLWEHWLGEGQKKLIMDSLETDHETDNLGKRTIQFLAAVHDIGKATPAFQTQKGYSNSEDLDLRLLEKLERSGFEGISSLQLASPRKSHHSVAGQYLLYTYGLKEDITTIIGGHHGKPIDSIDDYNCQGKSYPSNYFQFEESENRAVYQKWKQTQRNIFSWALKVSGFETIEALPKIKQPAQVLLSGLLIMADWIASNEHYFPLISIDDAKVKDESKRTPHGFQKWKKTSLWEPEIIINFKGAYKERFGFDPREVQIALADIIANTHNPGIFILEAPMGVGKTEAALIAAEQLAAKRGRNGLFFGLPTQATSNGIFPRIENWLESIQGDLEENISIHLVHGKAQLNEDFDRLRLAENINIDEADSGSVIVNEWFSGRKTASLDDFVVGTVDQFLMVALKQKHLALRHLGFSKKVVIIDEVHAYDAYMNQYLLEAIRWMGAYGVPVVILSATLPAERRVELLKNYMLGLGKEFNKKERRQLAETLKTEAYPLITYNDGFEVCQRKGFQQTKNKNITVQRLNEESLLETVERELSDGGVVGLIVNTVKRAQELAKSFVEKFGEDMVELLHSGFIATQRTQKEKDLLQIIGKNAKRPKRKIIIGTQVIEQSLDIDFDVLISDLAPMDLLIQRMGRLHRHDIKRPVKHMLPRFYVLGTSESLDFEEGSSFVYGDYLLARTQYFLPDTISLPEDISPLVQKVYNFNLKDDCDQNINLADDLRAKYLEARKRYKAKMEAKKSKAKNYRIDNPVLKPSRKRPESLIGWIKNPNPDESEEKAYAQVRDIEDTIEVIALKRLESGYGLFGENQDISSNITDFKIAKKVAQNTSRLPLTLSKSYNVDKTIEELEKYYRRHFENWDNSSWLKGTLGIVFNENNEFILNGFKLSYDEKYGIQVERV

SEQ ID NO: 13205 - protein, 706 aa, Porphyromonas gingivalis F0185
MSRYEHIFAKSDGTPLLQHLQDVAKAAEVMAQHWGLSTDMARKGAHLHDIGKASPIFQSRLKAEDNLGGDVFRHEIASIFFISLLPDEVDRRAIIEMIAAHHKSICNDSRELGLLDLDENESRCFKLHSKGFEQWSQEALGILHELGWETHPITMDEARSNYQEAVDYCSSLGRNCSQWKGLLMAADHFASGLDGQTEDTLRKLFVTPDLSYYRNRRSELYPLSLLSADDERQHTLVTAPTGAGKTDFLLRRCRGRVFYTLPFQASINAMYDRLKADLRDTDAQIYPLHAASILKLNGGYERILSRHVGASIKVLTPHQIAALAFGLKGYEVTALDIRGCDVILDEIHTYRKETQAMVLKIVEILVALGCRIHIGTATMPTDLYTGLLRLLGGETAVYEVKLPKEVLKGFDRHTIHKAGSMEDVEPVIQKAIEQSQKILMVCNQVTRAQQLYQEVVGKYPAIPTLLIHSRFKRGHRAQLEQELKERYNQCQGPCIVVSTQVVEVSLDISFDMMLTECAPIDALIQRFGRINRKRSLETIGQTKPIYVIAPPENEKEALPYELEILQRSYSSLPHCEVLHEADVQQLLDAVYPEVMALDINMHTIFQDGEWVMKELKHNSKSALFKILDINSACCIMESDREEYENGNYINRTPLEIPVPQSIRFKQLVATNCGAHPFVIPDRAYDSKLGLMEEFADSRYYKSFEIF

SEQ ID NO: 13206 - protein, 932 aa, Peptostreptococcaceae bacterium oral taxon 113 str. W5053
MEYVNDVFWAKKKEMNGQFFWLSLKQHLEDTKNIAGLLWEHWLCEGQRKLIEESLDDSSEDKGKKLAMFLGAIHDIGKATPAFQTKKGYEYSEELDFRLLENLERDGFSGIGSLHLTMPGYTPHNIAGQYLLMSYGVGKDIAVMIGGHHGKTVDVLAEIGEGIFSNTANYFQKEKKNHEIYRRWDREQRHIFKWALESCGFDSVEALPKIKQPAQVILLGLLIMADWIASNEDYFPLLSIERDERVNSSSRTEQGFSAWKRSDVWEAEYCSDIEELYKMKFGFAPRNVQKVMAKTIESIQNPGIIILEAPMGVGKTEAALAACEQLAYKTGRSGLFFGLPTQATSDGIFSRIVKWLPKIKEDQDEAVPVRLLHGKAYLNEEFTSLSRNINIDGEEDSCLIVNEWFSGRKTASLDDFVVGTVDQFLMVALRQKHLALRHLGYSKKVVIIDEVHAYDAYMNRYLLQAVKWVGTYGVPVIILSATLPENRRLELMKNYMSGMGIKWNKKERKERDNSIRTDAYPLITYNDGKQIHQIREFMIQDKERQEIRIQGLLEENLEEKVEDMLSGGGIIGIMVNTVKRAQSIAKLLSQKFGDEVVDVLHSSFIATERVEKEKALIAMIGKGAHRPYQKIIIGTQVIEQSLDIDFDVLISDLAPMDLLLQRMGRLHRHDETKRPDKHKSPVLYIMGMNDTLEFEEGSSFVYGDFLLARTQYYLPKVIRMPEDISVLVQKVYGFTLEEKDGRVLMDNDIQFSDSLSEKYLEFLENYCSKIKMKEKKANDYRIEDPVLEETIAHEENLIAWTKNPDLDNESKSYAQVRDIEDSVEVIALKRIGDGYGTFTEGVDISGSIGDNKTARKVARNTLILPKNLTKIYNIDETIKALENYNRENLSDWRNTMWLKEALGIIFDEKNEFVMDNFKLLYDKKYGVSIERV

SEQ ID NO: 13207 - protein, 767 aa, Porphyromonas gingivalis F0566
MINKESPILAKPSGITLDVHAENVIQEGALLLKGLGCTKEKYFQTTAKQIVQRVELACKYHDIGKRNKIWQDACKKDYKAYLIWKKIHPNKSFEDYTIECREEAGKFLRQTHVRHEFYSIKGLLNNNPPPWLKIAIAAHHRKLSMKHEERWLSSDEDICSVWKDIRRLSNCFFDDRNSVLSDIVIKQYEFAGPRSLLQLADHRASAKEESKDIPDPIAFSYTFPEKWEKRPVQKLVEKHWRDELLLVRAPTGAGKTDAALLWASLQIKHRKADRLIIAMPTRFTTNALALNVSSTLSSTGLYHSSAWTQNFSSKIDNGEIALEQARYYHNQARLLQTPITVCTIDHLLSSLTLCDEEHQTITFALANACLVIDEADFYDQFTQANILVLLEVLKYWKVPILLMSASLPDNIVQEYRKIGYGIKHILEDTSDIERARFSLIEKRDVSEISQMQDLLQLSLDRGSAIIFANTVDRAQAYYQWFLENGHEEDVILYHSRYTETDKIEKEAQLLLRLGRSAWDNDRANGIAILTQIGEMSVNISADIMISDLCPIDRLTQRCGRLCRFSRKIGDLYIIRPMREGNLFPAPYYQNVGPSQKLEPNDALIKTDELLEKGMYSAANLVQLLNKVYASQTVFSTEASCNADRLREMFKANWLINPIEYLDEEIGSTNFWRARNIMPRCRIYIKRPLQSFRNYSDFRRWETDVAIDIPIYVIKKAMRMSDTVCSQVKVCIGKNDYTLIVINAKCYNNVRGLFFSESVLEEPNIEFL

SEQ ID NO: 13208 - protein, 825 aa, Selenomonas sp. oral taxon 892 str. F0426
MKINNREFRRYVEIYRRSVIEMKQYLAHIRRDGSAEQTVRAHLLRVGELMEGYAAGIGLSATARLIGVLHDLGKCTAEFVAYLDYCRKHPGDYSRKGDVDHSSAGGQLLMKKYGQSGEDECLVVQMAALVIFSHHAGLMNYLSEDGKSDFLRRMEKIDVPNVDLSYYYDTVISESELDLLFEHAVHEFTVLDAKITALDPERGEKYHFYWGMVHKLLLSMLVDADRLDSAEFELDKPLTDEWDTAGVWADFSDKLEQKLIGFSIPPEPKAEKITRLRQKISDDCLESGDEPPGIFRLCVPTGGGKTLASMRFALRHAQKYNKKRIVVVIPYTSIIDQNVKEIRDIFHMDEAILEHHSNVITEDDGEDTESMDFRRILTERWDVPVIFTTQVQFLNTVFAGGNSPLRRLHALEDSIIIFDEIQTLPIRCTYLFNAAMNFLKDFCRVTALLCTATQPPLEQLDIPIEMRDNADLTSDLAEVFEGFRRVQIENICKDGGVSINEIAGEIVYSAEEIGDVLCIVNLTAQARSLYEKVSELAQISERDIHVVHLSTKMCPAHRKKILRTVRAELDVRHEYPEQRIICISTQLIEAGVDVSFPVVYRALAGFSSIAQAAGRCNRHGEMERGTVRLFTLENEDLSRLEDIRQGKKIASDMLYKTSADEILTPQAIEAYFRRFYKGRTARDMRFPMKDCNTIFDLLSANEAGLQEAAENGAHLDLWFTHAFCDAGRAFAVIDSHTEPVLVPYAGGKELIVEFNDMQFDKQRIGKKMNAAQQHMVNLFSYELQKLAKFGGIWRTESGVMALREEYYNEAFGIQTEEQGNAYCMI

SEQ ID NO: 13209 - protein, 710 aa, Porphyromonas gingivalis W4087; identical to SEQ ID NO: 13201

SEQ ID NO: 13210 - protein, 766 aa, Treponema lecithinolyticum ATCC 700332
MSYTEIIAHITEDGKSQTLLEHAKAVAELASGFAAEFNNADWAAAAAMWHDLGKADPSWQNYIRGKGSRTVNHAEAGAQYAYCNMQTRKPLEKTISYLIAGHHAGLPDWYAGSGKSLKSIFDRNDYEEIIKISEIKDICDFKLPSSVPFGLNKPSPDLFEHLHLWVRMLYSCLVDADFLDTERFMTPDTFKLRGKFVDLTELKKRFDVYMNEKTAHTQATRLNEIRVGVLASCRKKARCKPGFFSLNVPTGGGKTLSSMAFALEHALVHNRRRIIVAIPYTSIIEQTAKVYKYGTDVDALIEEYKKQDKYLFGEENVLEHHSNFDFDKKNEADILQRQKLATENWDAPVIVTTNVQLFESLFNAHSAHCRKLHNIVNSIIILDEVQMLPPDYLKSILSVLRRLVEYFGVTIVLCTATQPAFEGTIGSDAARFDGIPRDLITSIIDNPAELTKELKRIKINTDYVREKIPDWKSLADKLCDFEQVLCIVSTRKDCRDLHALMPVGTIHLSALMCPEERSEIISDIKNKLRNGEPVRVIRTQLVECGVDMDFPVVFRALAGMDSIAQAAGRCNREGNIKDLGVVYVFSPPSRIPFGLLRKGADATKSILEKYDYKIELTPELYKEYFKLYFDSVNDFDKADFESAMKKESKHENFQFRTLSDTYHLIDSSYQSSVIIRYTSPKTGKSNTALIDKLIADGPDRTVMRKLGRYSVNLPLKEITQLLQKGRLIQPFDDIAVYVQNQTDRNLYQPGLGLVADSLESFGTYIF

SEQ ID NO: 13211 - protein, 699 aa, Prevotella salivae F0493
MGAIPLAAHLQEVAAAAVVIARNGGLNESLARKGAILHDIGKVSPLFQAQLKYGYVRPPHFIFRHEIASLFFLSLLKEEERPEILEMIIAHHKSTLNDVSHKGLLDLDDNLRDCFKTHICGFQDWRVPALEILEDLGIQGHEISVEEARENYEYAVDYCWSMNDGCSRWKGVLMAADHYASALSEKTETNLEKLFVKPNLTFYNRENDLYPLSLISTVDSRLHTIVTAPTGAGKTDFLLRRCKGRVFYTLPFQASINAMYDRIKSDIGDTGAQIHLLHSTSELKVEDCCLEEQIMQRHIGASVKVLTPHQMSSIVFGIKGYEAMAEDLRGCDVILDEIHTYSGEIQSIVLRIIEILLVLDCRVHIGTATMPTVLYKKVLALLGGPTHVYEVSLPNPILQTFNRHIIHKINNWEDGYGIIDHALKSGNKVLLVCNQVKQSQQLYAILSDLYPNVKKMLIHSRFKRQDRQRLETALKEDFNMSDESCIVVSTQVVEVSLDISFDLMITACAPIDALIQRFGRINRKRTKQTIGHYKDIYVIPPKKEKSDALPYNLDVLRRSYDALPSDCILEEMHVQEMLDKVYPQIEVANIDYSGAIYVNGEWQIKQLCHHGKSALLDTLDIDVAVCIVESNRELYEQGHPNERIKFEIPISYKAIAYKKLDVSQQGHHPYIIPDRAYSEEMGLLIDYVNPEYYQSFEII

SEQ ID NO: 13212 - protein, 656 aa, Treponema socranskii subsp. socranskii VPI DR56BR1116 = ATCC 35536; identical to SEQ ID NO: 13179

SEQ ID NO: 13213 - protein, 716 aa, Oscillibacter sp. KLE 1745
MDTYAYLAHLTEDGRTQTILEHLKGTASLCSAFAAAFDAEAQGQLAGMAHDIGKYSAAFQRRLHGGPKVDHASAGAFECLKAQQLAAAFAISGHHGGLPDGGGRGDAAGTGTFWGRINRASQRNLEDYHAWQSEFSLPHANTPAFAGTRLEGMFFTRMLFSCLVDADYTDTGAFMDNSPYLPASSSSMEELWRRLETYVSGWFPPKGALNMQRCVILEQCISAGAQYGPGLFALTVPTGGGKTVASLSFALAQAKARRMKRIVYVIPYTSIIEQTAQAFREILGDENVLEFHSGVQFDQQEDDASSPEAAPLIRSVETWDVPVIVTTAVQFFESLYACQPSKCRKLHNLAQSVLIFDEAQMLPLPYLRPCVWAIAQLVRHYGASAVLCTATQPALDPIFQEFAPEIPIREICPMAEAHWESFRRVSFQQAGTLSWMDLAACLQQQEQVLCVVNTRRAAREVFHQLSGSGNFHLSTLMYPAHRRRILDEIRRRLRDGLPCRVVSTSLIEAGVDVDFPAVYRELSGLDSILQAAGRCNREGKRPPEDSIVTIFQGEDPPPRLFETSIGAGKIVLDHCQDVSSRAAIHTYFSTLLDLKGAEAQDAHHILPLMESEFFPFRTVAERFHLIESPTTTVYLPLEEGAGLVELLRSGQYSRTLYRRLGQYGVSVYPQHLAALEQAGALEHLEDGSVVLRDIGLYTQTTGLTLEPSGGNALFIG

SEQ ID NO: 13214 - protein, 716 aa, Oscillibacter sp. KLE 1728; identical to SEQ ID NO: 13213

SEQ ID NO: 13215 - protein, 746 aa, Myxococcus sp. (contaminant ex DSM 436)
MKRLLAKTTATPDRPEGEATLLGHTALVLSSARRLLEHRGRASLLAAGLAPTWEPRLRRIALLAAALHDLGKCSEHFQSMLRRKRTEPQLVRHEALSLWLCWPGQPLSSWLLGGMDELDLCLALVSAAAHHRKFQSDAFAPDGTGAGLSLELWVHHEDFARTLKRIAEELQLSAPPVFTAPIVLRATRKEHPRDQLQSWQDDFERVVPVDSPDARLLSVCKALVLAADVAGSALPRSGEKQDWVDRQLTAPHPAEALRTVVERRLGGRLPRPFQDAVARSSAPVTLVRAGCGSGKTVAAYLWAVTRHPGRPLWLTYPTMGTATEGFRDYLHGADVDARLQHSRAEVDFDIFGLRDGADPGRGSRDQDRLDALRSWGVDAMSCTADTVLGLVQSQRQGLYAWPSLCSACVVFDEIHAYDDRLFGCLLRFLEALPGLPVLLMTASLPVARLGALRDLCERVHGRSLAVVDGPEDLETLPRYQRLDVEDPWPLVTQCLRDDGKVLWVSNTVDRCMRAAEAASSRGAHALLYHSRFRYEDRVHRHGAVVAAFAKSGCSVFASTTQVAEMSLDLSADLLVTDLAPIPALIQRLGRLNRRSTPEAPERVRPFVVLPFDGAPYSAPALRDARAWLVRLGMGELCQRDLVSAWEAHGVTEAPQRYSSTWLDGRFDTWPAPVRDGSPSLTVLLEEDARKVLAGEVRAHEVTLPMNLPPESLKWRGWPRPGRLPYPIPPAGTLDYDELRGARWRKP

SEQ ID NO: 13216 - protein, 798 aa, Lactobacillus shenzhenensis LY-73
MKEETMDFLAHFDPRTKREQSVKAHLTAVRDLAYMYGESLNISHITGLAGWLHDAGKYSDAFQRYLRSQMGEGAHARAGTVNHAFAGAQLLRVYTENSLLLGLIANPIMAHHNSSGPFDYMDPTTLRPVYYDKLNSHPKSYDLTDISDRFFTDFSISDFRSYVAQAERELNDCKDLNPNQAFYLRFVASCLVDADHLETAAFMSDIKAAYTGSQDMDQWLNDFYQINEKAVIDQELTDAQNTDPAFRQLNELRHNMSNRAFTLGNSTVGLYSMSIPTGGGKTFASLRFALASAKSNHLHHIIYVVPFTTVIEQNAEAIRDRLGLAENSSKVLEYHSAIADQPGSYLWRYAKETWDAPLIMTTQVAYLDALYGKGSKNLRHMHRLVNSAIIYDEVQSLPLRLTEMNNDAVGWLTNSAHSTVLLCTATQPALSSQYLGSKLALPNEIVSDVKYFEAAFARTEIVDETSDIWDISKLISAVCNALSVNSSVLVVLNTKAAVKAAYTAFKQQDNSGQIGAFILSTNLVAAHRREIISKQIKPAIQAARDGGRKVVVFSTPLIEAGVDLSFAVGFRSLTGLPSIIQTAGRVNRNAEEPKATVYVFRLSGKVENTVMLPEITKGAAITSILIHAGNPLMTQETVKKYFEMVYRERRDLAYPVKSKRLNFTLRSLLQWNGNRRPNDQAIQVYMRTNNTDDSALPLYTAQETVANLFQVIDSATTPIIVHWAGHNDAMINGILNSDTSEEQRCLLLREAQQYTVQLWDDPSRNGDKYQDILIHDTKSDLWILRPEYYDDESGMEID

SEQ ID NO: 13217 - protein, 802 aa, Clostridioides difficile P33; identical to SEQ ID NO: 12087

SEQ ID NO: 13218 - protein, 802 aa, Clostridioides difficile DA00130; identical to SEQ ID NO: 12087

SEQ ID NO: 13219 - protein, 802 aa, Clostridioides difficile P64; identical to SEQ ID NO: 12087

SEQ ID NO: 13220 - protein, 802 aa, Clostridioides difficile F665; identical to SEQ ID NO: 12200

SEQ ID NO: 13221 - protein, 441 aa, Rhodonellum psychrophilum GCM71 = DSM 17998
MQNNLEETTAEFLKNLSIAELNDMQKAVIGKAASSENLMLLAPTGSGKTIAFLIPLVNQLQKDSSGVQALVVVPSRELALQIEQVFKAMKTSYKVSCCYGGHSVKIEQNSLNEAPAVIIGTPGRLADHIFRKSFDPKTVNMVVLDEFDKSLQMGFHDQLTLIFKALNGKQKHLLTSATKLKLWPEFLPFSKPEALNYLKDEVDSKLELKLVHTRSIEKVETLMRLVAEFNDEVCLVFCNHRDAVDRISTLFTDHRFAHGVLHGGMEQIDREKNLIKFRGGAHNVLIATDLASRGLDIPEIKHVVHYQLPPKEDAFIHRNGRTARMHAEGQAYLVLANDEALPEYVEKSVTEITLQEELVLPPPPIFACLYISAGKKDKISKGDIVGLLTKNAGISGEDIGLITILDFASYVSVKRTQVNKVLAKLKNEKLKKIKVKIEEAN

SEQ ID NO: 13222 - protein, 777 aa, Caldanaerobacter subterraneus subsp. yonseiensis KB-1
MKIESYRDIELYAKRFKSDKGNEYQTIYQHTVDLLNNMEKLFKEYKEEIEEGCKRLQIDCEKLKYLLRLAIIYHDLGKANSKFQQKIREKTRAHEVPQVKGLSKEVPHNFLSIAFVDLEDEIEKGNIACEDFENLLFAIAFSHDRDFDINYQYFEKYIYEDVSKYIENQTLKPLLELLPSVPDRYKMVESSNYTYRVINQLRELMLKDSYDLSDKKVVFRILLKGLLHRLDHSSSAGISAEEAKINDFPEKVEVYLKRKGSFTGFKEFQKKAIEFSEKSVVLFAPTGSGKTEFGLNWAFKSKLIYTLPIRVSINAMYERLTKVFGEDKVGILHSDSMIYLLEKYMDLEHENQELEALFDSVDLAKNLSLPIIVATGDQIFTSALKWPGFEKIYSLFLYTKIIIDEPQSYSPESLAIIIKTLEEIINLNGKFCLMSATINPLILKYLGDYAEYIQAYSDEELKKRYSHIISVKELSVLDCVDEIIEYAKQKNVLVICNTVKRSQEVYQAIKENLKSFEEIPVVLLHSRFLDGQKRQKEEIVISNQRKNGIVISTQLVEASLDIDYDILFTELASADSLLQRMGRIYRKRPYNESRPNVIILIKEPSGIGKVYQKEIVERTNVFLKKFDGNRITEYDKKELNEYVYDIDALSTTNFMSKFKKAYELLELGFKADRKVEAQKIFRDVVTISGIPRKIFDKNFKEINEALKKINSRSTKSIEKLKLISSIRKYTVTAPAYFFARGGASCYDKDLGLYILDCEYDDQLGLIPPKELEQSDVW

SEQ ID NO: 13223 - protein, 1140 aa, Amborella trichopoda
MADSLRNVNVRSLDGHTVNVSISHSSTVEDLKTLLKECFSPAKNSHDFHLFCRGTKLNPRSQITDHDIESDNFLVLVPFVKKKRCVDEVSPRIIHGDYVKVPKSHRNQVHNASSSGPNISSNSSSNAIDLDLLGVSPSQQIPHVDKSIKATFTSFAEAAWSDIMQDLSSLPKTLDDENSRSTIDEMNNLKRESDLLFNLFSHMEKNSCTTTCSYVIEVFDNVGLESLCHILYSVNCLSGERSKKCLVLQELCGWTSVEVPNGDLMPCAKKRKQCWCPSWLRKLLKCFTFLNIICSSLRLNYEVVTWSMVKGVLQQVQGFGFEEVGLDDFEHLSILSSKVVVFGGRGNRLNELDITIDVIDSSRRAKAGKQLSIQDLVNSIKKRQKTFERDLSIAINYFKQQKEIRGDGTRLLFSLENLLKSVKEMSYDPQNTIKGNLSTRARSMASGLMKVQSRCLETNPLIPVDMVGHLTRGLGSQGQVVHLEEIHPRTAVHVEIPDNLLPSTKAALERMGISRLYIHQEESIRFSLAGENVVVATSTASGKSLCYNVPVLEELSRNLQLCALYIFPTKALAQDQLRALLEMTGGLDVGFHIGVYDGDTSPGHRKWLRDNARLLITNPDMLHISILPFHGQFQRILSNLRFVIIDEAHAYKGTFGNHTSLILRRLCRICSHVYGSAPSFILCTATAANPREHAMELANLQTLKLVQNDGSPCGPKLFLLWNPPFNYKNLSLKSEAMICPSSPIDGKSEDINVFIKRSSPILETSYLFAEMVQHGLRCIAFCKTRKLSELVLSYTREILQETAPHLVDLVCVYRAGYTAQDRRSIESDFFGGKLQGVAATNALELGIDVGHIDATLHLGFPGSVASLWQQAGRSGRRERASLSIYIAFEGPLDQYFMKFPQKLFGRPIEHIQVDVHNKQVLEQQVVCAAAEHPVSLEYDEQFFGSGLHNAIVTIQNKGYLACDPSSNFADKLWSYIGHEKNPPQGVSIRAVETEKYRVINQKTNETIEEIEESRAFFQVYEGAVYLLQGKTYLVKDLDLATKTALCQEADLKYYTKTRDYTEIHVVGGDLAYPAKASAVQFHNTTAQVNICKVTTRWFGFYKIWRGSNRVFDAVDLSLPDFSYESQVCKQYNVFKSCIFI

SEQ ID NO: 13224 - protein, 748 aa, Chitinivibrio alkaliphilus ACht1
MLLAHVRQDESGEWEIHELGEHLAGVAEIAEQCAAPFGLRKVAYLAGITHDFGKASEAFQNKIASQSGYDPEAHVTLHVDHSTAGAQYLVEKYGKDIGTVLAYLIVGHHGGLPNGHDSTNSDLRHRLTKSLEPYRENLPHMVLPKNLNISDFTPIKNKRGKLQLPFLIRMLYSCLVDADFLDTERFMAPEKNKERQVRRASVTELQHQLNQYIRSTFKADSSINAKRMQILEWCRDAAKRDSGLFSLTVPTGGGKTVSSMAFALDHAVKHNLRRVIYVIPYTSIITQNAEVFRTVFGDENVLEHHNNLEPEKETALNRLSSQNWDAPIVVTTNVQFFESFYSNRSSACRKLHNVADSVIIFDEAQMFPPEYLRPSITVIRELVESYGCSAVLCTATQPTLSDTRLLKNDALQNVREIMPEPQKLYNDFKRVQLSYLEELLNVDDLARRLAQQEQVLAIVNTRKDARNIMESLADTNVEKNECFHLSTMMCPEHRKDILQTVRNRLDDGLPCRVVSTQLIEAGVDVDFPVVYRAVAGIDSIAQAAGRCNRNGKLKQGEVFVFNGETPPPPGHLRHAAESGKRILKRYTDDILSIESVSTYFQNFYNKQNSGNKLDKKEIMALLSAAPDKIQFKDMAEKFRIIEEATQSIIVPYGTDGAEVIQELRDWSEKVKYCSKDAAFLPREMQKRAQRFSVQLRKRMFENLAKDGVLEDLFDDGQYWILTNNDIYTENVGLCPDIPEFMNTDSLMF

SEQ ID NO: 13225 - protein, 1122 aa, Vibrio cholerae HC-36A1; identical to SEQ ID NO: 12513

SEQ ID NO: 13226 - protein, 947 aa, Corynebacterium sp. KPL1995
MDTTSFLPKSTIDFANNMESWVTNKSHQAKSLWAKSGDESGYLNLPQHLVDSACTAAAVFDIWVSDSIKQNLGHHLGISVAQLRALYTFLAGVHDIGKACKTFQTQLDQLPDYAHLAANVSDSGLDTTKSTLELGRQKMPHGIVSGVILQSWLSQHDAKPKLAIWLSSTVDAHHGIASSSSEQENISRVMDEYPTSWRNVHSELLDSMAESTNFYKIIAALNKTRSFHAGDAQLLTGLVVMADWIASNAEAFPMQVTGSQTERITNGMAATDLTGPWTTELPLQNIDHFFTKSFGWPDTFTARPVQKSMVEIALNIKQPSLFILEGETGVGKTEGAQAAAHVLGHAQQSQGIYFAAPTMATANGLLERTINWAQQTTEASSVASLYLAHSKNQLSRPYQELRFREIGEDRLNPNNSHKTSGDVVASSWMSGRRRGLLANIVVGTVDQVLMLALQQRYSMLRHTALAGKIIIFDEVHAYDAYTSDYLETTLEWLAFYGASVIMMSATLPPQRRQALIQAYTGASSALAPKAYPLITVANETETQYVTPEPTPTNLTAQVHIIGDELTALTTLLQDLLVDGGCALIICNTIARAQETLAAVEETFPGETELHHAGFTARDRTAKEDMLRAQLGPDANRSTTRPFRKIVVATQVAEQSLDIDADVLLTDIAPIDLLIQRLGRVHRHQRPASDRPDQLCNPAMYIRGVHALTPIPEIDSGAMTIYDPKIILATLLHLPDTFRRPDDIEPLVRAVYEGEQNIPAAWHEVWQTAEEESCARIERAHARSKTYRTCSPFAAKSLERLFERKHQDVINNNEETGAAQVRDAEPAVEVIPIIGTDYGYTPWGKKTEILKSSELNYSDAHYLATSTVRLPTRMTRYDRDFDEVITTLERNTPENWSQHFLLKGQLALQLNAEGSCQLGRFQVCYSNRLGIECLSDTSNIRVTASNYV

SEQ ID NO: 13227 - protein, 926 aa, Corynebacterium sp. KPL1855
MKLPAKTVDFCTRADGWAGQRSQQARSLWAKSGDGVDHLNLPQHMVDSACAASLVYNSWLSRSVKEFLKAELRVSETDIEVLYVFLAGSHDVGKGVKTFQRLLLDRSDVAHLVHAVSDAGLDIELSASEANMSKLPHGIASGEILAIWLVEQGLTLPKANSLAAVVNAHHGAASGPNKAVRELIQDYPSAWRIVHGELLDAMAQLCGGNELAQVLAKLPKVSPAAAQLLTGLVVMADWIASNEKAFSLRVEGTQLDRVARAAELIDLTSPWEPETRLHQDIDEQFRQSFGWPAEFKARQVQQEMVKAAKETDEPVLIVLEAETGVGKTEAALAAAEVLAARSGAQGIYFAAPTMATANGLLQRTIEWSRNVTTGSVRSMYLAHSKNALAKPYTDLKFTGINRYEEEGGNVVASQWMSGRRLGILSNFVVGTVDQVLMMALQQRFSMLRHVGLAGKVVIFDEVHSFDVYSSDYLRSAIEWLGFYGASIIVMSATLPADKRRALVSAYSDGQWPEEEPTGYPLITVATEDEIRSLEVPASPTDLEATISFLAEGEDSLHELLGEWLVDGGCVLIICNTIARAQAAYSELAESYGDCVELHHAGFVAWERVEKEDSLRRQLGPDAHRGAGRPKQKIVVATQVAEQSLDIDADALITDIAPMDLLIQRIGRLHRHARPFSDRPENLREPQVVIRGLETSSPVPEFESGAEAIYGRAILLSTYAVLPNKIRRPDDIAPLVAAAYDRNFKPPEAWNESWEEAIATRDFEESTAHSASSTFRLPDPWSTNGLDALFARLQDDSADDAEIKGAAQVRDAEPSVEVIPIIETDYGYRPWGWDEEVIEAADIPYKLAFHLASSTVRLPVRMTRYDSDFDAVVNDLEGATPAEWGSHYLLRGQLALPLDEGEETQVGRFVLRYTSQLGIEIMSDGRE

SEQ ID NO: 13228 - protein, 926 aa, Corynebacterium sp. KPL1814; identical to SEQ ID NO: 13227

SEQ ID NO: 13229 - protein, 947 aa, Corynebacterium sp. KPL1989; identical to SEQ ID NO: 13226

SEQ ID NO: 13230 - protein, 926 aa, Corynebacterium sp. KPL1859; identical to SEQ ID NO: 13227

SEQ ID NO: 13231 - protein, 893 aa, Lyngbya aestuarii BL J
MNINQQFHSLTNFSPRQFQQETISKIINSENVILRAPTGSGKTETAIAPFLFSKAFNLDFPNKLIYVVPLRTLANSLRLRVENLVHNWSKQYPDTRPLIVTLQTGENPEDPRFEGDIIFCTIDQVLSSFLNIPFSVGRGSANVNAGSIFASYLVFDELHLLDADRAFTTAIKVLKEVQGISQFLLMTATLTDELATKIKQEIKATKTEIVRVGDEDLAQIENNRCRTFQAISEPLTADVICDDIQKHNRKRVIVICNTVSQAQGLFKYLEDLNINNQFKITLLHSRFLASDRTSKERQLQDIFSQNCEDDGYCHILISTQVIEAGMNITCEVMHSQLCPMNSLLQRVGRCARFAGEQGEVYIYKTIQTQLDEDELDAEAIENSTQRKKRKYPPYPDELCEQTWEILINHTNSEQQDKNINFRIEEDWINQIHTVENIQQAERRQNQKDEFERNWEAAIFRGDKSVASELIRFIDSRSVFLWKEQPIILGEDDEENTVDVSQLDAFSIPIGTLCKVFKETQEEAYRLWGCAFHRIEPPQKGKEETYSQDSHSPIGSICILRTSARILLNSKYAYYDRNIGLVMGKDLERFELESSDSELNQSQKKRQVLKSEYQYKMDTYVGHLGCMWTCWRKPFKTEILKNGILTEVEFSSVRNELFKPGGKFIQSRIFPNASTEQSQALFEILVFLAILTHDLGKLQQKWQDVMQGWQTLAYQQFKGKNPKQFLIAHTDYDPTIPEQKAALKTYEKSQRKRPNHAIESAYLSKEILKQSLIPILKDCFEADREQMKNICWVILMATGRHHSAWTSGWKADDIVRKKRIELHPQAKNAIAESWCQLGRFLPNTLPLNPTNLSQTCYDLHELKLDIFSSDETEYQQLYTLVVRALRLCDQRSVQ

SEQ ID NO: 13232 - protein, 845 aa, Fusobacterium nucleatum CTI-5
MTKFEDIFDFQDKYKYLAHIKNNREETLQEHTELANKYLKKIIEYKNLKPFFERIKNILNLKNQEEELYYKMIDDVVNFHDFGKINSQFQIDKMLNEEILKMEDKYNISGVLGSDHSLLSASMFIAYYFGKITDLIEIVETKKIVILFEILFALSYVISKHHGNLDSFEEYIEKLSRNNDENILKELKNISVSNGGILLQAFLEKETITIFFNFIETYISERKKKENISSHEAMSIFVFTKMMFSLLVASDYYSTNEFMQEIKYENFGNMGNIDTIKKEYENSEIIKSIRDKEKNGIPNDEDINNFRTKIFLEAEKNLEKNKENNIFFLEAPTGSGKSNTALNLSLKLLDKDRKKIFYVYPFNTLVEQNMNTLKNIFENNEEVIKNIAVVNSVTALTNKDSRDIPIEEYSDILMDRQFLNYPFIVTTHVGIFNSLVGNTKEDCMPFYQLANSVIVFDEIQAYKNTIWTEIIKILNSYAKLLNIKIIIMSATLPNLSYLLDEEEKNNISKLIENRDEYFNNTIFKNRVKVNYDLLSEQKIEYEELLQHIIENSLNSQKILIEFISKNDAKKFYELCENNEDLNVDYEILILTGEDNKARRNSIIKKINSKDKKIILISTQLIEAGVDIDVDVGYKNISGLDNEEQFLGRINRSCKKSGKAYFFYLTDAKKVYKNSVIIENKLNLFSDEMKDVLENKNFDVFYSKVLEILKRKAKEKINNDNFETIIFNKKFRLLKKRMQLIEEQDDKKTYFFNRTLTDEEIEEIGENIDGSEVWERYVDILKEENYAKKIVELSKIREKMMYFLYEVKKNTELNYSDIKGSIIYIDDGDKYFTDGIYTGGEGDMFI

SEQ ID NO: 13233 - protein, 845 aa, Fusobacterium nucleatum CTI-3
MTKFEDIFSFQDKYKYLAHIKDNRKETLQEHTELANKYFKKIIEYKNLKPFFERIKNILNLENQEEELYYKMIDDVVNFHDFGKVNSQFQIDKMLNEEIFKMEDKYNISGVLGSDHSLLSASMFIAYYFGKITDLIEIVETKKIVILFEILFALSYVISKHHGNLDSFEEYIEKLSRNNDENILKELKNISVSNGGILLQAFLEKETITIFFNFIETYISERKKKENISSHEAMSIFVFTKMMFSLLVASDYYSTNEFMQEIKYEDFGNMGNIDTIKKEYENSEIIKSIRDKEKNGIPNDEDINNFRIKIFLEAEKNLEKNKENNIFFLEAPTGSGKSNTALNLSLKLLDKGRRKIFYVYPFNTLVEQNMNTLKNIFGNNKEAIKNITVVNSITALTNKDSRDIPIEEYSDILMDRQFLNYPFIVTTHVGIFNTLIGNTKEDCMPFYQLTNSVIVFDEIQAYKNTIWTEIIKILNSYAKLLNIKIIIMSATLPNLSYLLDEEEKNNISKLIENRDEYFNNTIFKNRVEVNYDLLSEQKIEYEELLQHIIKNSLNSQKILIEFISKNDAKKFYELCENNEDLNIKYEILLLTGEDNKARRNSIIKKINSKDKRVILISTQLIEAGVDIDVDVGYKNISGLDNEEQFLGRINRSCKKSGKAYFFYLTDPKKVYKNSVIIENKLNLFSDEMRDVLENKNFDIFYSKVLEILKRKAKEKINNDNFETIIFNKKFKLLKERMKLIEEQDDKKTYFFNRTLTDEEIEEIGENIDGSEVWERYVDILKEENYAKKIVELSKIREKMMYFLYEVKKNTELNYSDIKGSIIYIDDGDKYFTDGVYTGGEGDMFI

SEQ ID NO: 13234 - protein, 845 aa, Fusobacterium nucleatum CTI-1
MTKFEDIFSFQDKYKYLAHIKDNRKETLQEHTELANKYFEKIVEYKNLKPFFERIKNILNLKNQEEELYYKMIDDVVNFHDFGKVNSQFQIDKMLNEEILKMEDKYNISGVLGSDHSLLSASMFIAYYFGKITDLIEMVETKKIVILLEILFALSYTISKHHGNLDSFEEYIEKLSRNNDENILKELKNISVSNGGILLRAFLEKENITIFFNFIETYISERKKKENISSQEAMSIFVFTKMMFSLLVASDYYSTNEFMQEIKYEDFGNMGNIDTIKKEYENSEIIKSIRDKEKNGIANDEDINNFRTKIFLEAEKNLEKNKEDNIFFLEAPTGSGKSNTALNLSLKLLDKDRRKIFYVYPFNTLVEQNMNTLKNIFGNNKEVIKNIAVVNSVTALTNKDSRDIPIEEYSDILMDRQFLNYPFIVTTHVGIFNSLVGNTKEDCMPFYQLANSVIVFDEIQAYKNTIWTEIIKILNSYAKLLNIKIIIMSATLPNLSYLLDEEEKNNISKLIKNRDEYFNNTIFKNRVEVNYDLLSEQKIEYEELLQHIIENSLNSQKILIEFISKNDAKKFYEFCENNEDLNVNYEILILTGEDNKARRNSIIKKINSKDKRVILISTQLIEAGVDIDVDVGYKNISGLDNEEQFLGRINRSCKKSGKAYFFYLTDAKKVYKNSVIIENKLNLFSDEMRDVLENKNFDVFYSKVLEILKRKAKEKINNDNFEIIIFNKKFRLLKERMQLIEEQDDKKTYFFNRTLTDEEIEEIGENIDGSEVWERYVEILKEENYAKKIVELSKIREKMMYFLYEVKKNTELNYSDIKGSIIYIDDGDKYFTDGIYTGGEGDMFI

SEQ ID NO: 13235 - protein, 915 aa, Peptoniphilus sp. BV3AC2
MLAKKFWAKKSDRDGTLKWLSVIDHLQDTAGIIGRLWELWLDDSQKKMITENLISEEDGKKLATFIAYVHDIGKVTANFVTKKSFTNSEDLDSEVLIKLERCGFKGIHNLELANANKSHHSIAGQVILEKFGVKRDVSSIVGSHHGKSVNSLEDIELQLSSYSANYYGEENCSSDNLFKKAQEELFNWALKKSGYSSVEDIPEISVPVQMLLTGLLIMADWIASNEYYFPLIPIDDESACNPQGRIIDGFNKWRMSDTWIAEDVYEASKIYEKRFGFNTPRYEQQVLFDVIEQIDEPGIIIFEAPMGMGKTEASLIAAEQLACKLGKSGLFFGLPTQATSDGIFPRINDKWLKSISKDMGEKLPIRLKHGKSSLNDIYRHLSRNIYEDDFTPGTFVNEWFSGNKTSALDDFVVGTVDNFLMMSLKQKHLFLRHLGFSKKVVIIDEVHSYDSFMASYLYQSIKWAATYNIPIIILSATLPSERRKELVKNYLIGKRVKNIEIKKQLSNLNTDSYPLITYTDGEEVRIFDEFKTKHSKTIEIIREDSENLLNLVEDLSKEGGVIGIVVNTVKKSQEIAKDLISKFGEENVELLHSSFIATDRIKKEKNLMKIIGGKIEDRPKFKIIIGTQVIEQSLDIDFDVMISDLAPMDLLIQRMGRLHRHKNIRPEIFKEPKFYVLGTSDVLDFEKESIAVYDGYNLTRTQYFLPDKINIPEDISPLVQKVYGESEIELKEELLPIYKDYKYKFEAYTKNKKQRAETFKLREPYERSRFTDVNNLIGMFTTSKDFSGKSEEQIYAQVRDIKETVEVIALKKLDEGYGVFGDELDLSKDLENIETLREISKHTLRIPSGLTFSSTQVDRLILNLENYNNKYLRNWQDKSFLKGCLGIIFDEEGEFLLDGVRLKYDEKLGLMYERM

SEQ ID NO: 13236 - protein, 744 aa, Pseudomonas aeruginosa BL10
MDAEASDTHFFAHSTLKADRSDWQPLVEHLQAVARLAGEKAAFFGGGELAALAGLLHDLGKYTDEFQRRIAGDAIRVDHSTRGAILAVERYGALGQLLAYGIAGHHAGLANGREAGERTALVDRLKGVGLPRLLEGWCVEIVLPERLQPPPLKARLERGFFQLAFLGRMLFSCLVDADYLDTEAFYHRVEGRRSLREQARPTLAELRAALDRHLTEFKGDTPVNRVRGEILAGVRGKASELPGLFSLTVPTGGGKTLASLAFALDHALAHGLRRVIYVIPFTSIVEQNAAVFRRALGALGEEAVLEHHSAFVDDRRQSLEAKKKLNLAMENWDAPIVVTTAVQFFESLFADRPAQCRKLHNIAGSVVILDEAQTLPLKLLRPCVAALDELALNYRCSPVLCTATQPALQSPDFIGGLQDVRELAPEPQRLFRELVRVRIRTLGPLEDAALTEQIARREQVLCIVNNRRQARALYESLAELPGARHLTTLMCAKHRSSVLAEVRQMLKKGEPCRLVATSLIEAGVDVDFPVVLRAEAGLDSIAQAAGRCNREGKRPLAESEVLVFAAANSDWAPPEELKQFAQAAREVMRLHPDDCLSMAAIERYFRILYWQKGAEELDAGNLLGLIERGRLDGLPYETLATKFRMIDSLQLPVIIPFDDEARAALRELEFADGCAAIARRLQPYLVQMPRKGYQALREAGAIQAAAGTRYGEQFMALVNPDLYHHQFGLHWDNPAFVSSERLCW

SEQ ID NO: 13237 - protein, 744 aa, Pseudomonas aeruginosa BL07
MDAEASDTHFFAHSTLKADRSDWQPLVEHLQAVARLAGEKAAFFGGGELAALAGLLHDLGKYTDEFQRRIAGDAIRVDHTTRGAMLAVERYGALGQLLAYGIAGHHTGLANGREAGERTALVDRLKGIGLPRLLEAWCVEIVLPERLQPPPLKTRPERGFFQLAFLGRMLFSCLVDADYLDTEAFYHRVEGRRSLREQARPSLAELRAALDRHLTEFKGDTPVNRLRGEILAGVRGKANELPGLFSLTVPTGGGKTLASLAFALDHALAHGLRRVIYVIPFTSIVEQNAAVFRRALGALGEEAVLEHHSAFVDDHRQSLEAKKKLNLAMENWDAPIVVTTAVQFFESLFADRPAQCRKLHNIAGSVVILDEAQTLPLKLLRPCVAALDELALNYRCSPVLCTATQPALQSPDFIGGLQDVRELAPEPQRLYRELERVRVRALGPLEDAALTEQIAKREQVLCIVNNRRHARALYESLAGLPGARHLTTLMCAKHRSNVLAEVRQMLKTGESCRLVATSLIEAGVDVDFPVVLRAEAGLDSIAQAAGRCNREGKRPLAESEVLVFAAANSDWAPPEELKQFAQAAREVMRLHPDDCLSMAAIERYFRLLYWQKGAEELDAGNLLGLIERGRLDGLPYETLATKFRMIDSLQLPVIVPFDDEARAALRELEFAEGCAAIARRLQPYLVQMPRKGYQALLDAGAIQAAAGARYGEQFMTLVNPDLYHHQFGLHWDNPAFVSSERLCW

SEQ ID NO: 13238 - protein, 744 aa, Pseudomonas aeruginosa BWHPSA015; identical to SEQ ID NO: 13236

SEQ ID NO: 13239 - protein, 748 aa, Salmonella enterica subsp. enterica serovar Cerro str. 818
MLISTGHHGIPPDTMKNRSSLAFTDEDIVAATHYLEALSELFPFTLPQEWKTKAGRKCLKQHSWFFAGLVTLADWMGSDESQFPLLSSAMPLKDYWPLACEKAQQAILRMPPLSQHSHYQDHRALFPFIQTLTPLQQRASELDISAPGAQLVVLEDVTGAGKTEAALILTHRLMSANKGHGLYVGLPTMATANAMYQRLASAYHALFTDESRPSLILAHGGREMSDSFRQSIWQPTENIAEDYARDDGNATTECHTWFADSRKKALLAEVGVGTLDQLLMAVMPFRHQSLRLLGMRDKILLLDEVHAYDGYMVKLLEGLLRFHAAQGGSAIILSATLPAALREKLLNAFSDGAGFMSAGGSDNAGYPWLSHLTSSGLLEQPLATRPEVQRIVAVNWIQQRQEALDIIYRVVATGQCICWIRNTVDDALDTYQQLLHEGIVPEQDLLLFHSRFAFIDRIAIENKTLNWFGNNAPVSERRGKVLIATQVVEQSLDLDFDWMITDLAPIDLLIQRAGRLQRHIRDAHGQRKSTLPDERQPPVLHILAPHWQEQAEEGWLGQELKGTGFVYTDHACLWRTQALLRQHGEIRMPDNARALVDGVYEQKIAAPAGLQTISDVAFGKVLSQRSVAAQNLLRYDLGYDREASDFLWDKDREFSTRLGEESVDVYLARKDIDGQLRPLVDEIDFCWEKSRLSVRKSWWQKNSGTFQCPDEETLACFRKRHHRPSGQVVLVSDAGEASYYSKHFGLVG

SEQ ID NO: 13240 - protein, 623 aa, Candidatus Halobonum tyrrellensis G22
MELDPRTEQMNERREKARQEVHARAKEFVDDDRNVATLTLPTGMGKTLTGLDAALTVLEESDMESSPNVGRLVYALPYTSIIDQVAEQSHELFGTGERGERLTVDHHLADTLVSPPDEPESVADDAVENVAALLGESWRSGMVVTTFVQLFESLAGPTNARSMKLPSLYGSVVVLDEPQALPLEWWPLVDRLVELLTEEYGASVIAMTATQPELLSAGDREPFSLVSDPDPYYDELDRLDFVLHPSAVAMLPGQNETGGETNDDAESAALPYDRAGELVAARADDGDSVLAICNTIDSARELVESLDDRTVSLDVNEVYDELLDDADESTESISPEQTRAEAVRRQRPGQPLLVHLTTRHRPCDRRHLIDVASDLAESGEAVLFVATQLVEAGVDVSFDEVIRDFAPMDSLVQAAGRCNRSYDRNRGRVTVWQLAPPPNRETTPASAVYGRGESLTKLTGQALATIYDGEPMPEPDVTRSAVKHYFDLLEGRGVGADEYVEFLERAEAEQLGRLSLIDERPAVDVIVTRTAEERETVEQIRQAFREYRWEELDDLVESTADWQVSIPVYPGDDDTMEKLAACEPLFPDTDRLVLDGRPGRHDGYFDATDGVVIPDTSVEARLL

SEQ ID NO: 13241 - protein, 875 aa, Asticcacaulis sp. AC402
MDYIKDFWGKARPTETSKTDWHPLAYHSLDVAAAMQALLQLRPQILNAISRSCGLGRDETLRQLVLVAALHDIGKFAENFQCKVPDLAARLGHQSAPDGAQAWATDDHGRVGYCLWTEHYARSVSKGFDLWLHAAFSHHGTPVEDGVKLSNVMSATSRQAVEDFIKAVMVLLGPASSQAHDKTARTSETWRVAGLVTLADWIGSNVENDWFPYEDTAFTLESYWPRACAKAKNALGETRLAEAMAATAFDLSTYLGPEAQATPLQAWAQAQAPSAGPNLYIIEDLTGAGKTEAALILANRLMQGGAAEGLYWALPSMATANGLYERVRQGYRRLFADGPEASLVLAHSARDLNMGFQASLGSGHVHPGLKGANELPAEAHCAAFVAEDRKKTFLAQIGVGTVDQALLAVLPVRHQALRLAALSRRVLVIDEAHSFDPYMNKGLEALIGFHTALGGSTIILSATLTQKLKGRFIKAFGAPQPPSLSQAFPLVTHINSEKVLIEQPVDVARGTRRDLSICRFDNPDSAMADLLSKASEGACAVYVRNTVADAMTAFHQLRAAAPEGVTVHLFHARFTLGDRISRENRVLDLLGKQSTPDTRRGQIIIATQVVEQSLDLDADYMATDLCPIDLLIQRAGRLHRHDRPGRSEPQLWLVGPQANDDATETWYSALFPKGQYVYPNVGQLWRTMRVITRAGGLMLQSGSPRDLIEPVFGDDLDIPPTLEAQSQKAESQGQADSAVARLNFLDPTQGFERGRGAWDSDTRTPTRLGEPTLTLRLAKWADGVLAPWATAETPHLRWRLSEITIRGGLCAETLAPDAVCEQAIATAQARWPQRYDPPPILAMTAREDSVWHGRIRDQKGRERVATYSTLGGLTL

SEQ ID NO: 13242 - protein, 656 aa, Escherichia coli CE418
MDIKGYWQKTLIQAQNALTVFPLKAKVAPFNGINTLFPFIENPTPLQQKVLDLDISQQGPQLFILEDVTGAGKTEAALILAHRLIAAGKAQGLFFGLPTMATANAMYDRLVKTWLAFYSPESRPSLVLAHSARTLMDRFNESLWSGDLVGSEEPDEQTFSQGCAAWFADSNKKALLAEIGVGTLDQAMMAVMPFKHNNLRLLGLSNKILLADEIHACDAYMSCILEGLIERQARGGNSVILLSATLSQQQRDKLVAAFARGTEGQQEAPFLEKDDYPWLTHVTKSDVNSHRVATRKDVERSVSVGWLHSEQECIARIESAVSQGKCIAWIRNSVDDAIKVHRQLLARGVISASSLSLFHSRFAFSDRQRIETETLARFGKYCSLQRASQVIVCTQVIEQSVDIDLDEMISDLAPVDLLIQRAGRLQRHIRDINGQLKRDGKDERSPPELLILAPVWDDSPGDEWFGSAMRNSAFVYPDHGRIWLTQRVLREQGAIQMPHAARLLIESVYGEDVVMPEGFARSEQEQVGKYYCDRAMAKKFVLNFRPGYAANINDYLPEKLSTRLAEESVSLWLATCIDGVVKPYATGAHAWEMSVVRVRRSWWKKHRDEFSLLEGEAFRLWCIEQRQDPEMANVILVNDDESCGYSATEGLIGKVG

SEQ ID NO: 13243 - protein, 733 aa, Vagococcus lutrae LBD1
MKHYLAKSDGETIVEHTCQLIANLNELHALYPAINVNWELLRLACLHHDLGKINPKFQVKVHENKRTIEGELPHGLLSTGTIPNKKLRARGYSEAEVKILNYAVALHHERDISDITTEDYHRALEEMKEVAADFPYAALGMESCTIKPVSKRYFKINTTLKPSTIENYHDYVMLKGLLNRLDYAASAHIPVENPNDFLEDALAQLHYEWNDLQQYMTRHQEQNVVVVAQTGLGKTEAGLLWLGKAKGFFTLPLRTAINAIYQRVTEQIVTTSHDNRVGLLHSDTYQQYLLFEEKNEQMMDIDEYETKTRQLSLPLTICTLDQLFDIAFRYPGYEQKLATLSYSKVIIDEIQMYSADLLAYLIYGLKLITDYGGQFAILTATLSPYILDLLVREGLSFEMPSAPFLDETLLHRHEVEVVSEEISIERIVAHCNKNKLLVICNTVRKAREIYDELSDIINSEELYLFHSHFIKKDRTAKEQAILKFGQVDNTRSGIWVTTQVVEASLDVDFDILFTELSDLNSLFQRMGRCYRKRAWQTDVGTNVYVYTGGKKRCSGVGFVVDKDIHQLSKEALNSVKGRLDERMKVALINQTYTLEKVEKTRFYHDVTNNLAYLKLLIEGQKDKKDVQKQFRNIHSYKVMPKPVYEANRPHAEKLIATLKRRHHKELSATEKKKLTKEKRQARLMLEQYQVDIPAYLFQKGEWIGIEITPYETLLLFECEYDAEKGLYLIIDDT

SEQ ID NO: 13244 - protein, 950 aa, Frankia sp. CcI6
MDDEFFGMIWGKSAEKAGGSMHLLLGHLLDTAAVGELVWDRFLASTIRDRLDDCSDGRGRSLFALLCGLHDVGKATPAFQMKDEGLAQRVRAAGLGWRGVTPQQGRQWHHARAGAVIVRKYLPQVGWSRPGCDWVWPLVAGHHGLIPDRGRLVHKPAVHGAGPWLDVQRAFVDRVAGDLNVDLASFSELRTPSRGGQLALSGMIIMADWVASDKEHFGGLSDLAEISMKGSRERAQRAWAQLGLRGGWRSDRPAPGNQSDLVHHRFGKPARPAQRAAVQAVREMPGPGLLILEAPMGEGKTEAALAAAEVLAGKVGADGVFVGMPTQATSDPMFSRVRGWLTAVDPEVPIGLLHGRARFNKEWAALRSQVRFVDVHDDLDEYGMADDFGTGTSGPGRRDAPLAGAAAAAEWFFGSKRGLLAAVTVGTVDHLLQAATRTKHVMLRHAGLAGRVVILDEVHAYDVYMAQFLFEALRWLADTGVPVIVLSATLPPVLRAQLAGAYLQGALQRPDVDLADLPRPTGYPSTTAVYMADGKPRFSVTSQSPWRESVPVAVEILAEPTDFAPVSIAAAVSAEVSEGGCALVVCNTVQRAQVVYAELRTTFGDDVVLLHSRFTAAERASRTEDVVDKLGPPGRENAQDRPARLVVVATQVAEQSFDVDVDILVTDLAPIDLLLQRVGRLHRHDRPTGQRPARLRDPKVIVSGLRLPDGAVPLWPAGSRAVYGDHLLLRSAALVAEAATGGGWSIPADVPGLVALGYGDEPLGPARWADAAAEARQEWEAKERRRRVNATGFLLSGEDGLGLTTLEGLHDKATAPLETEERLTAVVRDSDESVEVVLVRRGPAGYLTLAGRSLGHIGEVAVSDDAVLEEVVGATIRLPANKEITAAAHAELTPLAGWDGDSWLRRTRALILDDRMSAILGGRHLTYDNKLGLSLAPRPAADTRPAAGKG

SEQ ID NO: 13245 - protein, 794 aa, Methanolobus tindarius DSM 2278
MVRELSSYELLSHPEKTLYIHLKNVADISRITINSKNLNFENLDVNILADISYIIGACHDFGKATHYFQDYIRERDEQRKLTLKNNPLTQHGLISAVFAYYVLKQYLKEKNEELFFIPLFGYLAVKRHHGNLDNPIFELVALDDDKIEYLKKQAEAIDPKQITEIYQSLLTDIDTNDFLKQIESLSLEIKKSKRQLIRHLKNESSTYSYILFQLLYSILLNSDKTDAASLNMPTRPNLSPLLVDEYRKFKKWDKTEEGINNIRNLIYSDVTDEIKNINLDHRIYSLNVPTGTGKTLTSFSLSLKLREKIESELNYSPKIIYSLPFLSIIDQNYSVFEDVFKTIYEDEPDTSTLLKHHHLSDIQYTFQDDEFKEDKALLLIEGWNSEIVVTTFIQFFHSLISNRNRSLRKFHNIANSIVILDEVQSIPHKYWLLFKELIITLSKHLNTYFIFVTATQPLIYNENEREIVELAKNKNDYFSKFDRISLQYLPEPMSLDDFKEKVRLDIETMENNDFLIVLNTINASKKVYEHLTFSKKESVDYFYLSTHITPKERLERIKQIKNTEKRRVIVSTQLIEAGVDIDVDVVYRDMSTLDSINQVAGRCNRNFDIKKKGEVKVFILKDERKEYYKYIYSTFLIDKTKETLDGTGIIKEKEFLELNNEYFKKIKETQSEDEAKKILDALHNMRFDYIKENFHLIENDYEKADVFIEIDDNAHDIWQQFKALREIKNSLERKNKFLNFKKQFYEYVISVPKAKVPSLVDSNTEISYVSLEILSEWYNKETGFIAKEEGALIF

SEQ ID NO: 13246 - protein, 746 aa, Youngiibacter fragilis 232.1
MEKDMIAHVRKNSGDTWAEPHALSDHINGTAKMAAQFASAFDSDEWGYVLGLAHDAGKSRPSWQGYLRTKSGYDEFAHIEGKSRKILHAIYGAILVEEIYGKEIGRILSYCIAGHHAGLPDWSSSETGNASLKDQKNKIESTNDIDSKLVDMLVQSKPKSIPRRFSQGLDISFWIRMLYSCLVDADFLDTENYMDGGKSILRGGYLSIDELLEKLNHHMKKFEEDSSRTKVNLLRNEVRQKCRVAALKNQGIFSLSVPTGGGKTLSSLTFALEHAKKHGLERVIYVIPYTSIIEQNANVFRSVLGDDQIIEHHSSIDEENETPKSRISAENWDGPVIVTTSVQFFESLFSAKSSRCRKLHNIANSVVILDEAQLVPAEFLKPILSVMQLLVDHYKVSFVISTATQPAFSYKNEPNFKFQGLKGITEIIGSTEEVRTLYDSLKRNNIIFPQDFDVPISWNDLSMDLIKHEKVLCIVSDRKSCRELYKLMPENTFHLSALMCGMHRSSVISEIKQKLLSNEPVRVISTQLVEAGVDMDFPVVYRALSGLDSIVQAAGRCNREGKSESGGNVFVFIPERPAPPGYLRKAMETAVGILKSAPIKEIDNSIIERYFSDLYWKVNSLDKAEIEALLDPVKNDRSELSIYYRTASNRFKLIDDRTQKQIFVRYKDGNELIDRIKKDGPDRMILRKLQRYVVNVSTNEFLRLRGIGAIEEVYPNIFALSTELYYSEEYGLISDENDIDISKFIN

SEQ ID NO: 13247 - protein, 748 aa, Salmonella enterica subsp. enterica serovar Cerro str. 5569; identical to SEQ ID NO: 13239

SEQ ID NO: 13248 - protein, 732 aa, Xanthomonas hortorum pv. carotae str. M081
MSQSSAFSLLSPGIQRYLWAEQWEALRDVQEMAIPLILPADQDVIVAASTASGKTEAAFLPALTYLEQQTPAGLIVYISPLKALINDQFGRLERLCEDLDIPVWPWHGDISSTSKQRFFKKPHGVVLITPESLEAMLCNRGTSVAGIFKHLAYFVIDELHAFIGSERGKQLQSLLHRIDTVVGRKVPRIGLSATLGDMQAAARFLRPAGTAAIVDAPSDAPELLLIIKGFEEPVPQKGEGDDKKEKQELAPLAVAEHLFKTLRGSNNLVFPNSRREVERYTHLLNELCEKGGVSREFWPHHGSLSKEIRYDTEAALKQKDQPATAVCTNTLELGIDIGAVKSVAQIGTPPTVASLRQRMGRSGRRKGEAAILRGYVIEDAIDSQADLRTRLRLDTFQTLAVVMLLTEKWYEPPVVKGAHLSTFIQQLLSAIAQYGGLTAPQAFQLLCAPSAPFNQVSRDAFVELLRHLGQHDILIQDGSGLLLHGSVGDRIVNHYSFYAAFTVDEEFRIVAAGKPLGTLPISQMLTTGQRILFGGRTWLVEQIDEGQKTIYVSATKSGAPPLFSGGGGRVHTKVRQTMRAIYKGTLTPTFVDACAQRFIDEGRTSYQQHSLDDQFFLDRGSDILLLTWLGDAANDAIACLLNARNFKAQGSRLGVEITRGPNALENIETALKAIAAAPTPSIEVLLAGAKNLASQKWDSLLSPHLLQVSYASSNLDLDEAIDWLRKTFLSSN

SEQ ID NO: 13249 - protein, 754 aa, Rhodobacter capsulatus DE442
MTHYAHSGTQADRSDWQTLLDHLRMVALLAQDRGAAFGLGAAAELAGRLHDLGKYDPAFDRVLCGEPGPVVDHSTAGGRVLLDPASGCPKPVAEALAQTILGHHAGLPDTNSPEDGGCLVARIARPGAALAAQASADMPEDFNAVSDEFRRKLRKDKAGFDFSVATRMVFSCLVDADYRDTEAFYDALEGRSRDRDWPALQSLLPAFRARFDAHMAAFDPGTDLNRLRAEILAQVRAKAALPPGLFTLSVPTGGGKTLASLGFALDHAACHGHRRIIYAIPFTSIIDQTVQVFADLLGAENVLEHHSAIEIETPGPGRREAADTKDRSRDKVRQAMEDWAAPVVVTTNVQLFESLFAARPSRCRKLHNIAGSVIVLDEAQCLPRKVLLPTLAMLDTLCAHYGCTVVLCTATQPAFDSAQLQPGGLALAGRELAPDPGTLAGRLRRARIVQGGAMDDAGLVAALAATPQGFVIVNSRRHALALYRAAEAAGLEGLLHLTTRQYPAHRREIIEQIRARLKAGQPCRLIATSLIEAGVDLDFPCGWRAEAGLDSVIQAAGRVNREGKRPLDASVLTVFSAPDNAPPGDVAQLAGAMQSVARGCDDLLDPAAIRRWFEEVYWRAGPKRLDAEGLMDRFTFDGSATNFAFRTVAERYRMIDSPMVPVIVARDETAADWVARLSNEWEKSGPLARALQPFTVQIPQRARETLRANDKGDFEAAPLRGDAFFVLSDGGLYRDDFGLWWEQADYLSADQSVI

SEQ ID NO: 13250 - protein, 715 aa, Ruminococcus  lactaris CC59_002D
MRYIAHKDGERVQTVKEHLEGTAERAGNFAEKFGKREWGYCCGMLHDIGKYSKEFQKKIQENTNDKVDHATAGAQVCKELGGYYPILSYCIAGHHAGLPDYGNTAISSSLCGRWKKKICDYQDYKDEVEIPDLDTEPITFKEDRNMDFSLGTFIRMLYSCLVDADFLDTESFMKNGDTGRNSGETMVTLQNRLKNHISEWLKNTDADTINGRRTEILSHCIKEGKQKEGIFRLTVPTGGGKTVASLAFALEHAVKNHKDRIIYVIPYTSIIEQNAQVFREILGEENVLENHYNVDYESSEEFKSMQLASENWDKPVVVTTNVQFFESLFANKSSKCRKIHNIANSVVIFDEAQMLPMDYLKPCIAMLQELVDSYSVSIVLCTATQPALDSFFSKNELIKELCPRMEEQFLFFKRVNYQNLGRIREDDLLEKLKKENNALCIVNTKKAAQMIYKELQGEGIYHLSTSMYPKHRKRVLKRIRERLKNNEKCIVISTSLVEAGVDLDFATVYRQIAGLDSMIQAAGRCNREGKRELSESMVYIFDLEESYSVPNQRQQIDVSKGILQDYTDIADLKAIHDYFTRLYHYRGTSLDKKKIMDEFQKMECNFAEVAKEFKLIEENTKTIFINREPEADELLQELRIKGVTRERMRKAGQYCIQIYDNAKSENSFFNRLNGAGMLRPVSEEMQDFYELVDGEQYSEEYGLDFSLEDGMAFFV

SEQ ID NO: 13251 - protein, 721 aa, Ruminococcus  gnavus CC55_001C; identical to SEQ ID NO: 12322

SEQ ID NO: 13252 - protein, 754 aa, Rhodobacter capsulatus R121; identical to SEQ ID NO: 13249

SEQ ID NO: 13253 - protein, 754 aa, Rhodobacter capsulatus B6
MTHYAHSGTQADRSDWQTLLDHLRMVALLAQDRGAAFGLGAAAELAGRLHDLGKYDPAFDRVLCGEPGPVVDHSTAGGRVLLDPASGCPKPVAEVLAQTILGHHAGLPDTNSPEDGGCLVARIARPGAALAAQASANMPEDFNAVSDEFRRKLRKDKAGFDFSVATRMVFSCLVDADYRDTEAFYDALEGRSRDRDWPALQSLLPGFRARFDAHMAAFDPGTDLNRLRAEILTQVRAKAALPPGLFTLSVPTGGGKTLASLGFALDHAACHGHRRIIYAIPFTSIIDQTVQVFADLLGAGNVLEHHSAIEIETPGPGSREAADTKDRSRDKVRQAMEDWAAPVVVTTNVQLFESLFAARPSRCRKLHNIAGAVIVLDEAQCLPRKVLLPTLAMLDTLCAHYGCTVVLCTATQPAFDSGRLQPGGLALAGRELAPDPGTLAGRLRRARIVQGGAMDDAGLVAALAATPQGFVIVNSRRHALALYRAAEAAGLEGLLHLTTRQYPAHRRAIIEQIRARLKAGQPCRLIATSLIEAGVDLDFPCGWRAEAGLDSVIQAAGRVNREGKRPLDASVLTVFSAPGNAPPGDVAQLAGAMQSVARGCDDLLDPAAIRRWFEEVYWRAGPKRLDAEGLMEKFVFNGSATNFAFRTVAERYRMIDSPMVPVIVARDKTAADWVARLSNEWEKSGPLARALQPFTVQIPQRARETLRANDKGDFVAAPLRGDAFFVLSDGGLYHDDVGLWWEQADYLSADQAVV

SEQ ID NO: 13254 - protein, 754 aa, Rhodobacter capsulatus Y262; identical to SEQ ID NO: 13249

SEQ ID NO: 13255 - protein, 720 aa, Escherichia coli ATCC BAA-2219
MRKYPLSLLKDKNIVTFFDFWGKTRRGEKDGGDDYHLLCWHSLDVAAMGYLMVKRNCFGLADYFRQLGISDKEQAAQFFAWLLCWHDIGKFARSFQQLYLPPELKIQEGARKNYEKISHSTLGYWLWNHYLSECQELLPSSSLSPRKLRRVIEMWMPVTTGHHGRPPDRMDELDNFLPEDKAAARDFLLEIKPLFPLIEIPAFWDDDEGIELIKHLSWYISATVVLADWTGSSTRFFPRVAHPMDIKGYWQKTLIQAQNALTVFPLKAKVAPFNGINTLFPFIENPTPLQQKVLDLDISQQGPQLFILEDVTGAGKTEAALILAHRLIAAGKAQGLFFGLPTMATANAMYDRLVKTWLAFYSPESRPSLVLAHSARTLMDRFNESLWSGDLVGSEEPDEQTFSQGCAAWFADSNKKALLAEIGVGTLDQAMMAVMPFKHNNLRLLGLSNKILLADEIHACDAYMSCILEGLIERQARGGNSVILLSATLSQQQRDKLVAAFARGTEGQQEAPFLEKDDYPWLTHVTKSDVNSHRVATRKDVERSVSVGWLHSEQECIARIESAVSQGKCIAWIRNSVDDAIKVHRQLLARGVIPASSLSLFHSRFAFSDRQRIETETLARFGKYCSLQRASQFIVCTQVIEQSVDIDLDEMISDLAPVDLLIQRAGRLQRHIRDINGQLKRDGKDERSPPELLILASVWDDSPGDEWFGSAMRNSVNRPG

SEQ ID NO: 13256 - protein, 754 aa, Intestinibacter bartlettii DORA_8_9
METLIAKTKPYETLREHTDELRKELEMLKVAYGEKIETLISIDKDEFWRLLDIIVEFHDLGKVFTPFQNKLKNVLNEMLNNPNKYIIEDTPFLNDIGHNYMSPVFMNFKKLNITDRETKRIVIQAIVYHHERDLVVDGELKKRLDKIIDEDLSKKIDLIQNEFKPKYHIKSKKLNSVYLKYAETRIDSNHKNYNLYILLKGLTHRLDHSASGHEEIEVNIDRNIGIYTENYFEAKKYKKKEAQEFALKNRDKNIILVASTGMGKTETALFWIDKDKAFFTLPLRVSINALYDRVSKSDEINYNYAGLLHSTSEDYLKDNGYTDFEKSSNLSRQLSQKLTFSTIDQIFKFPFKYKGYEKEYATLAYSKVVIDEIQAYSPEIAATLIKGIEMIHKIGGKFMIMTATMPTLYLEEMKRRGILDETTVMGEFISDEERHNIKILDESLYDKNNIEKIIEQSKNKKVLIILNTVASSIEMYSKIQEHNENININLLHSMFIQEHRSILEQNIKDFAKSKQNGIWITTQLVEASLDIDFDILHTEISTLDSLFQRLGRCNRAGKKSTDNTNVFIYTKDKNGVGSIYDEEIVDRSIQYLNEFCNAKLNSEKLILNEKDKMDMISELYNRKNLKESEFLSKFDKTLKLLDGIEASELKNKEAQKMLREIESYTVIPRTIYDSVRDTLIEDFYQLNNALSKAYNEKNYDVIDRLKVEKRDLKNKILKKTVTIPQYKANKGGIITEIIIGNELIRGLEDIYILE

SEQ ID NO: 13257 - protein, 697 aa, Microbispora sp. ATCC PTA-5024
MTSPTLALHPTIAYHLTNTLGWARLRPLQQEALGPIGEGQDALLIAPTAGGKTEAATFPLLSMMEEQTWTGLSVLYVCPLKALLNNLVPRLQAYAGWLGRRVELWHGDVSGSRRQAILRDPPDILLTTPESLEAMLISTGVDHRRLLADLQAIVVDEVHAFARDDRGWHLLAVLERLTRLTGRPLQRIGLSATVGNPDELLSWLQGSGAGSRPAGVIAPETGADPGAADVELDHVGSVANAARVIAALHQGEKRLVFCDSRRMVEELGQLLRDHGVTTFLSHSSLSAEERRRAEEAFAQSRDCVIVSTSTLELGIDVGDLDRVIQINAPWSVASFLQRLGRTGRRSGVRRNCLVLALTPEDLLASAGLLLLWSTGYVEPLQPPPAPRHIVAQQLLALTLQEGRIGDALWPDWWHGLGPFREQHARQVLDHLIAQGFLERDGGALLVGPQAEQRFGRRNFMDLTAVFTAPPEFTVLRGNAEIGRTDPGLLTSAVSGPRLLLLAGRTWVVDWIDWKRRRCFVQPVEGGGGKARWATSMSGGASFALSRAMRDVVLGADPPVKLTRRAVSGLTRIREESRDLVHPGGTVIVRIDGDLLWWTWAGYRANATIKATLGPLADPTQRVDDLYIRLRNDLNGTGWRQDLAGELSQPDIDDRALNGLKFSALLPRELAVETLATRLADFPAAAAVLSEPAHLTLR

SEQ ID NO: 13258 - protein, 787 aa, Thermoanaerobacterium aotearoense SCUT27; identical to SEQ ID NO: 11911

SEQ ID NO: 13259 - protein, 781 aa, Thermoanaerobacterium aotearoense SCUT27; identical to SEQ ID NO: 11912

SEQ ID NO: 13260 - protein, 638 aa, Borrelia duttonii CR2A
MNDFGLPIYKYKDDLIKKLSTNSVLIVESPTGSGKTTQIPRIIYEAGLAKLGKIGVTQPRRIATISIAEYIAKHIGVNLGEEVGYKIRFQEVISPKTKIKLMTDGVLLQELKKDTLLYEYDVIIIDEAHERSLNIDFILGLLKDILNKRNDFKVIISSATINTKIFSKYFNNAPILSIETITYPVQIIYNPPLLNTSKSMILKIKEIIAGIIKEKKEGDILIFLSGEKEIKETIKEIHALNLKKDLIILPLYGRMAKEAQEQIFMPTPKNKRKIIVSTNIAETSITIENIKIVIDSGKVKTNKFQMKTHTYSLQEVPISKSSATQRAGRAGRLSKGTCYRLYKRDEYQLRDEYQKEEIYRTDLSEVILRMADIGIKNFTKFDFISKPSIKSIQTASDILKSLDAINEKNELTEIGKYMIIFPLIPIHSRALVEAMMHYQQAIYPTTIGLSFLSTSGIFLLPQNEEIEARQAHLKYKNPLGDLIGFINIFEDYRKAINKEDFAKENYLDLQGLEEINNVQRQLENIVSSFDIPIVHKNEIDHEGYLKSIMRGMKDYICFKTSKNKYKTIKAQNVVIHPGSLINTDSVKYFVAGEIIETSKRYARAIGVLKKEWLNNIQFEENKKNSSKRKQTTTSFPQK

SEQ ID NO: 13261 - protein, 638 aa, Borrelia duttonii CR2A; identical to SEQ ID NO: 13260

SEQ ID NO: 13262 - protein, 709 aa, Pedobacter sp. V48
MFELLSEPVRKYIRDKRWESLRPIQAAAIEKIMTTSLNLILASRTASGKTEAAFLPILSKVDFAQPSVQVLYISPLIALINDQFTRIEDLCAYLDVSVTKWHGEASQARKKNLVKNPNGVLLITPESLEAMLVNAPYNAKTLFSGLKYVVIDEIHSFIGADRGIQLKSILSRLRYLNTHRFVVVGLSATIGDYTEAKKMTGDPDHTKVLLDRTAKEMEANFKYFKMEAADLPLALMKDLYLNTMANKVLIFPNSRGRAEEIAVKLKKISDKVNGHSNYFSHHSSIDKELREYIEHFAKTNVRFPFAISCTSTLELGIDIGSVDKVVQVDATYSISSLIQRIGRSGRRDGEVSKLLFYATDKWNLLQSLACFDLYKEGFIEPVNVVRQPFDILLHQMLAYVKQLSGCTRAMLWERVRENYAFDQVAEQDFDAILTQLLEKDLLELIGGELIIGVEGEWVVNNKDFYSVFKTEPAYKVLNYDKPIGEIPFSPQLNEDENLLLAARIWKIIEVDHTAKKISVIPAKDGKKPIFSGSGADLHPKIRERMLQLLTESEEIPELDETSIDILREFRSEFRNYRIESLEDDRPALLKEGTIQLYSFHGTRVNKSLHFLFDLIGQESNYLEQTSSFTFTGGKAELLSFIAEAIQILEDIDFHLENIVLTKPSIMEFSKWGHFLPLQLKCRLLNDKYFDFYGARDFLDRVSLVVVEFE

SEQ ID NO: 13263 - protein, 843 aa, Fusobacterium sp. CM22
MTKFEDIFDFQDKYKYLAHIKDNREETLQEHTELANKYFEKIVEYKNLKLFFERIKNILNLKNQEEELYYEMISDVINFHDFGKINSQFQIDKMLNEEILKMEDKYNISGVLASDHSLLSANIFIAYYFKKIIALIETVETKKIVILLEILFALSYTISKHHGNLDSFEEYIEKLSRNNDENILKELKNISMSNGGILLQAFLEKETITIFFNFIETYISERKESISSQEAMAIFTLTKMMFSLLIASDYYSTSEFMQEIKYENFGNIGNIDIIKKEYENSEIIKSIRDKEKNGILNNKDINNFRTKIFLEAEKNLEKNKDSNIFFLEAPTGSGKSNTALNLSLKLLNEDRKKIFYVYPFNTLVEQNMNTLKNIFQNNEEVVKNIAVVNSVTALTNKDSRDIPIEEYSDILMDRQFLNYPFIVTTHVGIFNSLVGNTKEDCMPFYQLANSVIVFDEIQAYKNTIWTEIIKILNSYAKLMNIKIIIMSATLPNLSYLLDEEEKNNISKLIENRDEYFNNAIFKNRVEVNYDLLSEQKIEYEELLEHIVENSLNKQKILIEFISKNDAKKFYELCENNEDLNVNHEILILTGEDNKARRNSIIKKINSKDKRIVLISTQLIEAGVDIDVDIGYKNISGLDNEEQFLGRINRSCKKSGKAYFFYLTDAKKVYKNSVIIENKLNLFSDEMRDVLENKNFDIFYSKVLEILKRKAKEKINNDNFETIIFNKKFRLLKERMKLIEEQDDKKTYFFNRTLTDEEIEEIGENIDGSEVWERYVDILKEENYAKKIVELSKIREKMMYFLYEVKKNVELNYSDIKGSIIYIDDGDKYFTDGIYTGGEGDMFI

SEQ ID NO: 13264 - protein, 845 aa, Fusobacterium sp. CM1
MTKFKDIFSFQDKYKYLAHIKDNRKETLQEHTELANKYFEKIVEYKNLKPFFERIKNILNLKNQEEELYYKMIDDVVNFHDFGKVNSQFQIDKMLNEEILKMEDKYNISGVLGSDHSLLSASMFIAYYFGKITDLIEIVETKKIVILFEILFALSYTISKHHGNLDSFEEYIEKLSRNNDENILKELKNISVSNGGILLQAFLEKETITIFFNFIETYISERKKKENISSQEAMSIFVFTKMMFSLLVASDYYSTNEFMQEMKYEDFGNMGNIDTIKKEYENSEIIKSIRDKEKNGIPNDEDINNFRTKIFLEAEKNLEKNKENNIFFLEAPTGSGKSNTALNLSLKLLNENRRKIFYVYPFNTLVEQNMNTLKNIFGNNEEAIKNITVVNSITALTNKDSMDIPIEEYSDILMDRQFLNYPFIVTTHVGIFNTLIGNTKEDCMPFYQLTNSVIVFDEIQAYKNTIWTEIIKILNSYAKLLNIKIIIMSATLPNLSYLLDEEEKNNISKLIENRDEYFNNTIFKNRVEVNYDLLSEQKIEYEELLQHIIENSLNSQKILIEFISKNDAKKFYELCENNEDLNVDYEILILTGEDNKARRNSIIKKINSKYKKIILISTQLIEAGVDIDVDVGYKNISGLDNEEQFLGRINRSCKKSGKAYFFYLTDAKKVYKNSVIIENKLNLFSDEMKDVLENKNFDVFYSKVLEILKRKVKEKINNDNFETIIFNKKFRLLKERMKLIEEQDDKKTYFFNRTLTDEEIEEIGENIDGSEVWERYVDILKEENYAKKIVELSKIREKMMYFLYEVKKNTELNYSDIKGSIIYIDDGDKYFTDGIYTGGEGDMFI

SEQ ID NO: 13265 - protein, 807 aa, Mogibacterium timidum ATCC 33093
MKFIAHINDDKMQSCEEHSQNAAKYAGECLKNVNLEKTGYLAGLLHDCGKFTDEFSDYIKRSAQGKSVRKGSVIHSFAGVYYLLEKLRSGNGSLTIVDVSAEILAYAIGSHHNMFDIVDIKDKNGFDHRREHQIAYEEKAIDNFNTNCACANKVDELFKSACNELHKICTELREICEKTNKSAEQTKSGNMELMFYIGLLSRLVLSSVVEGDRRDTVEFMNGDNLQAINSFSPQNWKKMLDSLEAYLNSKKTGNEISKARTEFSELCCDAGSKYTNGIYRLNLPTGAGKTLSGMRFALANAVKFNKKRIFYIAPLISILDQNSEEIKSSVGAEFDTEVLVHHSDLVNSREENEDELDTNDLLTETWDAPIVITTLVQFLNTLFDGRLSCVRRFKSLCNSVIIIDEVQTVPKRMLTLFNLSLNFLSEICEATILLCSATQPCLQNLDHAAHIKNEKIIPLDVEQRLKDVFKRTNIVDKGNYKFSEINKLICDLTADNKSLLVICNKKCEAQKLTLDCNEIPEVITFHLSSSMCMAHRVNVIEQMKSALEKGQHILCISTQVIEAGVDMSFESVVRFQAGMDNIVQAAGRCNRNGESTAPKDVYVINCTDENLERLEEIKRSKAATQDLLHSFKVNEQNYCNDLASDNSINFYYERLFSGAYMHKNEMDYYIENLKTSIFKLLSMGFDNGNNKYTLRQAFATAGKEFDVIDSETFSVIVPYGEGRDIITKLCGYGSKSQFDCGYKKRLVNQAKRYSVSLFKYQFERLRGIGAINEIVNSGIYALDANYYDDALGVYENGGGIKCDILML

SEQ ID NO: 13266 - protein, 737 aa, Listeria grandensis FSL F6-0971
MNKYLAKSKPEETIQEHTDNLLANYELLQKYYPEIRVNWHFLNLACMIHDLGKMNLFFQEKVSGGRRNKKEIPHNYLSVAFVPYKKLKEEGYSKEEIQVLFQAIARHHERDINFTEDEWTLEMKKLEQEWQGFTYDKLGEYRAYRSHFPAKYYQVTAHIFEGKTAESFEIFIQYVLLKGLLNRIDFAASADIDVEKPNDFLEAAMTEQMNVFRKQNPDADWKPLQKYMQAHQEENMIVVAETGMGKTEAGLLWLGNNKGFFTLPLRTAINAIYSRLIDSETGIVREQQTDRVGLLHSETYGQYLIHEPEMEAMDIEDYFTKTRQMSLPITVCTLDQLFDFVFRYAGFEPKLATLSYSKVIIDEVQMYSPDLLAYLIVGLSYIQKVGGKFTILTATLPGIIPDLLAEEGVTFTRAEEDFISDRVRHSLKVIHEPISSTFISAFYEDNRILVICNTVRVAKAMYEELVEAHGDAEVHLLHSQFIKRDRTAKEDAILSDGQKGSSRPCIWVATQVVEASLDIDFDILFTELSDLNGLFQRMGRCYRNRELDVATNVYVFDVECSGLRPRGFIDAQIHENSRALLQDVDGAVSEAQKLAMIDRVYSTEALEGSEYYEKVKGDIDYVKSFGTYELDKNEVKKRFRDINSVAAIPKPIFAENEAEIRGYIETIKTKGLDRKTKMRARTMLSAFMLDVPGYIFEKGNSDAIKINDYEKVTIFDCDYDTGLGLTPKDREKEDQFF

SEQ ID NO: 13267 - protein, 738 aa, Listeria cornellensis FSL F6-0969
MNQFLAKSNPRETIQEHTDNLLENFHVLKAKYPRITVDWKLLWLACLIHDLGKMNLVFQQKVSGGGSAFKTNEIPHGYLSVAFVPFERLEDEGYLEYEIRVLFQAIARHHERKFHRSKDAWKEEISKLEIEWDHFEYGTLKNSLEYHTADYIPEIYFHINDQIFEDDDVSFDTFRKYVLLKGLLNRIDFAASAGIGVEKPNDFLELAMTEQLAGFRTKNPDADWKPLQKYMHAHQDENVIVVAETGMGKTEAGLLWLGDHKGFFTLPLRTAINAIYSRLIDSETGIIKEFQTDRVGLLHSETYGQYLTHESHFDMDIDEYYTKTRQMSLPITVCTLDQLFDFVFRYAGFEPKLATLSYSKVIIDEVQMYSPDLLAYLIVGLSYIQKVGGKFTILTATLPGIIPDLLAENGVSFTRAEEDFISNRVRHSVQVVHEAITSDFIQDFYDGNRILVICNTVRVAKTLYEELVAMYGDAEVRLLHSQFIKRDRSVKEEAILLDGHKNSDRPCIWIATQVVEASLDIDFDVLFTELSDLNGLFQRMGRCYRNRALDVATNVYVFDEDCSGVAPRGFIDEQIHDNSKAVLQNCDGPISEAEKLSMIDQVYSTEALEGSKYYDEVKGMIGYVKSFKTYELDKKEVQKRFRNINSVAAIPESIYRENKVQITGYMETIKTGATRKDKMRARTKLSAFMLDVPGYIYEEGSSRKIEINKYEQVIIFDCHYDEGLGLTPKEKEQENPFF

SEQ ID NO: 13268 - protein, 411 aa, Brochothrix thermosphacta DSM 20171 = FSL F6-1036
MPTIHRGESAIGQSQTGTGKTHTYLLPLLDKIDPSLNEVQVIITAPSRELATQIHEEARQIAKLSDPEIHTRLMIGGTDKKRAMGQLKTQPQIVIGTPGRIYDLMREKALETYTTTTLVVDEADLMLDMGFLEDVDNIASRLAEKLQILVFSATIPEKLKPFLKKYMENPRYAHIQPEAIISPTVTNVLVDLKSKSREHLIYDITKTMTPFMALIFCNTKADADTLTEFLLEKELNVAKIHGGVPARDRKRIMKQIRNLDFQYVVATDLAARGIDIEGASHVINYNLPDDPDFFIHRAGRTGRAGQEGISISIYEPEDEEKLVALEKRGVEFEYKNLKKGEWIQMADRNRRKYRKEKRDDVDPRIGGMVKKAKANIKPGYKKKINRAIEKNKERAKRAGTRAGKNSQGKHN

SEQ ID NO: 13269 - protein, 383 aa, Brochothrix campestris FSL F6-1037
MDKIDPSLNEVQVIITAPSRELASQIYEEARQMAKLSDPEIHTRLMIGGTDKKRAMGQLKTQPQIVVGTPGRIYDLMREKALEAYTATTLVVDEADLMLDMGFLEDVDNIASRLAEKLQILVFSATIPEKLKPFLKKYMENPRYAHIQPEAIISPTVTNILVDLKSKSREQLVYDITTTMTPFLALIFCNTKAEADVLTTFLLEKQVNVAKIHGGVPARDRKRIMKQIRNLDYQYVVATDLAARGIDIEGASHVINHNLPDDPDFFIHRAGRTGRAGQEGISISIYEPDDEEKLVALEKRGVEFSYQNLKKGEWIQMADRNRRKFRKEKRDDVDARIGGMVKKAKANIKPGYKKKINRAIEKNKERAKRAGTRAGKNSQGKHN

SEQ ID NO: 13270 - protein, 736 aa, Listeria weihenstephanensis FSL R9-0317
MNHYLAKSKPEETIQEHTDNLLRNYDLLQKYYPEIPVNWHFLKLACLIHDLGKMNLYFQEKVSGGKRNKKEIPHNYLSVAFVPYKKLKEEGYTKEEIQVLFQAIARHHERKIGFTEDEWSLEMKKLEQEWQGFTYDKLGEYRAYRSHFPAKYYQVTAQIFEGKTDQSMEIFIHYVLLKGLLNRIDFAASADIDVEKPNDFLETAMAEQMTAFRAKNPDADWKPLQKYMQAHQDENVIVVAETGMGKTEAGLLWLGNHKGFFTLPLRTAINAIYSRLIDSETGIIKESQTDRVGLLHSETYGQYLTHESDFDMDIEDYYTKTRQMSLPITVCTLDQLFDFVFRYAGFEPKLATLSYSKVIIDEVQMYSPDLLAYLIVGLSYIQKVGGKFTILTATLPGIIPDLLAENDVIFTRAEEDFISDRIRHSIEVVHEPINSKFIQEFYEDNRILIICNTVRVAKELYKELVDMYDAAEVHLLHSQFIKRDRSAKEDAILADGHKDSKRPCIWVATQVVEASLDIDFDILFTELSDLNGLFQRMGRCYRNRKLDVATNVYVFDEECSGVEPRGFIDKQIHENSKMMLQSCHGPVSESEKLTMINQVYSTEALKGSHYYEEVTGMIQYVKSFDTYELDKNEVRKRFRNINSVAAIPKPIHAENKEEIAGHIEIIKTKGIERKAKMKARTMLSAYMLDVPGYIYEKGSAEFIKINDYEKVIIFDCDYDEGIGLTPKDKEKENLFF

SEQ ID NO: 13271 - protein, 372 aa, Brochothrix campestris FSL F6-1037
MNQSNWPKEWQDKWVELGYSEATPIQQQSYEPLMSGKDVVGQAPTGTGKTLAFALGHLERITTEKKSQWLILAPSQELVVQIADVIRPFLLTGQTMTTLGGGANIKRQLEKLKKKPNVLVGTPGRVAELIKQKKLKMHEINYITIDEADVLLTEEHEATTVFICQSANRDRQISLFSATTSDRLDEFFANVESVEQVEVVAGDAKMPDSITHVYIQSNPRDKVKTLYRLAQIEGMKAIVFVNTIGRLNTIYEKLNFDGLKISALHSDLSKIQRQESIRDFKKGETALLLATDVAARGIDLPNLPAIIQFDLPKSLTQYVHRSGRTGRMGEPGAAISIVTDREARELKQMVKENDVEMIEKLVKFAHLVDPKN

SEQ ID NO: 13272 - protein, 700 aa, Listeria riparia FSL S10-1204
MNRYLAKSNPEETIQEHTDNLLTNYKILQENYPDIPVNWYFLKLACLTHDLGKMNVYFQEKVSGGRRNKKEIPHNYLSVAFVPYKKLKEDGYSKEEIQLLFQAVARHHERDIHFTLEEWSSEMQKLEQEWNGFTYEALGKNRAYRNRIPSKYYQVSVRIFEGDNAQSFELFIQYVLLKGLLNRIDFAASAYIDVEKPNNFLESALNNQLETFRKSNPAADWKPLQKYMYAHQQDNIIVVAETGMGKTEAGLLWLGNNKGFFTLPLRTAINAIYDRLASSETGIIREDVTDRVGLLHSETYGQYLQREKDIQDIEEYFTKTRQMSLPITVCTLDQLFDFVFRYAGFEPKLATLSYSKVIIDEVQMYSPDLLAYLIVGLSYIQKVGGQFAILTATLPGIIPDLLAENGVSFTRAEEDFISDRIRHSLEVVHKQINSDFISDFYDGNRILVICNTVRVAKEMYENLEKIYGDEVKLIHSQFIKRDRNAKSDAILADGHKTSEGPCIWVATQVVEASLDIDFDLLFTELSDLNGLFQRMGRCYRNRELDVATNVYVFDEKCSGIGKNSVIDPLIHQNSRKALQEVGGPISEAEKLALIDRVYSTEALAGSDYYETVICNINYVKSFHTYELDKKTVREKFRNINSVTVIPEPVFDENRAEIEGYMAEISKPGKENKRSRMEARTKLSEFMMDAPGYIVKKKRVG

SEQ ID NO: 13273 - protein, 718 aa, Listeria fleischmannii FSL S10-1203
MKKFYAKSNPKETIQEHTDKLIENFILLKHLYSNIRVDWELLYEICVLHDLGKMGNKFQEKLKSKQKMVKGEIPHGWLSIAFIDYKRLKKEGYSVEEIGVIFQAIAYHHDRNYSFEIEELEAEFLELEEPASQFYYDKWKLPIPPAKKLNLRYFSIGEHTFENDYENFKKYVLLKGLLNRIDYAASASIPVEWENQFLERDLAVWKKNKGISEWNALQQFMNAHQNENVVVIAQTGMGKTEAGLLWLGDAKGFFTLPLKTAINSIYERVKDDILTEKVDTQVGLLHSDIFSRYLLDEKEYDIAEYITRTKQLSLPLTICTLDQIFDIVYRYPGFEHKLATLSYSKVILDEVQMYSPDLLAYVIVGLKYIQTFGGKFAILTATLPGIVTHYMKEEKLEFTMPEKPFITDIFRHSVCVKHRELDIQDILEHANRKRVLVICNTVNKAKEIFSALQTAGVNTKLFHSQFIRADRRQKEQEIFQDGQVGSEFEGVWVATQVVEASLDIDFDLLFTELSDINGLFQRMGRCYRKRENPAENNIFVYDGGEKKCNGVGFVVDKEIFQFSKEAIAVLGGKLLESKKMELIDEVYSYERLEGTEYNKLLQNNIDHLKDMGAYEIDKNEAKKRFRNILSVSVIPKSIFEENHRLITLYKNETNKFEKQKLWEKLKDLQVDVSAHLFEKSESKIEPLSKYKKLQILDCFYDNKTGVTRKERGKENKFF

SEQ ID NO: 13274 - protein, 1120 aa, Atopobium sp. ICM42b
MPGIEKSTRWSVLTQDVYLESLFKKELHVTPLVARVLVARGFTDVATAQEFLSPSLQRDWLNPQCIPGMAEVAAHVHKAIVEHKKIAVFGDFDVDGMSSTCLLTLALRRLGADVLPYIPHRFGEGYGLSKEALARVLQDRKPDLIITVDNGIAAAQEVAWLLQQGIDVVVTDHHEPADLVPQGVPVTDPKLVEDCPSRELAGAGVALKLVQVLGQLQDQPQLWLDYIDVAMLGTLSDMMMLNKENRALVSEGVKRLQKGLRPGLVALAAVAGQDIAQISADNLPFSIIPRLNAAGRMGTTDIALDLLLTEDAEEATILAGKLEEINAERRAIEAKLTDEALEQAKEIYDGGHAIVLAKEGWHEGVKGIVASRIVNRYHVPCILFTIQDGVARGSGRSVGSVDLFHAVEQCADLTVRFGGHQGAVGVTVETAKIDAFRKRLSKVMAELPEEEFEASGEVTALVNLDEITINSIDALEALQPFGQGNKKPLFGVKGVVMKNRSRVGAGGAHLCFMASNGISSISSIMFRTPHVEAAAEYDGAVDLIFEAVNETWQGRTKPKLMVRDILYRDFTDEDDGPIEADLLGSAADLPLVVTKETTEADEASQEQAQQKRHELESLSSEDLTQTLVTSMIGSRELLPLQKKTLEVLSQGTSCLSVMATGRGKSLIFQVHAARVALLQHKMSVFVYPLRALINDQVQSIKNTFEPLGISVEVLNGETDLSSREDLFARMTNNELDIVLTTPEFFSLHADQFAKAQNISFVVFDEAHHVGMNASEGRLAYAQMPQVLKMLGSPQVLATTATATTQSAQNICELLSIEAEHVYKDKTARTNLELKDLRGAKDRECALLSLVSDGTKTVVYVNSREQAQALTRMLRHRIPELGHKIAFYHAGLTPQIRKNVERAFRRGDVCCIIATSAFGEGVNISDIRQVILYHLPFGRVAFNQMSGRAGRDGKPSKIQMLFDAHDMRVNERILSSHAPQREALVAVYRALTALQSKLSAQTADSMLTDEDIAQMALEIDPRSKADEQTVRVALDVFAELGFISIEGFDQTRTISVNSQASHMDLLESARYAEGLKAHAEFESFAQWVLSASPEELADAITKPIVPEIGSTFDGGRESSDE

SEQ ID NO: 13275 - protein, 923 aa, Streptococcus thermophilus TH985
MNDNFWAKKTEENSRLLWLPLTQHLEDTKNIAGLLWEHWLSEGQKVLIENSINAKANIENQGKRLAQFLGAVHDIGKATPAFQTQKGYANSVDLDIQLLEKLERAGFSGISSLQLASPKKSHHSIAGQYLLSYYGVDEDIATIIGGHHGRPVDDLDGLNSQKSYPSNYYQDEKKDSLVYQKWKSTQEAFLNWALTETGFNSVSQLPKIKQPAQVILSGLLIMSDWIASNEHFFPLLSLDETDVKSKSQRIETGFKKWKKSNLWQPETFVDLVTLYQERFGFSPRNFQLILSQTIEKTTNPGIVILEAPMGLGKTEAALAVSEQLSSKKGCSGLFFGLPTQATSNGIFKRIEQWTENIKGNNSDHFSIQLVHGKAALNTDFIELPKGNTINMDDSENGSIFVNEWFSGRKTSALDDFVVGTVDQFLMVALKQKHLALRHLGFSKKVIVIDEVHAYDAYMSQYLLEAIRWMGAYGVPVIILSATLPAQQREKLIKSYMAGMGVKWRDIENTDQIKIDAYPLITYNDGPNIHQVKMFEKQEQKNIYIHRLPEEQLFDIVKEGLDNGGVVGIIVNTVRKSQELARNFSDIFGDDMVDLLHSNFIATERIRKEKDLLQEIGKKAMRPPKKIIIGTQVIEQSLDIDFDLLISDLAPMDLLIQRIGRLHRHKIKRPQKHEVARFYVLGTFEEFDFDEGTRLVYGDYLLARTQYFLPDKIRLPDDISPLVQKVYNSDLTITFPKPELHKKYLDAKIEHDDKIKNKETKAKSYRIANPVLKKSRVRTNSLIGWLKNLHPNESEEKAYAQVRDIEDTIEVIALKKISEGYGLFKENQDISQNIADPIIAKKVAQNTLRLPMSLSKAYNIDQTINELERYNNSHLSQWRNSSWLKGALGIIFDKNNEFILNGFKLLYDEKYGVTIERLDKNESV

SEQ ID NO: 13276 - protein, 566 aa, Thermoproteus tenax Kra 1; identical to SEQ ID NO: 14

SEQ ID NO: 13277 - protein, 1583 aa, Mixia osmundae IAM 14324
MVVASRADFYQSASLLHPIIVGGPAIVFVFVYLRLASNKTLAPTTVFSLLVNVALGSTLSRIITQPALDLTRGIISIIVILLFEYASSWLISVTPAFSYIFKSPPLLCVFKGVIQSKAIKANRIAPSGVYQGLRSQGFARLCDVEALVLEGSGSWSVIKRLPDNDPPSDTLLKVPGYAEAFAAYEAALDRPDPQVLEEARRNVALPVGMRETGGKVSQLVAPSAGLVDALIIHWRPGRRMATDDGYVHELAISLSREINLVNPNDLLARRVISLAHTLPSQAEFVKAAQTFGRFNKSDYLHTLYNEIRGRKQMNINIASDDDADVLMPPPARPGGLSLHESSPPSTASRSGLVTGTGLKHAYQPNTPSGQSRLGLERLAAEKRRERDLSALLGTNADASSSASAPSVNKRARVDSDHLRRRLDDTPSHGPGLSDKAKRVLEERRRNRSDQSGPAQQSSHDLVADSKDERKRLGQARQELASFQNRLNRETYPDSRNRQRPATNGDSQSGHHHPRAGQPERIARKSPGRDSTVRQGRHDQPDAPTRGGDTSRRIVRGTVDDTPSSLASTESNMAALNKRSWDSTPLRPGKRNPQEPREWDTPRLTTLSRQRPKGTSSRFSGSDYPEEQIHDRTAGGHEWEEEQMRLDRDWYSFDEAGVTAGDEATNPFASYEEQEADLEKEKASQLSAKGLAKRMSAKQAQYQQDNEAWESNRLMQSGLGGRRKMDLDFDDDEESKVHLLVHDLKPPFLDGRMAYTKQLDPVNPIRDPTSDMAVFSKKGSLLVREIREQRERQKAAAKAAQIAGTTLGNLTGVEEKAEETDVQKVQKILDEKPKNVVKQGHGGPGQMKVEDEASDARNYKKDSQFASHLKTNATGSSAFSRSKTLKEQRQYLPAFACREELLKVVRENQVTIIVGETGSGKTTQLGQFFHEEGYTKFGRVGCTQPRRVAAMSVAKRVSEEMEVELGREVGYAIRFEDCTSEDTVIKFMTDGVLLRESLNEGDLDKYSVIILDEAHERSLSTDVLMGLLRKILARRRDLKLIVTSATMNAEKFSTFYDGAPCYTIPGRTFPVDVLFSKTPCEDYVDSAVKQALQIHLSHGSGDVLIFMTGQEDIEVTCQVISDRLGQVDNAPDLAVLPIYSQMPADLQAKIFEQTNDGRRKCIVATNIAETSLTVDGIMFVIDSGYSKLKVYNPRIGMDALQITPISQANANQRSGRAGRTGSGTCFRLYTETAFRDELLANTIPEIQRTNLANTVLLLKSLGVKNLLEFDFMDPPPQQVLTNAMYQLWVLGALDNVGDLTPLGRKLSNFPMEPSLSKMLVTSVHYKCSSEMLTIVSMLSVPSVFYRPKEQLEESDAAREKFFVPESDHLTLLHCYTQWKNNGFRDEWASKHFLHAKLLRKAREVREQLEDIMRTERLEIIACGTDWDVIRKSICAGYFHQAAKAKGIGEYANCRSGIPMNLHPTSALYGLGYQPEYIVFHELVFTSKQYMQCVTAVDPFWLAELGGIFFSVRQQNFGHREARVADREFSKKSELELAMATERDRAEAERMRRLEASSAASTPRIAEIGARTPLTARRTPRRVGL

SEQ ID NO: 13278 - protein, 786 aa, Candidatus Jettenia caeni
MCLFSDIKSHPDLPLEKHLAQVAEIAIELLEGKHVEFQSLGLTKEHLKALVKRASLFHDLGKATSYFQMRLTTGKKGPNGEHWHTGLSAILAYEPLLTYCKENNLNEIIALSPLLAILYHHSELSKGLPNDPVIEDRLKAFKKEILNLPILGKAGMDVEINSIKPIEVDCGIENLFSDLSLFSNDQKIEFRLLTLFIYSLLLEADKAYLAVKDKELYQRKVIPIDTDIIDAYKAKEFKNKKANINADREKAYNEVMTELESLDLINHLYSLTLPTGMGKTLLAASWAIKLRNKIQNNLGFVPQIIIALPFLSIIDQSAKEYEKFLGNPNEEVFLKTHSLSSFEFNGYEPNTAEFFVNIWKSQIIMTTFDQLLYTFLSFKPKHLMRFHNLLNSIIIMDEIQALPPHLWHPFSTFIKYITNVGKSYLLVMSATQPRFLDNAEELVPTIRKVTKEKGPERYFEKLSRYKLLLNHKDTLALDDFILKMRDKLSKIEEEKIMIVLNTRDSAKKVYEKLKSIAKNRETYFLSSYIIPAERLNRIEKIKNSKGALVISTQCIEAGIDIDMDYVIRDFGPLDSIIQVAGRCNREGEKETKTVKVIRLYDPDIANNFCPTGEFNAIVYDRLSLDATMGILNKFGSTEVMENEVFDLASQYFIELKRKDLGKNKTECLIDFSHNYLRNGKQRSFDIRTELRGKLKQYNIIVEKHAPGLRNEIEQIFKEDMDRWERRRKLKGLSNKIAMNSISVNAYNFNPDDIAEKGKGNFYFLKSAYYDDEIGFNYQPPSGTVIV

SEQ ID NO: 13279 - protein, 797 aa, Candidatus Jettenia caeni
MKLIGKYYKEKKLYQSLYGHAYDSLAFLKDYLHKEFCVIKTFCKRWQIKEDDLIKSLFLTILLHDMGKLTKTFQKNILAGKHTFYMPHPLASLPILIAFQNHFPKLLEDVDPSYLEITAILSHHTQAYSGLYSTTDCKPDFETESVNNFIKAAICIYDKLEFGNYFKREFTEIKINCLNRKSDELKNGVDCLKEINGNKTAIKAIFSFIFSLLKMSDILASINFVEKVKNENVKEGFIFDELYDPNNQIVFSGITNKMGTWHRKSKRSFQENIYNNPKPFTMLFAPCGRGKTDAALYWATELIEKSEANRIIFALPTQVTCNAMFNTLSNNDYFGEKKVGLYHSRSALELSERKKEEHEEVEDHLSFVKDETFKGEVFFYPVTVTTVDHLLYAFIHGYSKADFSLGNIQTSVIIFDEIHYYDDMMLSNLKQLFGILREMRIPHFLMSGTFPEFLQSEINKAKEYHLEEDNEGLGFKPFEIIKKEEKSIITNDVLDKEVGDKLIAGYKKGLKQFIILNTIQSAQLTYIQLKEHFKEVGINKPNMILLHSRFIYSDRRDIEKKILRQAKAEKEIQENNIPFILVATQVIEVSLDISSHRLFTECAPVDAVGQRGGRLNRGGQNAGENRMILFKTSNAKPYDERLLENSWTAIPKGIVSYLDFKKACDDVYNGRCISLSDFDVFFKECTLFGRSPKEIRWNEDEGKGFKTRKKDYQTIDVYPIHFFYSYGDELFKMNNEVIKVPAWWYWYDKKEKKDLFCEHVFDDKTYLLCKLPYNNEVGLSTLNTAYVNIEQNYPQIL

SEQ ID NO: 13280 - protein, 825 aa, Paenibacillus popilliae ATCC 14706
MRSIAHIRVSDGKVQTVEQHLLEVKTLAEAYGKKLNIPHVTGLAGMLHDMGKYTREFSGYILAAVSGVADRPRRGDVDHSTAGGKLLYERFHSNGKALYQGILAEVVGNAIISHHSYLKDFLSPDLESPYLKRVSIKKIAEFEQSVEAFFTYVMSEQDFQQYVDQAVVEIEQYLARKPAQSMEQQLMFLTKFVFSALIDADRTNTRWFEMGEPDEPDRNTKELFSSYYERLMAQVHSFKKDKHARTPIALLRSEMSELCERFAAKPSSIYTLSIPTGGGKTLASLRYALKHALTFDKKRIIYVVPFTTIIEQNAAAVRNLLQDEANILEHHSNVVEVEDDDDEQDGVAVTSRQKANLAKDNWDTPIIFTTMVQFLNVFYAHGSRNIRRLHNLCEAVIIFDEVQKVPTHCISLFNQALNFLKEHGNSSIVLCTATQPALQFVEQKLEIAEDAEMISHIDQVIDAFKRVELIDKATDRAWNTEQLACFVQDAIQEAGNMLVILNTKSVVKALYERLQAMREQNQFGAGKEIFVYHLSTSMCAAHRFAILEKVRAHLEREERVVCVSTQLIEAGVDVSFDCVIRSLAGLDSIAQAAGRCNRHGKDEVRNVYIIDHAEENLKHLKEIQIGKELTRTMLIDRKRDAAAYGGQLLSRQAMESYFQRFYMRLEADLHYFVSKLRKDMTALLYAGRKEADSYFQAYHQKKKKEQAKDTWLPLFLANSYGTAAQHFHVIDDHTRSVIVPYGEKGKEVIADLNGGGTIDDLTRLLKRAQPFTVNLYEHDLRQLDRSGGLESCLDGKVFVLKEGAYSEHVGVALNSDSGMGFLGCF

SEQ ID NO: 13281 - protein, 961 aa, Gluconobacter thailandicus NBRC 3255
MRHKATSSSFRTRFATHTPSETDPGRANRNKPAKRVTASTALEQWEKTEFPDLASQETIPSDELGREHNGMDLTDLAQFWAKTDTQAAAECPMHPVVAHSLDVAAVAMNLPETMLPQIDNHPIDRRLLGFLASLHDIGKLGATFQFLRPDLWPTALEATPAAIPPGPRHDAAGLQILGQLSTHPVLKILFPDWSLSEKLRVLAGVAGHHGKPLNRAYQRPANLTPLDENTLNAARIFLDVMASLFQPPSFPGDFSEDAMDALAWRLAECLPVADWIGSNRTWFPYATPHTLTDPADYFWNKALPQAQKAIFKAGLGPVRTRPFQSAKDLLPHLENHALSPLQRWAETTSLPDGPALIVIEDMTGSGKTEAALILSHRLIARGHTNGVFLALPTMATANAMFDRVAAAYGKMFHPADRPSLALAHGKARLSERFTQTILSEKSLSSSAGIRKQPGESACMEWLASENRRALLAQVGVGTIDQALMAVLPVRYTTIRRQGLTGKILCIDEAHTFDAYMNEEMKELLTLHASRGGSAILLSATLSHALRTTLVNAFRKGLNLPATTLQDTHYPLTTLVSGTAAPVETPCEPRPGLGRTVTLNRLSDVGEAETRVIELAETGSAIAWIRNTVDEAIASAESLRAKGLKVQLFHARLAMVDRFEIEQDILRKFGKNSSPDQRAGVLVSSQILEQSLDLDFDALITDLAPADLLIQRAGRLWRHHREDRPVDYPQLDILSPSPVSDPDANWIRRVLPGTAAVYRDPSLLWRTARALFARNVLQTPKDVRPIIEEVADTASPGSVPAALEKEMLTTQGKNLSAQGLGRQTVLKTGEPYDPGTGQWDTDLQARTRLETDPTVIVRLALLRDGVIHPYAEDADPSQAWALSEIRVARRRLKSCPPPEGLQTAIETIRASWSRWERDAVEDILVLVLFESVDGGFEGRGLDKDDNALMLQYHKATGLMFPA

SEQ ID NO: 13282 - protein, 827 aa, Anoxybacillus flavithermus NBRC 109594
MYLSHTNPDKQLVVHLWEVYEYSSDMLKHVPLSEENREVLLYINKIVSLTHDFGKYLSYFQTYLKNGETQGDLHHHSFISALFAAHLLCRSSFLVASWSEFAPLLGYFIIMHHHGNLRDIALDVTKSRDIYEDSVQDSLRYRIRILKEQIEDVKKHVSDITRDLRPLWEKLCVPLSLEEELQDFTQDYEKSFDEVYRQYYFIKKKRRGEVTDNLYYYTLLLYSVLINADKLSAANIKRQPRVHIPSDLVDQYRKIHFNTEVIEGTNGWRNRMYNVVMERLQYIANTKPEQRLFTLTAPTGAGKTLLSISAALKWREYAEQHEGYTPKIIYALPFTSVIDQNEKVIHDLLNRLEDFTCNEQRYFVKHHHLSNFQYRTNNEELPVRQALLLTESWEAEFIVTTFVQLFYTLIGYENRALKKFHQIAGGIIILDEIQNVPVEYWPLLRSVLYKIAELFSCKILLLTATQPLIFPKDETIELLESDMIKPINFFKEMERVELHPFRGERGFCSVDEWIEQFQLRFEEGKSYLSIFNTIKTSIDVYERLKGWLKQYGYHVIYLSTNIVPYERRQRIETMKQLLKDKKKVAVISTQVVEAGVDVDFDIVYRDIGPIDAIVQAAGRCNRNGKAREFGKVYIVPIERNGTLESQYVYGSVHTKIAKESLPKETVSEHQFFDIIYRYFESVQNAKSFTVSEGIIRSIEELKFDAKDKRGGKNEPEYVSEFQLIKDANQAVDVFVEVDEQATAIWQEYITRVIEEQNLEMKFENYLRLKKDIRQYVISAPIQLVKNLDRNLYEKTRMIRLSNDILNQYYHCEYGLIRSSEMVDAWTM

SEQ ID NO: 13283 - protein, 712 aa, Porphyromonas crevioricanis JCM 15906
MDDLFAKSGPERATLLAHTEQVALVAEKMANHLSVDINIARNGAILHDIGKAHHVFQDRLEKAPQPSSTSFRHEIASLFFLSAFPKEQWNALIEMVVGHHKSVRRDISGLGLLDLEEECDYVDYHLGRWQEWSERAWKVLLALGIPYRHISVEEAIDNLQYSIDYCEERTRERAVSEWRGLLMGADHFASAVSGAVQTFLPRLFRSPDLSFYNRPHPLYSLSLLDANAPQKHTIVVAPTGAGKTDYLFRRCSGRVFYTLPYQASINAMYQRVANDLERDNQELDIRLLHSTSQVVKRRGRDEETVLQSHIGSAVKILTPHQLSALAFGMKGYEAMLLDLKDCDVILDEVHTYSGISQAIVLKLVQILKRIGCRVHIGTATMPSLLYRKIGEILGDDVLEIKLSSEELDRYDRHIIHKATSFESLFSLIGQAIEKGEKILIVQNRVKKAQEVYEQIREIYPWIPSLLLHSRFKRKDRNEKERALLGLDEEGRSLHQFNTSDEACVVVATQIVEVSLDISFDVMITECAPLDAMIQRFGRINRKRSKERIGQLKDIYVIAPSESKKEAKPYDVDILQKSFEVLEDAQPLRERELQSKIDEVFTSIDFLEIEEHSIFKADGRITIDCLTHNSKAILFKLLDIDSVVCVTESDVYEYEKGDLETRLQLEIPSYFSAVAQRRQLEKGNRPFIVPDEAYSSEMGLDIDMINNNVGVII

SEQ ID NO: 13284 - protein, 712 aa, Porphyromonas crevioricanis JCM 13913; identical to SEQ ID NO: 13283

SEQ ID NO: 13285 - protein, 961 aa, Gluconobacter thailandicus NBRC 3257; identical to SEQ ID NO: 13281

SEQ ID NO: 13286 - protein, 712 aa, Bacteroides pyogenes JCM 6292
MDELFAKSAPEWTTLLAHTKQVVLVVEKIAGYLAMDRSVARNGAILHDIGKAHPVFQNRLRMKRRPDDTVFRHEIASLFFLSAFPKDEWNKLIEMVVSHHKSVKKDVSGLGLLDLEEECDYLQFHLGKWEEWSEKAWLVLGELGIPYRRISVQEATENLQYCIDYCEKRTRERAVSEWKGLLMGADHFASAVIGEAEKFLPRMFVTPDLSFYNRPNDLYSLSLLDASSAKRHTVVVAPTGAGKTDYLFRRCIGRVFYTLPYQASINAMYKRVANDLEKDNPDLDVRVLHSTSKVVKRKNNDEETVIQSHIGSSVKILTPHQLSALAFGMKGYEAMILDLKGCDVILDEVHTYSGISQAIVLKLVEILKKIDCRIHIGTATMPSVLYHKIMEILGDDVLEVKLPDEELNLYDRHIIHKANSFHDLTSVIDKAIQSNQKVLIVQNRVKTAQEVYQYIKEEYPFVPSLLLHSRFKRKDRNEKETDLLGVDAEGNSLGKFNTSGEACIVVSTQIVEVSLDISFDLMITACAPLDAMIQRFGRVNRKRSKDTIGKLKDIYVTAPLDNEKEARPYTPEILKKSFEVLEDGKPLHERELQSKIDEVFTSIDFLEIEEHSVFKTNGNISIDCLTHNSRAILFDLLEIDNVACITESDVFAYENGDLETRLRLEIPTYFSAVSKKRQIDKGNRPFIVPDYAYSSEMGLDVTMINKSLGVII

SEQ ID NO: 13287 - protein, 712 aa, Bacteroides pyogenes DSM 20611 = JCM 6294; identical to SEQ ID NO: 13286

SEQ ID NO: 13288 - protein, 409 aa, Bacteroides reticulotermitis JCM 10512
MNRLLQGDVGSGKTLVALMSMLIALDNGYQACMMAPTEILANQHLETIKELLWGMDIRVELLTGSIKGKKREAILAGLLAGDVDILIGTHAVIEDTVTFSSLGFVVIDEQHRFGVAQRARLWVKNAQPPHMLVMTATPIPRTLAMTLYGDLDVSVIDELPPGRKPIETIHQFDNRRESLYRSVHKQLKEGRQVYIVYPLIKESEKIDLKNLEEGYQHTCEEFPECKVVKVHGKMKAAEKDAQMQLFVSGDAQIMVATTVIEVGVNVPNASVMIIENAERFGLSQLHQLRGRVGRGADQSYCILVTNYKLTDETRKRLEIMVRTNDGFEIAEADLKLRGPGDLEGTQQSGIAFDLKIADITRDGQLLQYVRAIAEKIVEHDPAAQSPENEILWKQLKSLRKTNVNWAAIS

SEQ ID NO: 13289 - protein, 759 aa, Archaeoglobus fulgidus DSM 4304; identical to SEQ ID NO: 11531

SEQ ID NO: 13290 - protein, 546 aa, Archaeoglobus fulgidus DSM 4304; identical to SEQ ID NO: 11530

SEQ ID NO: 13291 - protein, 443 aa, Ureaplasma parvum serovar 3 str. ATCC 700970; identical to SEQ ID NO: 11529

SEQ ID NO: 13292 - protein, 872 aa, Pyrococcus abyssi GE5; identical to SEQ ID NO: 12076

SEQ ID NO: 13293 - protein, 529 aa, Pyrococcus abyssi GE5; identical to SEQ ID NO: 12077

SEQ ID NO: 13294 - protein, 526 aa, Pyrococcus horikoshii OT3; identical to SEQ ID NO: 12033

SEQ ID NO: 13295 - protein, 728 aa, Methanocaldococcus jannaschii DSM 2661; identical to SEQ ID NO: 11532

SEQ ID NO: 13296 - protein, 614 aa, Methanocaldococcus jannaschii DSM 2661; identical to SEQ ID NO: 11533

SEQ ID NO: 13297 - protein, 572 aa, Sulfolobus solfataricus P2; identical to SEQ ID NO: 11535

SEQ ID NO: 13298 - protein, 515 aa, Sulfolobus solfataricus P2; identical to SEQ ID NO: 11536

SEQ ID NO: 13299 - protein, 515 aa, Sulfolobus solfataricus P2; identical to SEQ ID NO: 330

SEQ ID NO: 13300 - protein, 544 aa, Sulfolobus tokodaii str. 7
MDCKDVGENVKGKKLAECNDVNFILNFPTGYGKTTLSITLGEWLTTYTTTNFYRLIHVVPTRALVEDISKRAEGLKYAVQYSFAPSELKSPNFLADFIITTYDSFFLNLYKASIGEPFSDHGHYDLPRFSIYTSLVHFDEFHLMNESNSWTSLIGAVEHLSKLGVNFIMSSATPSKSVEEKIIDHSKNVIKVSVVNEYGNAINGRKCTEVDNGIYECETTKGRKRYKVVEIKEKIDVPNIDVKIVNNIEQFYNIVKDSEKAIIVVNTVDKAILLYDKLKHLKPCLIHSRFKISDRQKRKLDDCKLIVSTQVIEVGVNISSEIMITEQAPLTSIVQRVGRLLRYNEKNEGTLYIWKSNETYPYDENEVIKTVEALSNNDICLKHPYGCHNKKGYAEIIDSIISEPNINQKLLNDLEKISINPFLSKKDLDIILEKYCTLTNSFIVNLAIDKPSRMEDLIPFNGKMIDNAPLIRKDNKIVAYFEKYTPTNVIDKVEVIEDYIEFKDWKDLCIKYRKIFMKGEEKMILLALKADSSYYDSERGLRLK

SEQ ID NO: 13301 - protein, 501 aa, Sulfolobus tokodaii str. 7
MRLMRWEENMLSSAKSITDIYEEFIKDNRLQDRLAIRQTVEELEKGHNVILKAPTGYGKTTLTKVLANAVDLGYFARVIHVLPLRAIVQDLYEKLKSDSEKGVIRTKSIAAQDMDFSDSPFFMQRVTVTTLDTFILNLFKLPAVEMGKVFQNFGAHYELPRGMIYSSLVIFDEFHLLGEEGRPLTAGLSAVKSLTDAGVPVIIMSATIDKGLESLIMKYGKDFVTVEAKDFSIERKITVKKIREEEVLSDVLKEYSEGKRVLVVFNTRVGAINFYKALKDKGLNPVLIHSKFNREDRRVLVQKVLKERLVVSTQVIEAGIDTSFDVLITEAAPASNLIQRAGRVARYGGYGEVHVFPFSGKVYDKEEVQEVWESLDRGLPELKEKEYHVDNILLSDLTTIDHSVFADSITAKNLYTSVCNIVRETSIIMGFPRGEYNSEKAIPLTEKEAMEALRKNGAVKDGKEVTDYKPSTNVCLQLDLLMKGIDGVIIAGYDKEIGGII

SEQ ID NO: 13302 - protein, 609 aa, Pyrobaculum aerophilum str. IM2; identical to SEQ ID NO: 11538

SEQ ID NO: 13303 - protein, 554 aa, Pyrobaculum aerophilum str. IM2; identical to SEQ ID NO: 11539

SEQ ID NO: 13304 - protein, 658 aa, Pyrococcus furiosus DSM 3638; identical to SEQ ID NO: 11540

SEQ ID NO: 13305 - protein, 1327 aa, Schizosaccharomyces pombe
MGSKGKKGKSSEVNLETSKNKEKNIKGKKKNSLDPIEKNKQETAGLQTTSRPTAKQLVGGSSWTGKIPVVLLNEHCQRSKWEKSDVKVRQTKSKNYIFTSVVLAKKDPKNPSILDHVSLIPPKSYYENGYFPEKETLVEARNVGAVYALHRIMSHKSLQHALPPEHRNIWFDMEKQKKEELKNKHSWLYNEDPFKAAKELQAARASSAAKPPPKASQKNEKVSLTSIKNTSLSHFSKFNFKYALPIHMSLENRRSLENLFRNMNTWDILEDTKNLEPDTSIVNDLISLGFRDIHAKEACQYCVSLEDALEWLIIHVPEDDLPTRFLPSDYTTGISVQNLNSANLAIHYNAKRISETGYSFDLCFSTLQTFENNIQISSEYLQQHLIGESFDGNISLEPNSTEWDDDVSALQSILDNKVSKIENGCRVRIDYPTSEFGELFVDFRRPARSYPAHIPLMSLSSTKRMASYIKLSILKKMVVYAMDLRGECMLSWLYNHLQENIEDFLQNIGSLLNISAATIGVSLSSQNKSAPTAKKNNSFKPKLFRRSRELSEKLCNNWSERVKSPSYQLKVREREKLPAWESRRKIMDAIQHSQVVVISGETGSGKSTQVVQFILDHYLSSGEKDLQTVVCTQPRRISAISLAERVAFERDTTVGKEVGYSVHGEKSISKETLLEFCTTGLLLRRIQQHGLGFLSTLSCVVVDEVHERSIENDILLTLLKLVISRIPNLKVILMSATVNSDTFKYYFGNAGHLHIHGRTFPIKDYYIEDFAPKLNEDDDEEDVPRRKKKEYEIDYHLISRLVSSIDAELGSSSGSILVFLPGVSNIARCIREIKSKDGSKFEVLPLHASLNTSEQRRCFKTYTKRKIICATNIAETSITIDDVVAVIDSGRVKQIDYDVERDLVTFKETWASRAACQQRRGRAGRVKKGICYKLYTRGFEEKGMLGQTPPEVLRTALSQVCLNVVPLVKRFSSAGNSVNQGSIKKFMNSLIDPPNDATVDLALKKLIQVGALTVSEDLTGLGEYLVSLPIDLKLGKLLVFGSIFGYLEPALTITAILSTKSPFLGDDEAREIRSKQSQGWGDVLADARVYHNWLEILETRGVKKTVQWCEEMHLHYTTLQQIRQNRNELSEAAQLLELTTKKLTGNFDWYSTENLTVLSTLIAAALSPNVVKCVYPDKKFVASFSGSLEMEQEARLTKFYDQNNQRLFIHPSSTMFVNSPNASRCTFVAYEQKVETTKPFLRNCTPINTYGMILLGANDILIDPLGKGLILDQAYCIKAWPKVVILLKMLKRCLDASLHERLESSSGLNYESEIHQCIRTLIAGNGV

SEQ ID NO: 13306 - protein, 732 aa, Caldanaerobacter subterraneus subsp. tengcongensis MB4; identical to SEQ ID NO: 11541

SEQ ID NO: 13307 - protein, 764 aa, Xanthomonas axonopodis pv. citri str. 306; identical to SEQ ID NO: 11542

SEQ ID NO: 13308 - protein, 668 aa, Chlorobaculum tepidum TLS; identical to SEQ ID NO: 11543

SEQ ID NO: 13309 - protein, 861 aa, Chlorobaculum tepidum TLS; identical to SEQ ID NO: 11544

SEQ ID NO: 13310 - protein, 3374 aa, Montana myotis leukoencephalitis virus; identical to SEQ ID NO: 12078

SEQ ID NO: 13311 - protein, 752 aa, Leptospira interrogans serovar Lai str. 56601; identical to SEQ ID NO: 11545

SEQ ID NO: 13312 - protein, 616 aa, Montana myotis leukoencephalitis virus
SLYLLGLGEGEPESNQRITDGVYRIKVSSLFGKKQVGVGVWSEGSFHTMWHVTRGATLRIGDRKLSPEWANITEDLISYNGGWKLEKKWKGEEVQLHAFTPSNETVVTQLLPGSMKTEKGEELGLIPLDFPPGTSGSPIITSSGHVVGLYGNGIIHGDVYCSSIAQAKEVVKEETVKAVEGDEWLAKGKITVIDAHPGSGKTHKILPSLVRRASERRMRTLVLAPTRVVIKEMENALRGMDVSFHSSAVSSKTPGSLIDVMCHATFVNRKLIHMPQKNYELIIMDEAHWTDPSSIAARGFITTMSENKKCAVVLMTATPPGVQDPWANSNEKIEDVVKVIPEGPWKQGHEWITEFEGRTAWFVPSQNAAQGIAKTLREHGKKVAILTSKTFHDVYPKLKTEKPDFILTTDISEMGANFDVERVIDPRTTLKPIEKGNTVEISGEIQITPASAAQRRGRVGRTPGKMAQYIYQGEVEPDDSELVCWKEGQMLLDNMSVKQSMICTFYGPEQEKMPETPGFFRLSEEKRKVFRHLITQCDFTPWLAWNVASGTKGIEDRDWVNLGPKENLVTDENDDPIVYKSPGGKEHKLAPVWLDTRLTRERKDLAGFIEYAEKRR

SEQ ID NO: 13313 - protein, 776 aa, Clostridium tetani E88; identical to SEQ ID NO: 11546

SEQ ID NO: 13314 - protein, 866 aa, Clostridium tetani E88; identical to SEQ ID NO: 11547

SEQ ID NO: 13315 - protein, 693 aa, Chromobacterium violaceum ATCC 12472; identical to SEQ ID NO: 11548

SEQ ID NO: 13316 - protein, 778 aa, Porphyromonas gingivalis W83; identical to SEQ ID NO: 11549

SEQ ID NO: 13317 - protein, 876 aa, Corynebacterium diphtheriae NCTC 13129; identical to SEQ ID NO: 12079

SEQ ID NO: 13318 - protein, 755 aa, Nanoarchaeum equitans Kin4-M; identical to SEQ ID NO: 11550

SEQ ID NO: 13319 - protein, 577 aa, Chilli veinal mottle virus
SLDTILENFDERDEMIEFEITAPDAKSIAYKSSTFQVWWDNQLALNNVISHYRTEGHFVEFTRDTSAQVASDIANSDMKDFLVRGAVGSGKSTGLPSALCKRGRVLLLEPTRPLAENVHAQLSASPFHLNPTLMMRNKSVFGSTPITVMTSGYALHYLANDAQRLKEFSFILFDECHVLDASAMAFKSLLVDREFEGKILKVSATPPGRETEFSTQYPVQLKTEEHLSFQQFVDAQGTGVNADVTSIADNILVYVSSYNEVDQLSKLLTDKKFKVTKVDGRTMKSGATEIKTVGSKHRKHFIVATNIIENGVTIDIEAVVDFGLKVSAVVDADLRMVRILKVHSIMEKNSALGRVGRTKPGCALRIGHTNKGVEAIPTMIANEAAFLCLIYGLPVMTAQVSTSLISNCTVQQARTMALFELPFYFTQDYVSADGSLHPAIHALLRIQLRESEILLNNFQYHTQQSASGCQCASTTNAPKQLDMDPDVKLSFYVKEVPEELYEKLWHCVQENKGDAGFKKLRTHNAAKIAHKLRTDDMAIQRTILLIDQLIANEMQKKEHFDSLVNANTSSLSFTLQS

SEQ ID NO: 13320 - protein, 1327 aa, Schizosaccharomyces pombe 972h-; identical to SEQ ID NO: 13305

SEQ ID NO: 13321 - protein, 746 aa, Myxococcus xanthus DK 1622; identical to SEQ ID NO: 11576

SEQ ID NO: 13322 - protein, 728 aa, Methanocaldococcus jannaschii DSM 2661; identical to SEQ ID NO: 11532

SEQ ID NO: 13323 - protein, 614 aa, Methanocaldococcus jannaschii DSM 2661; identical to SEQ ID NO: 11533

SEQ ID NO: 13324 - protein, 593 aa, Debaryomyces hansenii CBS767; identical to SEQ ID NO: 12082

SEQ ID NO: 13325 - protein, 926 aa, Streptococcus sp. oral taxon 058; identical to SEQ ID NO: 12564

SEQ ID NO: 13326 - protein, 926 aa, Streptococcus oralis; identical to SEQ ID NO: 12617

SEQ ID NO: 13327 - protein, 926 aa, Streptococcus oralis; identical to SEQ ID NO: 12462

SEQ ID NO: 13328 - protein, 926 aa, Streptococcus; identical to SEQ ID NO: 12671

SEQ ID NO: 13329 - protein, 716 aa, Salmonella enterica; identical to SEQ ID NO: 12934

SEQ ID NO: 13330 - protein, 730 aa, Escherichia coli; identical to SEQ ID NO: 12685

SEQ ID NO: 13331 - protein, 731 aa, Bacillus toyonensis; identical to SEQ ID NO: 12658

SEQ ID NO: 13332 - protein, 696 aa, Bacillus; identical to SEQ ID NO: 11934

SEQ ID NO: 13333 - protein, 374 aa, Bacillus cereus; identical to SEQ ID NO: 12370

SEQ ID NO: 13334 - protein, 752 aa, Leptospira interrogans
MILLAKSYPEIEKQLKSGDPESWALLEHHSSATYQVAEVLLKILEPILRKWTRLSESEYNKFVLVVCLSAGLHDLGKANEDFQKMLQRRKYLQRFRHEIWSVLALTGSGPFSDWFRKTIGDETWVRIGQMGILSHHLKATRETLYADHETAEIKVFWKDQGVIKTFQSICRLAGISSPDFSSPSISSYTCLGEDADKSIRIWTREILNARIDPRYQHSIGAVRAMIIAADRLASAYKGADALKLWATEALNRVLSEQECSNIVKQGLGEKNLRPFQKQVGDSTSRVTLVRAGCGNGKTIAAFQWAKTHSAGRKLFFCYPTMGTATEGFRDYVSDIPGLDALLSHSRASLDLGELASTGEEDEGDSLNMHSRMLQEWTAQVTFCTVDQILGLLQNYRSSLTLSPAIFLGAFVFDEIHMYDSILFGNLLTFLKEFSHTSILLMTASLPETMLSAIQETVGADLGPVISGEAQIEERLRYRILHSSREDALQKAIQEFKNGGRVLWVCNKVEHCLKLYDELSEKYDIEALVYHSRFKYEDRKERHRAVIDSFQEGYKKSLPVFAITTQVCEVSLDISATLLISELCPFAALIQRLGRVNRPGQEMEGIAQALIIPFQGKPYEKENENDGESELERCKEILKPLLDRELSQKDLALALENAKGTEHQKIPSQWLSLGWEAKPDSIRESGYTLDVILESDAYKVLKNERPWEKSKLYTIPMPIQKQFSYGEPPLRIPVVPDSQIQYSSVRGGEWNLN

SEQ ID NO: 13335 - protein, 750 aa, Leptospira interrogans; identical to SEQ ID NO: 12712

SEQ ID NO: 13336 - protein, 752 aa, Leptospira interrogans; identical to SEQ ID NO: 12739

SEQ ID NO: 13337 - protein, 752 aa, Leptospira interrogans; identical to SEQ ID NO: 12735

SEQ ID NO: 13338 - protein, 762 aa, Leptospira interrogans; identical to SEQ ID NO: 12809

SEQ ID NO: 13339 - protein, 750 aa, Leptospira interrogans; identical to SEQ ID NO: 12744

SEQ ID NO: 13340 - protein, 752 aa, Leptospira interrogans; identical to SEQ ID NO: 12702

SEQ ID NO: 13341 - protein, 752 aa, Leptospira interrogans; identical to SEQ ID NO: 12811

SEQ ID NO: 13342 - protein, 750 aa, Leptospira interrogans; identical to SEQ ID NO: 12827

SEQ ID NO: 13343 - protein, 752 aa, Leptospira interrogans; identical to SEQ ID NO: 12649

SEQ ID NO: 13344 - protein, 752 aa, Leptospira interrogans; identical to SEQ ID NO: 12832

SEQ ID NO: 13345 - protein, 752 aa, Leptospira interrogans; identical to SEQ ID NO: 12859

SEQ ID NO: 13346 - protein, 747 aa, Leptospira interrogans; identical to SEQ ID NO: 12740

SEQ ID NO: 13347 - protein, 752 aa, Leptospira interrogans; identical to SEQ ID NO: 11545

SEQ ID NO: 13348 - protein, 751 aa, Leptospira interrogans
MILLAKSYPGIEKQLKSGDPESWALLEHHSSATYQVAEVLLKILEPILRKWTRLSESEYNKFVLVVCLSAGLHDLGKANEDFQKMLQRRKYLQRFRHEIWSVLALTGSGPFSDWFRKTIGDETWVRIGQMGILSHLKATRETLYADHETAEIKVFWKDQGVIKMFQSICRLAGISSPDFSSPSISSYTCLGEDADKSIRIWTREILNARIDPRYQHSIGAVRAMIIAADRLASAYKGADALKLWATEALNRVLSEQECSKIVKQGLGEKNLRPFQKQVGDSTSRVTLVRAGCGNGKTIAAFQWAKTHSAGRKLFFCYPTMGTATEGFRDYVSDIPGLDALLSHSRASLDLGELASTGEEDEGDSLNMHSRMLQEWTAQVTFCTVDQILGLLQNYRSSLTLSPAIFLGAFVFDEIHMYDSILFGNLLTFLKEFSHTSILLMTASLPETMLSAIQETVGADLGPVISGEAQIEERLRYRILHSSREDALQKAIQEFKNGGRVLWVCNKVEHCLKLYDELSEKYDIEALVYHSRFKYEDRKERHRAVIDSFQEGYKKSLPVFAITTQVCEVSLDISATLLISELCPFAALIQRLGRVNRPGQEMEGIAQVLIIPFQGKPYEKENEDDGESELERCKEILKPLLDRELSQKDLALALENAKGTEHQKIPSQWLSLGWEAKPDSIRESGYTLDVILESDAYKVLKNERPWEKSKLYTIPMPIQKQFSYGEPPLRIPVVPDSQIQYSSVRGGEWNLN

SEQ ID NO: 13349 - protein, 752 aa, Leptospira interrogans; identical to SEQ ID NO: 12699

SEQ ID NO: 13350 - protein, 750 aa, Leptospira interrogans; identical to SEQ ID NO: 11551

SEQ ID NO: 13351 - protein, 752 aa, Leptospira interrogans; identical to SEQ ID NO: 12651

SEQ ID NO: 13352 - protein, 916 aa, Acinetobacter baumannii
MIVTFISQCEKKAIPRTRRVLDAFADRIGDNTWQTVITEDGLLAVKKLLRKTVTKNTAVSCHWIRGRRRSELMWIVGNRNKFNEQGIVPVNSTKKSLAQNKWENDWHYLPLIKALVAVSALLHDWGKATVLFQQKLLSKNDQFKGDPLRHEWISCMLLNALVQSSGNTKSDEAWLKLLMNQTWDEELLKQTIIKNSDQSKVLDQLPPFAQLAAWLIVSHHRLPNLKTEKEYKKYGSEDISCIKDLFEFIEADWGYQNKFEEKEYQQRLQLCFEFEQGLLTQSVEWTKQVKKWSARLLQESQVSEQIFVDGCWRVILHHARLCLMLGDHYYSSCEADKTWKTSLSLVANTDPKTKQAKQYLDEHLVRVSDNAMRVAQSLSRLADEMESAYDIQKLKKKSPQGFEWQDQAVKGIQQFIQKNEGSEKQGWFIVNMASTGKGKTIANAKIMQALSQDGQSLRYVLALGLRTLTLQTGDSYRHDIGLGNDELAILIGSKAVQDLHHQNIKNNQTDELSIEEIGSESLEELLDNELDYDAMPQAEFMNALFPKNQEQRNKAFLYKPVLTCTIDHLMAATETKRGGKYILPSLRLSSSDLVIDEVDDFNGQDLIAIARLIHLAGMLGRKVMISSATIPPALAEGFFNAYQQGWSLYCAFKKLKNIDTVAMWVDEFKTKTQTINSGKSEDLVQQYKKAHDQFIELRADALSKQIVKHKAYIVDCSDLVTEKEVRRLDQSLQSQYFERIKQNAEQLHFKHHTIDTQTGKKVSFGVVRVANIPPCVALTQYLLNAEWSQGISPRVMAYHSRQVLLLRSEQERHLDRVLKRKEKLGEQTAAFLDDVIRQHLDSTDDEHVIFILVATPVEEVGRDHDFDWAIVEPSSYRSIIQLAGRVLRHRKLDQDIQNPNIALMQYNLKGLRKAKV

SEQ ID NO: 13353 - protein, 574 aa, Salmonella enterica; identical to SEQ ID NO: 12554

SEQ ID NO: 13354 - protein, 745 aa, Leptospira interrogans; identical to SEQ ID NO: 12647

SEQ ID NO: 13355 - protein, 745 aa, Leptospira interrogans; identical to SEQ ID NO: 12860

SEQ ID NO: 13356 - protein, 745 aa, Leptospira interrogans; identical to SEQ ID NO: 12711

SEQ ID NO: 13357 - protein, 745 aa, Leptospira interrogans; identical to SEQ ID NO: 12648

SEQ ID NO: 13358 - protein, 745 aa, Leptospira interrogans; identical to SEQ ID NO: 12885

SEQ ID NO: 13359 - protein, 745 aa, Leptospira interrogans; identical to SEQ ID NO: 12889

SEQ ID NO: 13360 - protein, 754 aa, Leptospira interrogans; identical to SEQ ID NO: 12950

SEQ ID NO: 13361 - protein, 742 aa, Leptospira interrogans
MKRNKQSIFIGHILRKDDGNFVEHLLDDHLYSVAELTEKFCEKFGAGTFGYLIGLWHDLGKFKLEFQERIRIRSGHIGEKAHLEGKTAKSVKHSASGAIHCFNKFKQSDIIKKLICLPMLCHHSGLKNFGIDVDIQLNEEREILALSETTPHIPQEILDGIDLKQLGKSFKDHSLLIRMLFSALIDADRLDTERFMDPAKFKERYSKTIILQDLNIKLDKHLKNIQKQADTTKVNSIRKRILKEVQSKTNLKPGFYTLTVPTGGGKTLTSLSFALKHCITNKMDRVIYGVPYLSIIEQTTDVFKKILGEDSVLEHHSGIDISKEKENSINRLLTENWDHPLIVTTNVQLFESLFSSKTTKVRKLHNIINSVIILDEAQMIPPQFLQPIVKTLKELVEFYNVIIILCTATQPTLSSIKSIDLNFDGINTAIELAPEPEKLFQELKRVIIHKPEERKLSFIEIATKISNYDQVLTIVNRKSDSIGIFNQLTGNKYYLTTNLCAEHRRDILKKVKSHLSNGESVYLVSTQLIEAGVDIDFPIVFRAVAGLDSIAQAVGRCNREGKLVDENGQEKLGEVFLFHPEQDPPSGHLLQTKQASEDCIKNFEELIHPDTLKQYFNTLFWLKQNKGLDKEEIEKDKRSFQFETINKNFKLIDEDSRPVIVPYKEGKDLIVQLQNSVVQNNFVDYKLIRKSQRYTVNLKTNLYNKLLSEGIISEIEGILNFDSYYHNDLGILESPNDQDLII

SEQ ID NO: 13362 - protein, 745 aa, Leptospira interrogans; identical to SEQ ID NO: 12864

SEQ ID NO: 13363 - protein, 745 aa, Leptospira interrogans
MKRNKQSIFIGHILRKDDGNFVEHLLDDHLYSVAELTEKFCEKFGAGTFGYLIGLWYDLGKFKLEFQERIRIRSGHIGEEAHLEGKTAKSVKHSASGAIHCFNKFKQSDIIKKLICLPMLCHHSGLKNFGIDVDIQLNEEREILALSETTPHIPQEILDGIDLKQLGKNFKDHSLLIRMLFSALIDADRLDTERFMDPAKFKERYSKTIILQDLNIKLDKHLKNIQKQADTTKVNSIRKRILEEVQSKTNLKPGFYTLTVPTGGGKTLTSLSFALKHCITNKMDRVIYGVPYLSIIEQTTDVFKKILGEDSVLEHHSGIDISKEKENSINRLLTENWDHPLIVTTNVQLFESLFSSKTTKVRKLHNIINSVIILDEAQMIPPQFLQPIVKTLKELVEFYNVTIILCTATQPTLSSIKSIDLNFDGINTAIELAPEPEKLFQELKRVIIHKPEKRKLSFIEIATKISNYDQVLTIVNRKSDSSGIFNQLTGNKYYLTTNLCAEHRRDILKKVKSHLSNGESVYLVSTQLIEAGVDIDFPIVFRAVAGLDSIAQAAGRCNREGKLVDENGQEKLGEVFLFHPEQDPPSGHLLQTKQASEDCIKNFEELIHPDTLKQYFNTLFWLKQDKGLDKEEIEKDKRSFQFETINKNFKLIDEDSRPVIVPYKEGKDLIVQLQNSVVQNNFVDYKLIRKSQRYTVNLKTNLYNKLLSEGIISEIEGIIGILNFDSYYDNDLGILESPNDQDLII

SEQ ID NO: 13364 - protein, 745 aa, Leptospira interrogans; identical to SEQ ID NO: 12650

SEQ ID NO: 13365 - protein, 745 aa, Leptospira interrogans; identical to SEQ ID NO: 12879

SEQ ID NO: 13366 - protein, 1122 aa, Vibrio cholerae; identical to SEQ ID NO: 12680

SEQ ID NO: 13367 - protein, 1122 aa, Vibrio cholerae; identical to SEQ ID NO: 12513

SEQ ID NO: 13368 - protein, 713 aa, Escherichia coli; identical to SEQ ID NO: 12478

SEQ ID NO: 13369 - protein, 724 aa, Escherichia coli; identical to SEQ ID NO: 12623

SEQ ID NO: 13370 - protein, 785 aa, Escherichia coli; identical to SEQ ID NO: 12958

SEQ ID NO: 13371 - protein, 705 aa, Escherichia coli; identical to SEQ ID NO: 12959

SEQ ID NO: 13372 - protein, 785 aa, Escherichia coli; identical to SEQ ID NO: 12943

SEQ ID NO: 13373 - protein, 730 aa, Escherichia coli; identical to SEQ ID NO: 12606

SEQ ID NO: 13374 - protein, 829 aa, Salmonella enterica
MTQIEYLDYLCYWGKTDKSTKNIICNYHLLAYHCLDVAACGKYIIKNNIFNSCNILKECNISGTNAENWIIWFLASHDIGKFARGFQKYAEFPNSPLVSPVSGVSAFERHDSLGFYLWGKLFEAWSSGSNEIIAGIEPENRARFESALNSWMLISTGHHGIPPDTMKNRSSLAFTDEDIVAATHYLEALSELFPFTLPQEWKTKAGRKCLKQHSWFFAGLVTLADWMGSDESQFPLLSSAMPLKDYWPLACEKAQQAILRMPPLSQHSHYQDHRALFPFIQTLTPLQQRASELDISAPGAQLVVLEDVTGAGKTEAALILTHRLMSANKGHGLYVGLPTMATANAMYQRLASAYHALFTDESRPSLILAHGGREMSDSFRQSIWQPTENLAEDYARDDGNATTECHTWFADSRKKALLAEVGVGTLDQLLMAVMPFRHQSLRLLGMRDKILLLDEVHAYDGYMVKLLEGLLRFHAAQGGSAIILSATLPAALREKLLNAFSDGAGFMSAGGSDNAGYPWLSHLTSSGLLEQPLATRPEVQRTVAVNWIQQRQEALDIIYRVVATGQCICWIRNTVDDALDTYQQLLHEGIVPEQDLLLFHSRFAFIDRIAIENKTLNWFGNNAPVSERRGKVLIATQVVEQSLDLDFDWMITDLAPIDLLIQRAGRLQRHIRDAHGQRKSTLPDERQPPVLHILAPHWQEQAEEGWLGQELKGTGFVYADHACLWRTQALLRQHGEIRMPDNARALVDGVYEQKIAAPAGLQTISDVAFGKVLSQRSVAAQNLLRYDLGYDREPATFYGIKIENFLPVWVKRVLMFISPEKTLMDSYAL

SEQ ID NO: 13375 - protein, 698 aa, Escherichia coli; identical to SEQ ID NO: 12760

SEQ ID NO: 13376 - protein, 768 aa, Escherichia coli; identical to SEQ ID NO: 12761

SEQ ID NO: 13377 - protein, 621 aa, Escherichia coli; identical to SEQ ID NO: 12963

SEQ ID NO: 13378 - protein, 730 aa, Escherichia coli; identical to SEQ ID NO: 12964

SEQ ID NO: 13379 - protein, 730 aa, Escherichia coli; identical to SEQ ID NO: 12942

SEQ ID NO: 13380 - protein, 684 aa, Escherichia coli; identical to SEQ ID NO: 12944

SEQ ID NO: 13381 - protein, 730 aa, Escherichia coli; identical to SEQ ID NO: 12945

SEQ ID NO: 13382 - protein, 757 aa, Leptospira interrogans; identical to SEQ ID NO: 12700

SEQ ID NO: 13383 - protein, 639 aa, Leptospira interrogans; identical to SEQ ID NO: 12948

SEQ ID NO: 13384 - protein, 1121 aa, Vibrio cholerae; identical to SEQ ID NO: 12688

SEQ ID NO: 13385 - protein, 374 aa, Bacillus cereus; identical to SEQ ID NO: 12369

SEQ ID NO: 13386 - protein, 731 aa, Bacillus cereus; identical to SEQ ID NO: 12655

SEQ ID NO: 13387 - protein, 807 aa, Leptospira interrogans; identical to SEQ ID NO: 12869

SEQ ID NO: 13388 - protein, 754 aa, Leptospira interrogans; identical to SEQ ID NO: 12737

SEQ ID NO: 13389 - protein, 745 aa, Leptospira interrogans; identical to SEQ ID NO: 12736

SEQ ID NO: 13390 - protein, 742 aa, Leptospira interrogans; identical to SEQ ID NO: 12880

SEQ ID NO: 13391 - protein, 745 aa, Leptospira interrogans; identical to SEQ ID NO: 12704

SEQ ID NO: 13392 - protein, 745 aa, Leptospira interrogans; identical to SEQ ID NO: 12927

SEQ ID NO: 13393 - protein, 617 aa, Leptospira interrogans; identical to SEQ ID NO: 12895

SEQ ID NO: 13394 - protein, 671 aa, Leptospira interrogans; identical to SEQ ID NO: 12897

SEQ ID NO: 13395 - protein, 476 aa, Bacillus cereus
MAYLSERFNQQDFRNMEPGYNYAFWSEPDSGKTSMIAKHLIPLAEQQNKSILFLYPRSAIGEQLKEKEEFKSHVIDYCTYQSLEEKLDDGLIMNHYDYIVCDEAHYFVEDADFNENIELSFDFINNERNSVKILLSGTPDPLQFVEFKKPVVAMSTVDYSNHNVEIVFLTRSTKSIENEIRRELENNKQTLVFSSSATTAYEMSRNFLEHNPFFISSKSNKTFKDKNDEGIREKIIEKEKSERQIGFMTAAMNTGVNFNEDVKNVVIVGTPSSVDIRQSVARIRKGEVNRKVRLYIQVPYGQAIRTKVESMKRDLEYNDIGIHNWQKKYGKRKVPSFVWHETDKQDEELARIKVNKLKLAKLKSDISDFATMSGDTIGTYKRIVSKFYPNTSVHMLKEHSESIEEVLEKIEGEYLLREDQDKIKSLFKEAGIKSKNGAVSLNVIRDYLYQKNNYFLEVNSKKFEGKTKRYWKFNRI

SEQ ID NO: 13396 - protein, 745 aa, Leptospira interrogans; identical to SEQ ID NO: 12904

SEQ ID NO: 13397 - protein, 745 aa, Leptospira noguchii; identical to SEQ ID NO: 12911

SEQ ID NO: 13398 - protein, 742 aa, Leptospira interrogans; identical to SEQ ID NO: 12826

SEQ ID NO: 13399 - protein, 743 aa, Bacillus cereus; identical to SEQ ID NO: 12656

SEQ ID NO: 13400 - protein, 745 aa, Leptospira interrogans; identical to SEQ ID NO: 12715

SEQ ID NO: 13401 - protein, 731 aa, Bacillus cereus; identical to SEQ ID NO: 12657

SEQ ID NO: 13402 - protein, 374 aa, Bacillus cereus; identical to SEQ ID NO: 12371

SEQ ID NO: 13403 - protein, 731 aa, Bacillus cereus; identical to SEQ ID NO: 12665

SEQ ID NO: 13404 - protein, 405 aa, Enterococcus faecium; identical to SEQ ID NO: 12424

SEQ ID NO: 13405 - protein, 405 aa, Enterococcus faecium; identical to SEQ ID NO: 12423

SEQ ID NO: 13406 - protein, 358 aa, Enterococcus faecium; identical to SEQ ID NO: 12395

SEQ ID NO: 13407 - protein, 358 aa, Enterococcus faecium; identical to SEQ ID NO: 12586

SEQ ID NO: 13408 - protein, 358 aa, Enterococcus
MFDQPEAKPREVVFFWTGQLTEKQTEIAKRILCHSEKRHHLIWAVTGAGKTEMLYPILVETLKAGGRVAICTPRVDVCNELFLRYRYVFPEEKITLLHGNTATAYTFTSFVICTIHQLYRFYRSFDLIVIDEIDAFPYNGDAGLAHAVQTAIRSNGRFIYLSATPDEKLLKEIKQTFELHKLALRFHRRLLPEPVLVFMNNWRQKCGNKKKINSLVRIIQQLIKENRILLFCPSITMMHRLKITLQEAFPEYEITDVSSQDDQRAKKVQKMREAIYEILLTTMILERGVTFERISVIVLGADHPVFTKSSLVQIAGRADRKGPYTNSRVYFFYEEKTSAIRKACQEIKEMNEEGKQVL

SEQ ID NO: 13409 - protein, 358 aa, Enterococcus faecium
MFDQPEAKPREVVFFWTGQLTEKQTEIAKRILCHSEKRHHLIWAVTGAGKTEMLYPILMETLKAGGRVAICTPRVDVCNELFLRYRYVFPEEKITLLHGNTATAYTFTSFVICTIHQLYRFYRSFDLIVIDEIDAFPYNGDAGLAHAVQTAIRSNGRFIYLSATPDEKLLKEIKQTFELHKLALRFHRRLLPEPVLVFMNNWRQKCGNKKKINSLVRIIQQLIKENRILLFCPSITMMHRLKITLQEAFPEYEITDVSSQDDQRAKKVQKMREAIYEILLTTMILERGVTFERISVIVLGADHPVFTKSSLVQIAGRADRKGPYTNSRVYFFYEEKTSAIRKACQEIKEMNEEGKQML

SEQ ID NO: 13410 - protein, 358 aa, Enterococcus faecium
MFDQPEAKPREVVFFWTGQLTEKQTEIAKRILCHSEKRHHLIWAVTGAGKTEMLYPILVETLKAGGRVAICTPRVDVCNELFLRYRYVFPEEKITLLHGNTATAYTFTSFVICTIHQLYRFYRSFDLIVIDEIDAFPYNGDAGLAHAVQTAIRSNGRFIYLSATPDEKLLKEIKQTFELHKLALRFHRRLLPEPVLVFMNNWRQKCGNKKKINSLVRIIQQLIKENRILLFCPSITMMHRLKITLQEAFPEYEITDVSSQDDQRAKKVQKMREAIYEILLTTMILERGVTFERISVIVLGADHPVFTKSSLVQIAGRADRKGPYTNSRVYFFYEEKTSAIRKACQEIKEMNEEGKQML

SEQ ID NO: 13411 - protein, 358 aa, Enterococcus faecium
MFDQPEAKPREVVFFWTGQLTEKQTEIVKRILCHSEKRHHLIWAVTGAGKTEMLYPILVETLKAGGRVAICTPRVDVCNELFLRYRYVFPEEKITLLHGNTATAYTFTSFVICTIHQLYRFYRSFDLIVIDEIDAFPYNGDAGLAHAVQTAIRSNGRFIYLSATPDEKLLKEIKQTFELHKLALRFHRRLLPEPVLVFMNNWRQKCGNKKKINSLVRIIQQLIKENRILLFCPSITMMHRLKITLQEAFPEYEITDVSSQDDQRAKKVQKMREAIYEILLTTMILERGVTFERISVIVLGADHPVFTKSSLVQIAGRADRKGPYTNSRVYFFYEEKTSAIRKACQEIKEMNEEGKQML

SEQ ID NO: 13412 - protein, 725 aa, Enterocloster bolteae; identical to SEQ ID NO: 12327

SEQ ID NO: 13413 - protein, 725 aa, Enterocloster bolteae; identical to SEQ ID NO: 12986

SEQ ID NO: 13414 - protein, 794 aa, Enterocloster bolteae; identical to SEQ ID NO: 12985

SEQ ID NO: 13415 - protein, 725 aa, Clostridiales; identical to SEQ ID NO: 12984

SEQ ID NO: 13416 - protein, 725 aa, Enterocloster clostridioformis; identical to SEQ ID NO: 12977

SEQ ID NO: 13417 - protein, 725 aa, Enterocloster; identical to SEQ ID NO: 12981

SEQ ID NO: 13418 - protein, 756 aa, Enterocloster clostridioformis; identical to SEQ ID NO: 12979

SEQ ID NO: 13419 - protein, 725 aa, Enterocloster clostridioformis; identical to SEQ ID NO: 12560

SEQ ID NO: 13420 - protein, 788 aa, Clostridium  innocuum; identical to SEQ ID NO: 12526

SEQ ID NO: 13421 - protein, 846 aa, Leptospira weilii; identical to SEQ ID NO: 12949

SEQ ID NO: 13422 - protein, 733 aa, Myxococcus hansupus
MVTNEPLAHVTEDCRPHLLREHLEAVGQWAARLAPREDLRAPALAAGRWHDLGKYTQDFQFRIRKENGFEAHLEKEGALERDHSTAGALWALSQDRRLLPLALAIAGHHAGLPDLPKFKERVGRDEKQALLADARARCDSPSLLNEPLGFSPETLVKLEPRQLELWTRMLFSVLCDADFLDTEAFFDASRGAAREVPVSLSQLSARLREFLDEKQRGAPDTEVNRVRREVLAAAVEAASQQPGVFSLTVPTGGGKTLTSMAFALEHARAQGLERVIVAIPFTSIIEQSAEAYRQAFQGLEHAVIEHHSAVDPDKETPLNRVASENWDAPVIVTTTVQLLESLFARRPSACRKLHRVARSVIVLDEAQTLPASLLEPILDGLGALVKDYGCSVIICTATQPALSRRPDFPEGLPEAREIVPASIRAFERLRRVRVRWPTSGRKLPYAELADAVAAERDVLAVVHLRADARRLCELVDERLGHEETLHLSALMCPEHRSKVLADIKARKRRGEPVRLVATQLVEAGVDLDFAVVYRGLGGLDALAQAAGRCNREGMLEGLGELRVYEPETQPPKGVSRAAQDVTRGLLAQSSDLDLFSPESFQRYFTRLYATRRLDEKGIQALRAKLHFEEVAQAFKLVEDDWSASVVVPYADCAPLLEALRVLGPSRERMRALQRFTVTVPRKLRDAWLARELARLAAETVAYLGPEHASVYDKRFGLLLDRVGIFDPAFLIPD

SEQ ID NO: 13423 - protein, 746 aa, Myxococcus hansupus; identical to SEQ ID NO: 13215

SEQ ID NO: 13424 - protein, 906 aa, Saprospira grandis; identical to SEQ ID NO: 12638

SEQ ID NO: 13425 - protein, 735 aa, Microscilla marina; identical to SEQ ID NO: 12317

SEQ ID NO: 13426 - protein, 844 aa, Treponema phagedenis; identical to SEQ ID NO: 12470

SEQ ID NO: 13427 - protein, 769 aa, Microscilla marina; identical to SEQ ID NO: 12316

SEQ ID NO: 13428 - protein, 773 aa, Treponema saccharophilum; identical to SEQ ID NO: 12613

SEQ ID NO: 13429 - protein, 744 aa, Phaeospirillum molischianum; identical to SEQ ID NO: 12136

SEQ ID NO: 13430 - protein, 931 aa, Leptospira; identical to SEQ ID NO: 12719

SEQ ID NO: 13431 - protein, 796 aa, Leptospira borgpetersenii; identical to SEQ ID NO: 12898

SEQ ID NO: 13432 - protein, 945 aa, Leptospira mayottensis; identical to SEQ ID NO: 12910

SEQ ID NO: 13433 - protein, 822 aa, Microcystis aeruginosa; identical to SEQ ID NO: 12141

SEQ ID NO: 13434 - protein, 945 aa, Leptospira mayottensis; identical to SEQ ID NO: 12746

SEQ ID NO: 13435 - protein, 632 aa, Leptospira borgpetersenii; identical to SEQ ID NO: 12814

SEQ ID NO: 13436 - protein, 918 aa, Microcystis aeruginosa; identical to SEQ ID NO: 12142

SEQ ID NO: 13437 - protein, 925 aa, Leptonema illini; identical to SEQ ID NO: 12599

SEQ ID NO: 13438 - protein, 798 aa, Microcystis aeruginosa; identical to SEQ ID NO: 12143

SEQ ID NO: 13439 - protein, 351 aa, Oenococcus oeni
MNWNGQLTRQQQKVSNEIITSINNKENRLIWAVTGAGKTEMIFPAIDHVIKKGGRVAVVSPRIDVILELAPRLRKAFSKLDLVLLYGDMPEEYHYTKLVLATTHQLLKFSQAFDLLIIDEVDSFPFHGDSMLESAALRAKKKIASTIYLTATPTKKLINDYRKKRLDASFLPLRFHQHLLPELTFSRIGDWRKQIIKNRLPRKLKIQIEKYQKSGQRFLLFVPKVSDLKNTLETIESFSKIKGLSVHAADPERKSKVQQMRDRKIQFLVTTTILERGITFPGIDVIILGADNQIFSVNAIVQIAGRVGRNKDRPSGLVLALIEEKTQVLIQASRQIRFMNEKGLKQLNNVQ

SEQ ID NO: 13440 - protein, 775 aa, Finegoldia magna; identical to SEQ ID NO: 12438

SEQ ID NO: 13441 - protein, 773 aa, Ruminococcus albus; identical to SEQ ID NO: 12481

SEQ ID NO: 13442 - protein, 791 aa, Thauera sp. 28; identical to SEQ ID NO: 12972

SEQ ID NO: 13443 - protein, 755 aa, Thauera sp. 27; identical to SEQ ID NO: 12970

SEQ ID NO: 13444 - protein, 753 aa, Campylobacter rectus; identical to SEQ ID NO: 12355

SEQ ID NO: 13445 - protein, 732 aa, Campylobacter showae; identical to SEQ ID NO: 12389

SEQ ID NO: 13446 - protein, 719 aa, Campylobacter showae; identical to SEQ ID NO: 12816

SEQ ID NO: 13447 - protein, 776 aa, Leptospira weilii; identical to SEQ ID NO: 12954

SEQ ID NO: 13448 - protein, 896 aa, Leptospira weilii; identical to SEQ ID NO: 12953

SEQ ID NO: 13449 - protein, 793 aa, Blautia hansenii; identical to SEQ ID NO: 12398

SEQ ID NO: 13450 - protein, 749 aa, Thermus aquaticus; identical to SEQ ID NO: 12354

SEQ ID NO: 13451 - protein, 1193 aa, Pseudomonas aeruginosa
MNILLVSQCEKRALSETRRILDQFAERRGERTWQTPITQAGLDTLRRLLKKSARRNTAVACHWIRGRDHSELLWIVGDASRFNAQGAVPTNRTRRDILRKEDENDWHSAEDIRLLTVMAALFHDIGKASQAFQAKLRNRGKPMADAYRHEWVSLRLFEAFVGPGSSDEDWLRRLADKRETGDAWLSQLARDDRQPAPPGPFQKSRLPPLAQAVGWLIVSHHRLPNGDHRGSASLARLPAPIQSQWCGARDADAKEKDACWQFPHGLPFASPHWRARTALCAQSMLERPGLLARGPALLHDAYVMHVSRLILMLADHHYSSLPADSRLGDPNFPLHANTDRDSGQLKQRLDEHLLGVALHSRKLAGTLPRLERQLPRLARHKGFTRRVEQPRFRWQDKAYDCAMACREQAMEHGFFGLNLASTGCGKTLANGRILYALADPQRGARFSIALGLRSLTLQTGQAYRERLGLGDDDLAILVGGSAARELFEKQQERLERSGSESAQELLAENSHVHFAGTLEDGPLREWLGRNSAGNRLLQAPILACTIDHLMPASESLRGGHQIAPLLRLMTSDLVLDEVDDFDIDDLPALSRLVHWAGLFGSRVLLSSATLPPALVQGLFEAYRSGREIFQRHRGAPGRATEIRCAWFDEFSSQSSAHGAVTSFSEAHATFVAQRLAKLEQLPPRRQAQLCTVHAAGEARPALCRELAGQMNTWMADLHRCHHTEHQGRRISFGLLRLANIEPLIELAQAILAQGAPEGLHVHLCVYHSRHPLLVRSAIERQLDELLKRSDDDAAALFARPTLAKALQASTERDHLFVVLASPVAEVGRDHDYDWAIVEPSSMRSIIQLAGRIRRHRSGFSGEANLYLLSRNIRSLEGQNPAFQRPGFETPDFPLDSHDLHDLLDPALLARIDASPRIVEPFPLFPRSRLVDLEHRRLRALMLADDPVVPARRTALVANPGIAQRRPANQPTISRRRQGAMLRPAAGRGRRGALAFQPLRRRDLEQPGQPVAQPRPHLWPAHPDMGHGQLSGGASRNGRPRGPRPASMRHALRRDEIARKHPGMELPPLFGVQEIQLRSTAFECEHSSMTIDQGGMDDLSPPNAYVAGASPVHRILHPGAPPGQAGQTPSRRRRQAPDIAGHPPAGGLAGRCRPAGWPVAVGDPHAQADPSRRPRQQPAQPAASTRATGPRRFP

SEQ ID NO: 13452 - protein, 827 aa, Bacillaceae; identical to SEQ ID NO: 12619

SEQ ID NO: 13453 - protein, 910 aa, Ralstonia solanacearum; identical to SEQ ID NO: 12135

SEQ ID NO: 13454 - protein, 895 aa, Pseudomonas stutzeri; identical to SEQ ID NO: 12607

SEQ ID NO: 13455 - protein, 703 aa, Pseudomonas stutzeri
MSEFDKFHPALQHHIVNSLGWNGLRPLQEATIQPVLDGEHAILLAPTAGGKTEAASFPVFSRMLSESWEGLSVLYICPIKALLNNLEQRLSYYGHLLGRSVALWHGDISAARKSKIVASPPDILLTTPESLEVMLVSNKVDHQQLFANVRTVIIDEVHAFAGDDRGWHLLSVLERISVLAGREIQRLGLSATVGNPDTLCDWLAGSCNARRSVINPPAENNVIPDVQVDWVGSLKNAAVVISRLHKGEKRLVFVDSRSKVEELAVELRCLGVATYISHSSLSLEERRAAEEAFSQGNDCVIVSTSTLELGIDVGDLDRVIQIDAPYTVASFLQRIGRTGRRAGSSRNCLFLATKEDAFLRALALLQLWRQGYVEPIEPPARPVHIYAQQTMALALQQKGIIAADVDQWVGRMPGFAGVTPDDRAGVISYMLGAGILHSDEGLIGIGKAGERAFGEKNFMELFSVFTTPPMVKVFSGKQELGEVHQLTFAVRDNGPALLTLGGRSWQTTYIDWPRKKAFVEPSEVRGKSQWVSDAQPLRYELCRAIADVLISDLVPEGLSSRAQGLLADLRDQYGWMESGKSTLLLDADGNAIWWNFAGKLLNSAMKDLLADEADKLIADNECMTFRHVYSAEALVRAIREILAGDAHNLAVLLDESFVQELKFAECLSQKEIDRELGERYSVDSDFKQFSRVSLAVLWVKDEA

SEQ ID NO: 13456 - protein, 779 aa, Bacillus azotoformans; identical to SEQ ID NO: 12698

SEQ ID NO: 13457 - protein, 737 aa, Brevibacillus laterosporus; identical to SEQ ID NO: 12133

SEQ ID NO: 13458 - protein, 741 aa, Bacillus smithii; identical to SEQ ID NO: 12581

SEQ ID NO: 13459 - protein, 761 aa, Clostridium botulinum; identical to SEQ ID NO: 12337

SEQ ID NO: 13460 - protein, 877 aa, Clostridium botulinum; identical to SEQ ID NO: 12386

SEQ ID NO: 13461 - protein, 657 aa, Brevibacillus borstelensis; identical to SEQ ID NO: 12941

SEQ ID NO: 13462 - protein, 768 aa, Brevibacillus borstelensis; identical to SEQ ID NO: 12940

SEQ ID NO: 13463 - protein, 726 aa, Anoxybacillus flavithermus; identical to SEQ ID NO: 12939

SEQ ID NO: 13464 - protein, 727 aa, Pseudomonas; identical to SEQ ID NO: 12499

SEQ ID NO: 13465 - protein, 727 aa, Pseudomonas syringa
MWSQGWTSLRDAQEWAIPALIDADRDVIIAASTAAGKTEAAFLPILTHLLNNTDAPGAVLYISPLKALINDQWDRLTRLCERLEIPVVGWHGDVSASRKHRFLKSPRGILLITPESLEALFVNRGSALAGLFQPLRYIVIDELHAFIGSERGKQLQSLMHRVETVVGKKLPRVGLSATLGEMALAREFLRPGQGRRMDEIISRASGQDLQVQVRGYTMLPMKKLTANLQMVVTKDDGNDDQDEEQEEDVSGTRHAIAAHMYKVLRGSNNLIFPNSRDKVEWYADRLRHLCENDGLPNEFLPHHGSLSRDLREDTERALKAGSPPASAVCTTTLELGIDIGNIKAVAQIGPPPSVASLRQRLGRSGRRAGEPATLRAYCQEDTLTPDSDLSDQLRQNLVQTIAMIRLLIEKWFEPPRANGLHASTLVQQCLSTIAQQGGAHASQLWNELIASGTFAAVDKTDFMALLKALGEKKLIVQDSSGLLLPGEIGEKLVNHYEFYSAFSSDEEFRLLRDGKPLGSIPVSRPLTLGQRIIFAGKRWQVMDVDLEKKVIAVRRARGGEPPVFDGLGAKIHDRVREEMRAVLTEVTPCPFLDANAQALLAEARQTFHRLGLADQRLTGSTSSSYLLTWAGDYTNDALCLLLNQAGVMCTASGLVLEISASQESVRAALARIAELDATDVEPLLKDVKNLIRERWDWALPKSLLIKSFASSQLDIPNAIALAKTLTT

SEQ ID NO: 13466 - protein, 802 aa, Clostridioides difficile; identical to SEQ ID NO: 12160

SEQ ID NO: 13467 - protein, 727 aa, Pseudomonas syringae
MWSQGWTSLRDAQEWAIPALIDADRDVIIAASTAAGKTEAAFLPILTHLLNNTDAPGAVLYISPLKALINDQWDRLTRLCERLEIPVVGWHGDVSASRKHRFLKSPRGILLITPESLEALFVNRGSALAGLFQPLRYIVIDELHAFIGSERGKQLQSLMHRVETVVGKKLPRVGLSATLGEMALAREFLRPGQGRRMDEIISRASGQDLQVQVRGYTMLPMKKLTANLQMVVTKDDGNDDQDEEQEEDVSGTRHAIAAHMYKVLRGSNNLIFPNSRDKVEWYADRLRHLCENDGLPNEFLPHHGSLSRDLREDTERALKAGSPPASAVCTTTLELGIDIGNIKAVAQIGPPPSVASLRQRLGRSGRRAGEPATLRAYCQEDTLTPDSDLSDQLRQNLVQTIAMIRLLIEKWFEPPRANGLHASTLVQQCLSTIAQQGGAHASQLWNELIASGTFAAVDKTDFMVLLKALGEKKLIVQDSSGLLLPGEIGEKLVNHYEFYSAFSSDEEFRLLRDGKPLGSIPVSRPLTLGQRIIFAGKRWQVMDVDLEKKVIAVIRARGGEPPVFDGLGAKIHDRVREEMRAVLTEVTPCPFLDANAQALLAEARQTFHRLGLADQRLTGSTSSSYLLTWAGDYTNDALCLLLNQAGVMCTASGLVLEISASQESVLAALARIAELDATDVEPLLKDVKNLIREKWDWALPKSLLIKSFASSQLDIPNAIALAKTLTT

SEQ ID NO: 13468 - protein, 773 aa, Clostridioides difficile; identical to SEQ ID NO: 12161

SEQ ID NO: 13469 - protein, 852 aa, Clostridioides difficile; identical to SEQ ID NO: 12159

SEQ ID NO: 13470 - protein, 727 aa, Pseudomonas syringae
MWSQGWTSLRDAQEWAIPALIDADRDVIIAASTAAGKTEAAFLPILTHLLNDTDAPGAVLYISPLKALINDQWDRLTRLCERLEIPVVGWHGDVSASRKHRFLKSPRGILLITPESLEALFVNRGSALAGLFQPLRYIVIDELHAFIGSERGKQLQSLMHRVETVVGKKLPRVGLSATLGEMALAREFLRPGQGRRMDEIISRASGQDLQVQVRGYTMLPMKKLTENLQMVVTKDDGNDDQDEEQEEDVSGTRHAIAAHIYKVLRGSNNLIFPNSRDKVEWYADRLRHLCENDGLPNEFLPHHGSLSRDLREDTERALKAGSPPASAVCTTTLELGIDIGNIKAVAQIGPPPSVASLRQRLGRSGRRAGEPATLRAYCQEDTLTPDSDLSDQLRQNLVQTIAMIRLLIEKWFEPPRVNGLHASTLVQQCLSTIAQQGGAHASQLWNELIASGTFAAVDKTDFMALLKALGEKKLIVQDSSGLLLPGEIGEKLVNHYEFYSAFSSDEEFRLLRDGKPLGSIPVSRPLTLGQRIIFAGKRWQVMDVDLEKKVIAVIRARGGEPPVFDGLGAKIHDRVREEMRAVLTEVTPCPFLDANAQALLAEARQTFHRLGLADQRLTGSTSSSYLLTWAGDYTNDALCLLLNQAGVMCTASGLVLEISASQESVRAALARIAELDATNVEPLLKDVKNLIREKWDWALPKSLLIKSFASSQLDIPNAIALAKTLTI

SEQ ID NO: 13471 - protein, 802 aa, Clostridioides difficile; identical to SEQ ID NO: 12171

SEQ ID NO: 13472 - protein, 773 aa, Clostridioides difficile; identical to SEQ ID NO: 12210

SEQ ID NO: 13473 - protein, 484 aa, Clostridium perfringens; identical to SEQ ID NO: 12338

SEQ ID NO: 13474 - protein, 764 aa, Xanthomonas translucens; identical to SEQ ID NO: 12765

SEQ ID NO: 13475 - protein, 764 aa, Xanthomonas translucens; identical to SEQ ID NO: 12220

SEQ ID NO: 13476 - protein, 910 aa, Clostridium perfringens
MYFEALNSLNIDDLIKEEYTVLAHIEGKNSEKETLKMHIDLCKEYFKKIYREKNLEKVFLNFENIFLNKPSHDEEFLFREMLVGIITMHDMGKINPNFQEIKMKNKLDINMELNIDTNHSIYSSIIYIDYFLGKLVKLNKEGKVKKENHSSFFTLLILNSYIISKHHSPIDNINLYTSKEGRLLSKFEEEKIEELKKIINPIYFRNLILNKRHIEKILEKYKDFSKSILEGKDSIKKEIGIYTYERFMLSILIACDYYSTSEYMNGTKIKDIGTISDINKFYETFKRGEIYKFIREYEKNEYGKEEDFSKVENINVLRNEMFLDAERELLKNIDKNIFYLEAPTGSGKSNVANNLAFKIIENDPTKNKIFYVYPFNTLIEQNLVTLEKIYENNKEVLEEIAVINSLFPIKEVKGTDYEKEKYFEDLEYSDYSKALLNRQFLNYPMILTTHVSLFSYMFGTMKENIFAFHQLANSVIVLDEIQSYKNQIWREIIEFLNGFSKILNIKIIIMSATLPDLEGLLIKDDIENSYKKSGDLDEKYKGNLAIYKDDKPLNNKNSVRLIKDRDKYFKNEKFKNRVRVDYSLMDLEKDEIFDALIEKIKAYDGKKRIVEFISKNSAYKFFEELKIREESEEGFGEIRLLTGDDNSIDREKIINEIKGNKDKKGLDNVTLVATQVIEAGVDIDMDIGFKDSSILDSEEQFLGRINRSCLKEDSKVYFFNLDNAISIYKGDVRKNTSLTIENKDIRNILIEKDFDYYNQLVNEPLLDNTSSYNDNNTELFFNGPVRNLDFKNVEEKMKLIDDDRNDIQVFLAYEIENKNTGSVYKIDGEEVWKEYRNLLLNNEMNYAEKMVKLSKVKAKMNYFIYRIRTKQNFNYNDRIGELLYIENGYDFFENGKLNKSRFEKDIGEFI

SEQ ID NO: 13477 - protein, 750 aa, Clostridium sporogenes; identical to SEQ ID NO: 12343

SEQ ID NO: 13478 - protein, 774 aa, Clostridium  symbiosum; identical to SEQ ID NO: 12475

SEQ ID NO: 13479 - protein, 774 aa, Clostridium  symbiosum; identical to SEQ ID NO: 12477

SEQ ID NO: 13480 - protein, 800 aa, Hungateiclostridium thermocellum; identical to SEQ ID NO: 11590

SEQ ID NO: 13481 - protein, 750 aa, Hungateiclostridium thermocellum; identical to SEQ ID NO: 12411

SEQ ID NO: 13482 - protein, 750 aa, Hungateiclostridium thermocellum; identical to SEQ ID NO: 11589

SEQ ID NO: 13483 - protein, 467 aa, Lactobacillus hilgardii; identical to SEQ ID NO: 12365

SEQ ID NO: 13484 - protein, 900 aa, Komagataeibacter hansenii; identical to SEQ ID NO: 12429

SEQ ID NO: 13485 - protein, 809 aa, Lactobacillus helveticus; identical to SEQ ID NO: 12301

SEQ ID NO: 13486 - protein, 814 aa, Lactobacillus coryniformis; identical to SEQ ID NO: 12644

SEQ ID NO: 13487 - protein, 664 aa, Neisseria flavescens; identical to SEQ ID NO: 12358

SEQ ID NO: 13488 - protein, 762 aa, Neisseria flavescens; identical to SEQ ID NO: 12382

SEQ ID NO: 13489 - protein, 770 aa, Lactobacillus ruminis; identical to SEQ ID NO: 12504

SEQ ID NO: 13490 - protein, 851 aa, Neisseria lactamica; identical to SEQ ID NO: 12407

SEQ ID NO: 13491 - protein, 834 aa, Neisseria lactamica; identical to SEQ ID NO: 12116

SEQ ID NO: 13492 - protein, 727 aa, Listeria monocytogenes; identical to SEQ ID NO: 11873

SEQ ID NO: 13493 - protein, 760 aa, Neisseria mucosa; identical to SEQ ID NO: 12417

SEQ ID NO: 13494 - protein, 726 aa, Listeria seeligeri; identical to SEQ ID NO: 12456

SEQ ID NO: 13495 - protein, 762 aa, Neisseria mucosa; identical to SEQ ID NO: 12467

SEQ ID NO: 13496 - protein, 836 aa, Neisseria polysaccharea; identical to SEQ ID NO: 12437

SEQ ID NO: 13497 - protein, 760 aa, Neisseria sicca; identical to SEQ ID NO: 12387

SEQ ID NO: 13498 - protein, 769 aa, Neisseria sicca; identical to SEQ ID NO: 12621

SEQ ID NO: 13499 - protein, 760 aa, Neisseria macacae; identical to SEQ ID NO: 12511

SEQ ID NO: 13500 - protein, 760 aa, Kingella denitrificans; identical to SEQ ID NO: 12482

SEQ ID NO: 13501 - protein, 961 aa, Schaalia odontolytica; identical to SEQ ID NO: 12323

SEQ ID NO: 13502 - protein, 759 aa, Kingella oralis; identical to SEQ ID NO: 12379

SEQ ID NO: 13503 - protein, 805 aa, Bifidobacterium adolescentis; identical to SEQ ID NO: 12324

SEQ ID NO: 13504 - protein, 1001 aa, Bifidobacterium angulatum; identical to SEQ ID NO: 12377

SEQ ID NO: 13505 - protein, 547 aa, Bifidobacterium breve; identical to SEQ ID NO: 12605

SEQ ID NO: 13506 - protein, 1045 aa, Bifidobacterium catenulatum; identical to SEQ ID NO: 12352

SEQ ID NO: 13507 - protein, 820 aa, Bifidobacterium dentium; identical to SEQ ID NO: 12339

SEQ ID NO: 13508 - protein, 784 aa, Thermoanaerobacter ethanolicus; identical to SEQ ID NO: 12488

SEQ ID NO: 13509 - protein, 756 aa, Mycolicibacterium phlei; identical to SEQ ID NO: 12618

SEQ ID NO: 13510 - protein, 838 aa, Streptomyces clavuligerus; identical to SEQ ID NO: 12350

SEQ ID NO: 13511 - protein, 982 aa, Streptomyces viridochromogenes; identical to SEQ ID NO: 12447

SEQ ID NO: 13512 - protein, 725 aa, Methanofollis liminatans; identical to SEQ ID NO: 12639

SEQ ID NO: 13513 - protein, 726 aa, Methanofollis liminatans; identical to SEQ ID NO: 12640

SEQ ID NO: 13514 - protein, 937 aa, Haloferax volcanii; identical to SEQ ID NO: 11729

SEQ ID NO: 13515 - protein, 791 aa, Halorubrum saccharovorum
MAYYVLDAAGFESDDPLVGFLTVARHHGQLPDTADYVRKATAERDEGPLHRLFREDTFEQVANIDANESTVADALIDRSTGGEGSWEGFCEWLHEIHEQDRFTQIGKHVLGGRKLSFKESEQLSEEFYDGVLQTWSALVLADKTSARHLTSEVDLPSEMIYGSPTPRRTAIDAKVRTLQWDAKRSGVDDRTRSLNEKREQARREVRSRAEDFAESSDSVATLTLPTGLGKTLTGLDAGLTVLDRKAGDGRLVYALPFTSIIDQVATESESVFDVDRVDSDVLTVDHHLSETRVPLPGSPEEVPDDTRADAEAILGESWRSGMVVTTFVQLFESLAGPGNVQSMKLPSLYDSVVVLDEPQALPHRWWALVERLARLLVEEYDATVIAMTATQPKLFTGSEDDETAELVPDPERYYEGLDRVRFELGPSVEAALDGEPAPLDYDRAGQRLAEVASEGASVLSICNTIDSARELTQSVEQHANPLVVNDVYDRVLASEGGKPADISPELTVERALDGWDSDRPLLVHLTTRHRPVDRKHLIDVAIELTEHELPVVFVSTQLIEAGVDVSFDRVFRDFAPLDSIVQAAGRCNRSFDRETGLVTTWVLEPPEGRERTPSAAVYDYGGDSLTKIAALALAEVYDGDPMDEYTVTRSAVESYFGKLNERGVGNPEYLKHIKKADAETLGRLSLIDEPPSVEVIVTRTREEKIHIDELRDAYREYDWETVEAKTELLKPLQVSVPMYGSDDEELFAHCSPIDERDDRLHIDARQARFDDYFDATEGVVTPDDSVEARLL

SEQ ID NO: 13516 - protein, 778 aa, Eubacterium plexicaudatum; identical to SEQ ID NO: 12956

SEQ ID NO: 13517 - protein, 864 aa, Haloferax mediterranei; identical to SEQ ID NO: 11908

SEQ ID NO: 13518 - protein, 862 aa, Haloferax lucentense
MIFKKYISHPAKTDDGEPTLLIGGGGRFDDEGHLRMVADRMVEACYGQMMADGTSTEVVAEVVGLTHDFSKLTRWAQKHLRGEPFQHSDEYRYHAFPGALVTLYCLLEYWDEVGDYAAEVATLVVAGHHDTQSPPEPTKMAENYGRTTVEVQETYERVDEQFEDIGNEVPERADRIIRAATDGAGSWEDFREWHDDRAEPINGAHDHLMYFARMGKRDADASYYGDVVRLWTALKLADQTAASGLEDGDIGGTLPDRDALDEHVDDLDEGEGVLADLNRLRDRARKDATENVKALVESDDVGLITLPTGFAKTYAGLSAGLRAADINDSRLVYVLPYTSILDQTASDIQSVFGVSPYSKAFTLHHHLSNTYTGLGDHYTDADIGRSPGALHAESWLSGLTLTTTVQLFESLAAPTARQATRVPSLRESVVVIDEPQAIPEDWWQIVPALVELLVDTYDATVILMTATQPGLVKYGSDELTTRELTDDTDQYTDFLADHPRVTYRLHDTVRLDRGDEYATLDYPTAGGRISEAAGDGRDVLAVCNTRASAEELYQHVTPMQSGGENESVELGHLLHDYVNETGELPTPVELRRLALDAVTEQDTNTVYAFLSGDVRPDDRKLLIDTLYDDEAGDEDDLGPLLDTDESVVLVSTSVVEAGVDVSFDTVFRDYAPIPNIVQSGGRCNRSFGGETGDVVVWRLAEPEDGNAIPSLVIHGGDGGDALPLLRETGQVLWRHAEDGTIDESTMVSDTVGEFYESLFDGDLEPGNERLADAVASASMSELEGEHMIEEIENYEDVVACLTDRERADLLGGDMDAGDIRRYPGAQVNTDPDGCATELAVGNSRYLLVDAQSRSYHPVFGVR

SEQ ID NO: 13519 - protein, 880 aa, Haloferax; identical to SEQ ID NO: 12788

SEQ ID NO: 13520 - protein, 492 aa, Thermococcus litoralis; identical to SEQ ID NO: 12604

SEQ ID NO: 13521 - protein, 712 aa, Schaedlerella arabinosiphila; identical to SEQ ID NO: 12955

SEQ ID NO: 13522 - protein, 734 aa, Desulfobacter postgatei; identical to SEQ ID NO: 12628

SEQ ID NO: 13523 - protein, 908 aa, Desulfobacter postgatei; identical to SEQ ID NO: 12629

SEQ ID NO: 13524 - protein, 747 aa, Cardiobacterium hominis; identical to SEQ ID NO: 12392

SEQ ID NO: 13525 - protein, 881 aa, Nitrosospira lacus; identical to SEQ ID NO: 12227

SEQ ID NO: 13526 - protein, 580 aa, Bifidobacterium pseudocatenulatum; identical to SEQ ID NO: 12362

SEQ ID NO: 13527 - protein, 742 aa, Lysinibacillus fusiformis; identical to SEQ ID NO: 12442

SEQ ID NO: 13528 - protein, 612 aa, Thauera sp. 63; identical to SEQ ID NO: 12969

SEQ ID NO: 13529 - protein, 819 aa, Microcystis aeruginosa; identical to SEQ ID NO: 12144

SEQ ID NO: 13530 - protein, 882 aa, Nitrospirillum amazonense; identical to SEQ ID NO: 12527

SEQ ID NO: 13531 - protein, 931 aa, Leptospira borgpetersenii; identical to SEQ ID NO: 12732

SEQ ID NO: 13532 - protein, 764 aa, Neisseria weaveri; identical to SEQ ID NO: 12518

SEQ ID NO: 13533 - protein, 600 aa, Thauera aminoaromatica; identical to SEQ ID NO: 12971

SEQ ID NO: 13534 - protein, 699 aa, Thauera aminoaromatica
MLLAGLTSFADWIGSNTEWFKFGTEADTDKPARWFETRRSCAEQALDALGWQRRTPLLKSPCGFDEVFGFPPRPLQEAVSTVLADLNAPAILLIEAPMGEGKTEAAWFAHLELQRRFEHRGLYIALPTQATGNAMFARTLAFLRARDAGRVLDLQLLHGGTLLNDHFQQLRLSSVHDDDAADPHAAQVKAAEWFTHRKRALLSEYGVGTVDQALLPVLPVRHHFVRLWGLANRVVVFDEIHAYDAYTGTLLIHLVRWLHALGSSVLLLSATLPPAIRRELARVVGSDLPATEADYPRLSVFATGSVRQTHFEADPTRRVTMDIQPIGSALEDMQTELERRLSEGGMGLALVNTVQRAQALYSLFPEGRPLLWESEQVGKLLDDGTEIYLFHARFPASQRQLRERRVLDIFGKTGGENGELRSGRKILIATQVAEQSLDLDFDLMATDLAPIDLLLQRAGRLWRHPRPRRPVAAPVLLIAGLAGDAPDDFGRPLWWGAVYAESVLLRTWCLLRQPARRQIILPDHIDTLVQAVYEENVPIPDGLQARLDKALMESDGDGIAKTQQANGAIIGLPDDASWDDPARFVLYDEDDPCVHRTLAAQTRLGDESLTVIPLGPADVFDVGTAPCFEQATAWSRRTLRVGRKGVVKQLKALGIPEPWQQSPLLRNHFPLCLDEEGRWLGDLSVRLDSALGLTYGNEN

SEQ ID NO: 13535 - protein, 771 aa, Porphyromonas asaccharolytica; identical to SEQ ID NO: 12454

SEQ ID NO: 13536 - protein, 705 aa, Porphyromonas endodontalis; identical to SEQ ID NO: 12374

SEQ ID NO: 13537 - protein, 750 aa, Porphyromonas endodontalis; identical to SEQ ID NO: 12373

SEQ ID NO: 13538 - protein, 744 aa, Prevotella oris; identical to SEQ ID NO: 12410

SEQ ID NO: 13539 - protein, 711 aa, Prevotella oris; identical to SEQ ID NO: 12441

SEQ ID NO: 13540 - protein, 763 aa, Vibrio; identical to SEQ ID NO: 12399

SEQ ID NO: 13541 - protein, 823 aa, Thermoanaerobacter thermohydrosulfuricus; identical to SEQ ID NO: 12938

SEQ ID NO: 13542 - protein, 750 aa, Pseudomonas syringae
MNSQASSSDSSAFERLHPDVQQWVWSQGWTSLRDAQEWAIPALIDADRDVIIAASTAAGKTEAAFLPILTHLLNDTDAPGAVLYISPLKALINDQWDRLTRLCERLEIPVVGWHGDVSASRKHRFLKSPRGILLITPESLEALFVNRGSALAGLFQPLRYIVIDELHAFIGSERGKQLQSLMHRVETVVGKKLPRVGLSATLGEMALAREFLRPGQGRRMDEIISQASGQDLQVQVRGYTMLPMKKLTENLQMVVTKDDGNDDQDEEQEEDVSGTRHAIAAHIYKVLRGSNNLIFPISRDKVEWYADRLRHLCENDGLPNEFLPHHGSLSRDLREDTERALKAGSPPASAVCTTTLELGIDIGNIKAVAQIGPPPSVASLRQRLGRSGRRAGEPATLRAYCQEDTLTPDSDLSDQLRQNLVQTIAMIRLLIEKWFEPPRANGLHASTLVQQCLSTIAQQGGAHASQLWNELIASGTFAAVDKTDFMALLKALGEKKLIVQDSSGLLLPGEIGEKLVNHYEFYSAFSSDEEFRLLRDGKPLGSIPVSRPLTLGQRIIFAGKRWQVMDVDLEKKVIAVIRARGGEPPVFDGLGAKIHDRVREEMRAVLTEVTPCPFLDANAQALLAEARQTFHRLGLADQRLTGSTSSSYLLTWAGDYTNDALCLLLNQAGVMCTASGLVLEISASQESVRAALARIAELDATDVEPLLKDVKNLIREKWDWALPKSLLIKSFASSQLDIPNAIALAKTLTI

SEQ ID NO: 13543 - protein, 745 aa, Leptospira noguchii; identical to SEQ ID NO: 12742

SEQ ID NO: 13544 - protein, 892 aa, Pseudomonas oleovorans; identical to SEQ ID NO: 12139

SEQ ID NO: 13545 - protein, 922 aa, Leptospira noguchii; identical to SEQ ID NO: 12866

SEQ ID NO: 13546 - protein, 745 aa, Leptospira noguchii; identical to SEQ ID NO: 12865

SEQ ID NO: 13547 - protein, 745 aa, Leptospira noguchii; identical to SEQ ID NO: 12908

SEQ ID NO: 13548 - protein, 745 aa, Leptospira noguchii; identical to SEQ ID NO: 12925

SEQ ID NO: 13549 - protein, 745 aa, Leptospira noguchii; identical to SEQ ID NO: 12825

SEQ ID NO: 13550 - protein, 922 aa, Leptospira noguchii; identical to SEQ ID NO: 12823

SEQ ID NO: 13551 - protein, 745 aa, Leptospira noguchii; identical to SEQ ID NO: 12936

SEQ ID NO: 13552 - protein, 802 aa, Clostridioides difficile; identical to SEQ ID NO: 12200

SEQ ID NO: 13553 - protein, 745 aa, Leptospira noguchii; identical to SEQ ID NO: 12937

SEQ ID NO: 13554 - protein, 758 aa, Leptospira santarosai
MEKLLAKSLSGDPRDNEQELYLVPHLRAAEEAGSAIYESIGERILKAVGLPSIIWSKRLKILLPLACLLHDLGKANNWFQELLRGMKIYQPIRHEFLSVIMILRSTKKIQNYLKEKIHVLETSEDKTPFINSIYSGILAHHMKMDIDLKRACPALFANGGTPTEIIAYTNASDFDSLFGPDKPTNDFCFTFLSSHANDKYKPIHRWIDEFQKISCEWEEFLKENNDWHIFSTILKPLVISADVIASALVPKGIEYKDWVIKSLQNYIEQNDINQIVKERLHGKSPREFQRQIANSEERITLVEAGCGSGKTIGAYLWAANNALNSKLFFCYPTTGTATEGYLGYVSDSNYESKLIHSKSQVDLEGIHKTGDEDSTELTDKIHALHSYHPKIIICTADTVLSLIKNGRKSILSFPSIATGIFVFDEIHSYNDEMFLVMVRFIQFFKNTKFLLMSASLQPERKNVLKREFINFQEIESPTDLMDIPRYKFEEIRDSKTLSEDIKRHAGHSKILVVVNTVKRAQSIYRDLKSSGLNLKIYHSRYKYKDRVIRHREFITAFKDDAPPVVGIATQVAEMSLDIDSDTLFCELATIPSIMQRLGRLNRRTTPDNQLPARSVYFSRPEKPLPYEKEELELAEQWIEILRNSKDEISQNDLQEFFLNIKTETADLFPPVYYDFNKPTFYFTPATEGLRGASSTVNCILKSDLLEIDQSPYNIANYIIPMTMNRKVDFTILDQYKYAFVIPDEKIHYDSLEGAQWLN

SEQ ID NO: 13555 - protein, 932 aa, Leptospira santarosai; identical to SEQ ID NO: 12749

SEQ ID NO: 13556 - protein, 931 aa, Leptospira santarosai; identical to SEQ ID NO: 12858

SEQ ID NO: 13557 - protein, 932 aa, Leptospira santarosai; identical to SEQ ID NO: 12862

SEQ ID NO: 13558 - protein, 759 aa, Leptospira santarosai; identical to SEQ ID NO: 12861

SEQ ID NO: 13559 - protein, 932 aa, Leptospira santarosai; identical to SEQ ID NO: 12870

SEQ ID NO: 13560 - protein, 932 aa, Leptospira santarosai; identical to SEQ ID NO: 12916

SEQ ID NO: 13561 - protein, 758 aa, Leptospira santarosai; identical to SEQ ID NO: 12917

SEQ ID NO: 13562 - protein, 932 aa, Leptospira santarosai; identical to SEQ ID NO: 12706

SEQ ID NO: 13563 - protein, 932 aa, Leptospira santarosai; identical to SEQ ID NO: 12900

SEQ ID NO: 13564 - protein, 758 aa, Leptospira santarosai; identical to SEQ ID NO: 12899

SEQ ID NO: 13565 - protein, 932 aa, Leptospira santarosai; identical to SEQ ID NO: 12903

SEQ ID NO: 13566 - protein, 758 aa, Leptospira santarosai; identical to SEQ ID NO: 12902

SEQ ID NO: 13567 - protein, 932 aa, Leptospira santarosai; identical to SEQ ID NO: 12930

SEQ ID NO: 13568 - protein, 932 aa, Leptospira santarosai; identical to SEQ ID NO: 12906

SEQ ID NO: 13569 - protein, 759 aa, Leptospira santarosai; identical to SEQ ID NO: 12905

SEQ ID NO: 13570 - protein, 932 aa, Leptospira santarosai; identical to SEQ ID NO: 12909

SEQ ID NO: 13571 - protein, 758 aa, Leptospira santarosai; identical to SEQ ID NO: 12913

SEQ ID NO: 13572 - protein, 932 aa, Leptospira santarosai; identical to SEQ ID NO: 12912

SEQ ID NO: 13573 - protein, 932 aa, Leptospira santarosai; identical to SEQ ID NO: 12747

SEQ ID NO: 13574 - protein, 758 aa, Leptospira santarosai; identical to SEQ ID NO: 12748

SEQ ID NO: 13575 - protein, 758 aa, Leptospira santarosai; identical to SEQ ID NO: 12923

SEQ ID NO: 13576 - protein, 932 aa, Leptospira santarosai; identical to SEQ ID NO: 12922

SEQ ID NO: 13577 - protein, 932 aa, Leptospira santarosai; identical to SEQ ID NO: 12813

SEQ ID NO: 13578 - protein, 932 aa, Leptospira santarosai; identical to SEQ ID NO: 12932

SEQ ID NO: 13579 - protein, 931 aa, Leptospira weilii; identical to SEQ ID NO: 12857

SEQ ID NO: 13580 - protein, 931 aa, Leptospira weilii; identical to SEQ ID NO: 12741

SEQ ID NO: 13581 - protein, 931 aa, Leptospira weilii; identical to SEQ ID NO: 12878

SEQ ID NO: 13582 - protein, 931 aa, Leptospira weilii; identical to SEQ ID NO: 12892

SEQ ID NO: 13583 - protein, 931 aa, Leptospira weilii; identical to SEQ ID NO: 12812

SEQ ID NO: 13584 - protein, 722 aa, Geobacter metallireducens; identical to SEQ ID NO: 11562

SEQ ID NO: 13585 - protein, 470 aa, Haloarcula vallismortis; identical to SEQ ID NO: 12795

SEQ ID NO: 13586 - protein, 762 aa, Neisseria; identical to SEQ ID NO: 12415

SEQ ID NO: 13587 - protein, 961 aa, Schaalia odontolytica; identical to SEQ ID NO: 12426

SEQ ID NO: 13588 - protein, 702 aa, Eubacterium  cellulosolvens; identical to SEQ ID NO: 12627

SEQ ID NO: 13589 - protein, 807 aa, Clostridium  scindens; identical to SEQ ID NO: 12334

SEQ ID NO: 13590 - protein, 368 aa, Clostridium  spiroforme; identical to SEQ ID NO: 12336

SEQ ID NO: 13591 - protein, 720 aa, Clostridium  spiroforme; identical to SEQ ID NO: 12335

SEQ ID NO: 13592 - protein, 721 aa, Lachnospiraceae; identical to SEQ ID NO: 12322

SEQ ID NO: 13593 - protein, 803 aa, Ruminiclostridium papyrosolvens; identical to SEQ ID NO: 12487

SEQ ID NO: 13594 - protein, 765 aa, Ruminiclostridium cellobioparum
MDNKAADERFIAKTIPRKDIQGHTDDLLDNFKLLKELYPNLKIDWELLRLACIYHDLGKMNDTFQQCVHGKVKSTGIPHGFLSLGFIDVEYLEELGYEEKDIRALFQAVAYHHERDVYLEEDEISREIARLAGVFKNFEYRPLPSRHLDARLYKSFFRLGTRPYESRDGEYFFKTIMLKGLLNRIDYAASAGIDVEKPAGFLPEAMEILVNGWKKDNPGAGWNELQKYMLENRNENVVVVAQTGMGKTEAGLLWLGDSKGFFTLPLKSAINAIYKRIAENIAGKDMENRVALLHSDTLKVYTEQEESNKYKKKSSEADDIREYESAELEGYYTRTRQLSLPLTICTLDQIFDFVYRYKGFELKLATLSYSKVIVDEIQMYSPDLIAYLILGLKYITRMGGRFAILTATLPGVILDLMKDEGICFKGSETFTNGLVRHSIMKIDSQIDEDSSIAEMARAYNKNKLLIICNTVRKAKTVYNKLKAVLQKETGDESVEHLQLLHSGFIREERSKKEDRIMELGKKGSTGCGIWVTTQLVEASLDIDFDLLYTELSDLNGLFQRMGRCCRHRKLDKEYNCFVFTGGNKKCSGVGSFIDEKIHQLSKEALYNGVLNETAKAEMIKETYSTEKLKDTGYYSDIKSTIQYVKDISSYEMDKRDVNKVFRDIDQVSVIPLSVYKEHEEDIGYNIGIIKSREYSKKEKVKVREALRDLMVPVQRRLAEETKIIFKKISNGFDIIAVDAEYSIETGISFEKTGKEEFRNAESRMF

SEQ ID NO: 13595 - protein, 918 aa, Acinetobacter bohemicus
MVSWLIVSHHRLPDLKEEDRRKAYASTPKETLPSLLKSIGADWGYQNKFDENDYKSRLKQCFEFEQGLLSQSTEWTKQIKKWSGRLLQELSHTEQIFVDGSWRVIVHHARLCLMLGDHYYSSCDADKTWKTKLTLIANTDQKTKQPKQFLDEHLVNVSKNALLVSQSLSRLAEDMEPAYDIQKLKKKSPDGFEWQDQAVKSIQQFIQKNEGTEKQGWFIVNMASTGKGKTIANAKIMQALSPNADSLRYILALGLRTLTLQTGDSYRHDIGLGNDELAVLIGSKAVQELHHKNTQKKDEIENDLAEIGSESLEQLLDNELDYESMPQADFMNALFPQNQAERNKAFLYKPVLACTIDHIMSATETKRGGKYILPCLRLLSSDLVIDEVDDFNGQDLIAIARLVHLTGMLGRKVMISSATIPPALVEGFFNAYQQGWQLYCAFKKLKNTDVVSMWVDEFKAQIQTVPLANNHNIILDYENAHEKFVQIRAKFLLEQVVKHKAYLIDCADLVVEKNTQQLDESVQTEYFRRIQQHVEKLHHDHHTIDEKTGKKVSFGVIRVANVSPCVALTQYLLNAEWSPDVAARIMAYHSRQVLLLRSEQEHHLDEVLKRKEKMGEQPKAFSNLMIRQHLDSTQADNVIFILVATPVEEVGRDHDFDWAIVEPSSYRSIIQLAGRVLRHRKLEQNIEKPNIALLQYNLKGLRKADVAFEKPGFEINSAKGNFKLDTKNFAELVDIQNIESGINAIPRIQRNYPLQPTKKLADLEHAVMADALTAYAKVGAQPLNGWLTQKWFLTALPQRFNAFRQSSPNIQLFAVWKNDKLIFCEKDDFGEYIERTGFYHISCVELNDLEKEKLWLNRNYGDILCRMAIEKDSENEDIKSEVEKLSKRYGEIMLPEYDSNKKLTYSEQLGLVVLNKDK

SEQ ID NO: 13596 - protein, 745 aa, Leptospira kirschneri; identical to SEQ ID NO: 12646

SEQ ID NO: 13597 - protein, 765 aa, Leptospira kirschneri; identical to SEQ ID NO: 12645

SEQ ID NO: 13598 - protein, 765 aa, Leptospira kirschneri; identical to SEQ ID NO: 12729

SEQ ID NO: 13599 - protein, 745 aa, Leptospira kirschneri; identical to SEQ ID NO: 12852

SEQ ID NO: 13600 - protein, 745 aa, Leptospira kirschneri; identical to SEQ ID NO: 12872

SEQ ID NO: 13601 - protein, 761 aa, Leptospira kirschneri; identical to SEQ ID NO: 12871

SEQ ID NO: 13602 - protein, 745 aa, Leptospira kirschneri; identical to SEQ ID NO: 12703

SEQ ID NO: 13603 - protein, 758 aa, Leptospira kirschneri; identical to SEQ ID NO: 12708

SEQ ID NO: 13604 - protein, 745 aa, Leptospira kirschneri; identical to SEQ ID NO: 12914

SEQ ID NO: 13605 - protein, 745 aa, Leptospira kirschneri; identical to SEQ ID NO: 12707

SEQ ID NO: 13606 - protein, 745 aa, Leptospira kirschneri; identical to SEQ ID NO: 12921

SEQ ID NO: 13607 - protein, 765 aa, Leptospira kirschneri; identical to SEQ ID NO: 12920

SEQ ID NO: 13608 - protein, 765 aa, Leptospira kirschneri; identical to SEQ ID NO: 12710

SEQ ID NO: 13609 - protein, 745 aa, Leptospira kirschneri; identical to SEQ ID NO: 12709

SEQ ID NO: 13610 - protein, 745 aa, Leptospira kirschneri; identical to SEQ ID NO: 12718

SEQ ID NO: 13611 - protein, 758 aa, Leptospira kirschneri; identical to SEQ ID NO: 12717

SEQ ID NO: 13612 - protein, 866 aa, Actinomycetaceae; identical to SEQ ID NO: 12670

SEQ ID NO: 13613 - protein, 634 aa, Peptoniphilus indolicus; identical to SEQ ID NO: 12545

SEQ ID NO: 13614 - protein, 853 aa, Peptoniphilus lacrimalis; identical to SEQ ID NO: 12409

SEQ ID NO: 13615 - protein, 920 aa, Anaerococcus lactolyticus; identical to SEQ ID NO: 12367

SEQ ID NO: 13616 - protein, 713 aa, Coprococcus eutactus; identical to SEQ ID NO: 12329

SEQ ID NO: 13617 - protein, 750 aa, Pseudomonas syringae group
MNSPVSGSESSSFERLHPDVQHWVWSQGWTSLRDAQECAIPALIDADRDVIIAASTAAGKTEAAFLPILTNLLVNDQPAGAVLYISPLKALINDQWDRLSRLCERLEVPVVAWHGDVSASRKHRFLTSPSGILLITPESLEALFVNRGSAVKGLFQQLRYIVVDELHAFIGSERGKQLQSLMQRVERVAGRQLPRVGLSATLGEMSLAREFLRPGQNQRMEVIESKSSGQNLQIQVRGYTLPPMIKLISGQKPAETTDHDENEQENESGSRHAIAAHLYKFLCGSNNLIFPNSRDKVEWYADRLRHLCEKDGLPNEFFPHHGSLSRDLREDTERALKAGTPPASAVCTTTLELGIDIGNIRTVAQINSPPSVASLRQRLGRSGRREGEPATLRVYCEESTLTPDSDLSDQLRQNLVQTIAMIRLLINKWFEPPRANGLHASTLVQQCLSVIAQQGGASASELWSALVASGTFSAITRPDFLAMLKALGEQKLVVQDSSGLLLPGEIGERLVNHYEFYSAFQSDEEFRLIRDGKPLGSVPVSRPLTQGQRIIFGGRRWQVMDIDLEKKVIVVKPARGGEPPTFDGLSAKIHDDVRQEMRSVLVETAPCPFIDANAQKLLEEARHTFRSLGLDKRHLAGSASRNYLLTWKGDYINDALSLLLNREGVMCECSGLVLDIGAPKESLMAALREIACLDAIDVEPLLKEVKNLIREKWDWALPLPLLIKSFASSQLDLGGAIELAKVLSLSDGSS

SEQ ID NO: 13618 - protein, 779 aa, Anoxybacillus flavithermus; identical to SEQ ID NO: 12764

SEQ ID NO: 13619 - protein, 730 aa, Anoxybacillus flavithermus; identical to SEQ ID NO: 12763

SEQ ID NO: 13620 - protein, 935 aa, Haloarcula sinaiiensis; identical to SEQ ID NO: 12796

SEQ ID NO: 13621 - protein, 881 aa, Haloferax denitrificans; identical to SEQ ID NO: 12794

SEQ ID NO: 13622 - protein, 984 aa, Acinetobacter ursingii; identical to SEQ ID NO: 12973

SEQ ID NO: 13623 - protein, 864 aa, Streptomyces viridosporus; identical to SEQ ID NO: 12422

SEQ ID NO: 13624 - protein, 882 aa, Corynebacterium accolens; identical to SEQ ID NO: 12364

SEQ ID NO: 13625 - protein, 1017 aa, Acinetobacter sp. ANC 3880; identical to SEQ ID NO: 12974

SEQ ID NO: 13626 - protein, 806 aa, Anaerobutyricum hallii; identical to SEQ ID NO: 12360

SEQ ID NO: 13627 - protein, 652 aa, Anaerobutyricum hallii; identical to SEQ ID NO: 12359

SEQ ID NO: 13628 - protein, 899 aa, Aeromonas diversa; identical to SEQ ID NO: 12975

SEQ ID NO: 13629 - protein, 812 aa, Eubacterium  siraeum; identical to SEQ ID NO: 12333

SEQ ID NO: 13630 - protein, 894 aa, Corynebacterium glucuronolyticum; identical to SEQ ID NO: 12366

SEQ ID NO: 13631 - protein, 718 aa, Halanaerobium saccharolyticum; identical to SEQ ID NO: 12229

SEQ ID NO: 13632 - protein, 876 aa, Haloarcula argentinensis; identical to SEQ ID NO: 12798

SEQ ID NO: 13633 - protein, 567 aa, Aggregatibacter actinomycetemcomitans; identical to SEQ ID NO: 12537

SEQ ID NO: 13634 - protein, 821 aa, Aggregatibacter actinomycetemcomitans; identical to SEQ ID NO: 12542

SEQ ID NO: 13635 - protein, 674 aa, Aggregatibacter actinomycetemcomitans; identical to SEQ ID NO: 12544

SEQ ID NO: 13636 - protein, 815 aa, Paenibacillus alvei; identical to SEQ ID NO: 12667

SEQ ID NO: 13637 - protein, 719 aa, Aggregatibacter actinomycetemcomitans; identical to SEQ ID NO: 12532

SEQ ID NO: 13638 - protein, 595 aa, Aggregatibacter actinomycetemcomitans; identical to SEQ ID NO: 12533

SEQ ID NO: 13639 - protein, 821 aa, Aggregatibacter actinomycetemcomitans; identical to SEQ ID NO: 12530

SEQ ID NO: 13640 - protein, 834 aa, Aggregatibacter actinomycetemcomitans; identical to SEQ ID NO: 12531

SEQ ID NO: 13641 - protein, 595 aa, Aggregatibacter actinomycetemcomitans; identical to SEQ ID NO: 12534

SEQ ID NO: 13642 - protein, 821 aa, Aggregatibacter actinomycetemcomitans; identical to SEQ ID NO: 12536

SEQ ID NO: 13643 - protein, 595 aa, Aggregatibacter actinomycetemcomitans; identical to SEQ ID NO: 12535

SEQ ID NO: 13644 - protein, 832 aa, Aggregatibacter actinomycetemcomitans; identical to SEQ ID NO: 12539

SEQ ID NO: 13645 - protein, 522 aa, Aggregatibacter actinomycetemcomitans; identical to SEQ ID NO: 12538

SEQ ID NO: 13646 - protein, 860 aa, Natronobacterium gregoryi; identical to SEQ ID NO: 12780

SEQ ID NO: 13647 - protein, 688 aa, Natronobacterium gregoryi; identical to SEQ ID NO: 11945

SEQ ID NO: 13648 - protein, 831 aa, Aggregatibacter actinomycetemcomitans; identical to SEQ ID NO: 12572

SEQ ID NO: 13649 - protein, 751 aa, Clostridium  ultunense; identical to SEQ ID NO: 12223

SEQ ID NO: 13650 - protein, 729 aa, Clostridium  ultunense; identical to SEQ ID NO: 12224

SEQ ID NO: 13651 - protein, 785 aa, Clostridium  ultunense; identical to SEQ ID NO: 12225

SEQ ID NO: 13652 - protein, 825 aa, Clostridium  ultunense; identical to SEQ ID NO: 12226

SEQ ID NO: 13653 - protein, 623 aa, Aggregatibacter actinomycetemcomitans; identical to SEQ ID NO: 12772

SEQ ID NO: 13654 - protein, 768 aa, Aggregatibacter actinomycetemcomitans; identical to SEQ ID NO: 11710

SEQ ID NO: 13655 - protein, 838 aa, Aggregatibacter actinomycetemcomitans; identical to SEQ ID NO: 12756

SEQ ID NO: 13656 - protein, 715 aa, Ruminococcus  lactaris; identical to SEQ ID NO: 12348

SEQ ID NO: 13657 - protein, 733 aa, Pseudomonas avellanae
MWSQGWTSLRDAQEWAIPALIEADRDVIIAASTAAGKTEAAFLPILTNLLNSADPPGAVLYISPLKALINDQWDRLTRLCERLEIPVVGWHGDVSASKKHKFLKSPSGILLITPESLEALFVNRGSALAGLFQNLRYIVIDELHAFIGSERGKQLQSLMHRVESVANRKLPRVGLSATLGEMALAREFLRPGQTRRMDEIISRASGQDLQVQVRGYTMLPLKKLLASEQAATAKDDDDEEDASGTRHAIAAHLYKVLRGSNNLIFPNSRDKVEWYADRLRRLCENDGLPNEFLPHHGSLSRDLREDTERALKAGTPPASAVCTTTLELGIDIGNIRAVAQIGPPPSVASLRQRLGRSGRREGEPATLRAYCQESTLTPESGLSDQLRQDLVQTIAMIRLLIEKWFEPPRANGLHASTLVQQCLSMIAQQGGASAAELWTSLVASGTFAAINKADFMTLLKALGEKKLIVQDSSGLLLPGEIGEKLVNHYEFYSAFTTDEEFRLVRDGKPLGSVPVSRPLTLGQRIIFGGRRWQVLDVDLEKKVIVVMPARGGEPPVFDGLGAKIHDRVRQEMRAVLTESSPCPFIDANAQALLEEARQTFHRLGLADQYLTGSASTSYLLSWAGDYTNDALCLLLNQSGVMCSGSGLVLEIGASRESALAALGRIAELDANDVEPLLKDVKNLIREKWDWALPKSLLIKSFASSQLDIPGAIALAKALVLHERDAVLTDPPST

SEQ ID NO: 13658 - protein, 727 aa, Actinobacillus ureae; identical to SEQ ID NO: 12473

SEQ ID NO: 13659 - protein, 731 aa, Haemophilus haemolyticus; identical to SEQ ID NO: 12515

SEQ ID NO: 13660 - protein, 823 aa, Haemophilus haemolyticus; identical to SEQ ID NO: 12514

SEQ ID NO: 13661 - protein, 750 aa, Parabacteroides merdae; identical to SEQ ID NO: 12325

SEQ ID NO: 13662 - protein, 741 aa, Parabacteroides merdae; identical to SEQ ID NO: 12697

SEQ ID NO: 13663 - protein, 712 aa, Dethiosulfovibrio peptidovorans; identical to SEQ ID NO: 12418

SEQ ID NO: 13664 - protein, 911 aa, Lautropia mirabilis; identical to SEQ ID NO: 12468

SEQ ID NO: 13665 - protein, 763 aa, Aggregatibacter aphrophilus; identical to SEQ ID NO: 12552

SEQ ID NO: 13666 - protein, 763 aa, Aggregatibacter aphrophilus; identical to SEQ ID NO: 12529

SEQ ID NO: 13667 - protein, 733 aa, Pseudomonas syringae group; identical to SEQ ID NO: 12494

SEQ ID NO: 13668 - protein, 813 aa, Pasteurella bettyae; identical to SEQ ID NO: 12624

SEQ ID NO: 13669 - protein, 743 aa, Candidatus Arthromitus sp. SFB-mouse; identical to SEQ ID NO: 12061

SEQ ID NO: 13670 - protein, 719 aa, Bacteroides; identical to SEQ ID NO: 12673

SEQ ID NO: 13671 - protein, 742 aa, Desulfitobacterium hafniense; identical to SEQ ID NO: 12573

SEQ ID NO: 13672 - protein, 731 aa, Prevotella dentalis; identical to SEQ ID NO: 11956

SEQ ID NO: 13673 - protein, 714 aa, Parabacteroides distasonis; identical to SEQ ID NO: 12696

SEQ ID NO: 13674 - protein, 773 aa, Porphyromonas gingivalis; identical to SEQ ID NO: 12635

SEQ ID NO: 13675 - protein, 984 aa, Oxalobacter formigenes; identical to SEQ ID NO: 12375

SEQ ID NO: 13676 - protein, 845 aa, Fusobacterium nucleatum; identical to SEQ ID NO: 12593

SEQ ID NO: 13677 - protein, 918 aa, Faecalibacterium prausnitzii; identical to SEQ ID NO: 12328

SEQ ID NO: 13678 - protein, 764 aa, Xanthomonas; identical to SEQ ID NO: 11542

SEQ ID NO: 13679 - protein, 720 aa, Bacteroides salyersiae; identical to SEQ ID NO: 12992

SEQ ID NO: 13680 - protein, 803 aa, Bacteroidales; identical to SEQ ID NO: 12993

SEQ ID NO: 13681 - protein, 918 aa, Faecalibacterium prausnitzii; identical to SEQ ID NO: 12452

SEQ ID NO: 13682 - protein, 858 aa, Fusobacterium varium; identical to SEQ ID NO: 12384

SEQ ID NO: 13683 - protein, 733 aa, Fusobacterium necrophorum; identical to SEQ ID NO: 12625

SEQ ID NO: 13684 - protein, 943 aa, Schaalia cardiffensis; identical to SEQ ID NO: 12965

SEQ ID NO: 13685 - protein, 879 aa, endosymbiont of Riftia pachyptila; identical to SEQ ID NO: 12521

SEQ ID NO: 13686 - protein, 848 aa, endosymbiont of Riftia pachyptila; identical to SEQ ID NO: 12520

SEQ ID NO: 13687 - protein, 861 aa, Fusobacterium ulcerans; identical to SEQ ID NO: 12459

SEQ ID NO: 13688 - protein, 989 aa, Actinomyces graevenitzii; identical to SEQ ID NO: 12588

SEQ ID NO: 13689 - protein, 732 aa, Xanthomonas vesicatoria; identical to SEQ ID NO: 12486

SEQ ID NO: 13690 - protein, 852 aa, Eubacterium  infirmum; identical to SEQ ID NO: 12594

SEQ ID NO: 13691 - protein, 654 aa, Desulfovibrio piger; identical to SEQ ID NO: 12353

SEQ ID NO: 13692 - protein, 775 aa, Paenibacillus curdlanolyticus; identical to SEQ ID NO: 12449

SEQ ID NO: 13693 - protein, 842 aa, Holdemania filiformis; identical to SEQ ID NO: 12356

SEQ ID NO: 13694 - protein, 996 aa, Vibrio mediterranei; identical to SEQ ID NO: 12319

SEQ ID NO: 13695 - protein, 703 aa, Coleofasciculus chthonoplastes; identical to SEQ ID NO: 12347

SEQ ID NO: 13696 - protein, 862 aa, Halorubrum coriense
MAFEQYISHPAKTDDGESTLLIGKGGRFDDDGHLRTVADRMVEACLGQTLADGTPAEPVAEVIGLTHDIAKLTRWTQKYLRGEPFQHSDEYRYHAFPGALVTLYCLLECCDDVGDHAAEVATLVVAGHHDTQSPPGPSKLAENYGRTTVGVRETYERVDDQFGEIDDEVPDRADRIIRAATDGAGSWDDFRQWHDNRAEPIDGAHDHLIYFARMGKSDARVGYYGDVVRLWTALKLADQTAASGLEDDDIGGTLPDREALDQHVDGLDEGEGILADLNSLRDRARKDATENVEALVESDDVGLITLPTGFGKTYAGLSAGLRAADLSDSRLVYVLPYTSILDQTASEIKSVFGVSPYSKSFTLHHHLSNTYTGLGDNYTDADIGRSPGALHAESWLSGLTLTTTVQLFESLAAPTARQATRVPSLRESVVVIDEPQAIPENWWQIVPALIEFLANTYDATVILMTATQPGLVEYGSDELTTRELTDDTDQYTDFLADHPRVTYRLHDTIRTDRGDEYATLDYPTAGGRISDAAGDERHVLAVCNTRSSAEELYRYVTPMGGAEENEPVELGRLLHDYVDESGELPSPVELRKLALGTVANQDADTVYAFLSGDVRPDDRQLLIDALYDDDAGDGDDPIPLLDGDNSVVLVSTSVVEAGVDVSFDTVFRDYAPIPNIVQSGGRCNRSFGGETGDVVVWRLAEPEDGNAVPSLVIHGGDAGDALPLLRETGRVLRRHAEDGCIDESTMVSDTVAEFYGSLFGGVLEPGDERLADAVSSASMSDLEGEHMIEEIEDYDDVVACFTDEERADLLGGDLEAGGIVRHPGAQVNTDPAAWTEEVTIGNSRYLLVDALDTSYHPVFGVR

SEQ ID NO: 13697 - protein, 820 aa, Acetobacter pomorum; identical to SEQ ID NO: 12489

SEQ ID NO: 13698 - protein, 986 aa, Natrialba chahannaoensis; identical to SEQ ID NO: 12783

SEQ ID NO: 13699 - protein, 906 aa, Natrialba chahannaoensis; identical to SEQ ID NO: 12782

SEQ ID NO: 13700 - protein, 434 aa, Treponema vincentii; identical to SEQ ID NO: 12391

SEQ ID NO: 13701 - protein, 752 aa, Selenomonas sputigena; identical to SEQ ID NO: 11820

SEQ ID NO: 13702 - protein, 762 aa, Mannheimia haemolytica; identical to SEQ ID NO: 11977

SEQ ID NO: 13703 - protein, 762 aa, Mannheimia haemolytica; identical to SEQ ID NO: 11998

SEQ ID NO: 13704 - protein, 762 aa, Mannheimia haemolytica; identical to SEQ ID NO: 12403

SEQ ID NO: 13705 - protein, 825 aa, Paenibacillus popilliae; identical to SEQ ID NO: 13280

SEQ ID NO: 13706 - protein, 809 aa, Parascardovia denticolens
MLARRDQSGRTQTLQSHLSGAAALSGAFEGEFSSLARLAAFLHDAGKASKNFQDYLLSDDGIRGSVIHAWQGAFMINDLDAQNGYAKIAQQLLELVISKHHGELPDCVNQDGMESFFDNFSAENKQGEKYSYNEVKRNLNDLQPQISRLFLEATDKIGSFWTKMSEIRNAQGNQLSGESKFFYLGLLAKYIYSRLVDADRTDAASFESRTTYQPKIVQWEELISKLDKKMSGFDSTTSINAIRSKISQACRQASDRKTGIYKLAVPTGGGKTLASLNFAMRHAQKQGKRRIIYVIPYLSITTQTSQTFRDMLDLSENNDLILEHYSSAMNETIEEITKERTDEEKEEESAKSKKRKLVAEQWDNPIIVTTMVQFLETIMSARGTNLRKFHNMAESVIIFDEIQSLPTDTINLFNEIVSFLSEILDSTILLCSATQPLLEQTNRDNLCLASEPNLIKLNEHDLGLFKRTNIVASTKDKDCDELAEFAFDRARENGNCLIIVNLKSKAKNIYRALRKLDEDKQFDLIHLSTSMCGKHRKDKLNHIRNSSKSSEAKPIICVSTQLIEAGVDISFSCVVRAMAGLDSILQAAGRCNRNGESPTPKNVYVFPVKDEKGLSYLPDIKLGKELMSQLIREYPDEDLLSDAMLTEYYRRYFARLQPDDRKQFSKMDYPLKGFHTSAYDLLARNRMWRGTYKNRRGADFPYYYAQAFKTVSDNFHLIPGAACNVIVPYGDSGELLELLSVSDMDTRYKALHNLQDYTISLFEWEEQSLRESHAIDLVDDTFEIYVLDQEYYNEEYGLAVEAPMPLQMY

SEQ ID NO: 13707 - protein, 814 aa, Parascardovia denticolens; identical to SEQ ID NO: 12428

SEQ ID NO: 13708 - protein, 814 aa, Parascardovia denticolens; identical to SEQ ID NO: 12633

SEQ ID NO: 13709 - protein, 930 aa, Fannyhessea vaginae; identical to SEQ ID NO: 12490

SEQ ID NO: 13710 - protein, 722 aa, Caldisalinibacter kiritimatiensis; identical to SEQ ID NO: 12994

SEQ ID NO: 13711 - protein, 827 aa, Anoxybacillus flavithermus; identical to SEQ ID NO: 13282

SEQ ID NO: 13712 - protein, 958 aa, Streptomyces tsukubensis
MRSVWAKHDRDTEGWLPLWRHMADSAAVAGLLWDHWLPANVRKLVGDALPGGADDARLLTVWLAAVHDIGKATPAFACQVEGLAATMGQHGLTMKTRAQLRNDRLLAPHGLAGQVLLEEWLEERQGWPAKRCGQFGVVVGGHHGTPPQHGQLTDLYDRPHLLRTPGPSAGLWGRVQDELLDACADEYGVRERLDAWRSVALPQPVQVLLGSVVIVADWIASNPDLFPYFPEETRSGEERIAAAWRGLRLPPPWRAKEPEHEAQELFAARFDLPPGAAVRPVQEAAVRLAREMPVPGLMIVEAPMGEGKTEAALAVAEIFGARSGAGGLFFALPTMATGNAMFPRLLRWLDRLPHPTGVPRSVLLAHAKSALNDTYAELLRDGRQQRIAAVDMDADETDWRPSDKRRHAPAELVAHAWLRGRKKAMLSSFVAGTVDQLLFAGLKSRHLVLRHLAVAGKVVVIDEAHAYDTYMSVYLDRVLSWLGAYRVPVVVLSATLPAGRRRQLAAAYGGTAEDSYEEVAAATAYPLLTAVAPGGAPIVGRPPASSRGGHVVLEPIDDELPALADRLTAELGLDNNDKNDNDGGCVLVVRNTVRRVVETAHALRERFGADAVTVAHSCFVDLDRAAKDADLLDRFGPPETAAGRRPRGAHIVVASQVAEQSLDVDFDLLVTDLCPVDLMLQRMGRLHRHHRGEGQSERPRRLRTARCLVTGADWTAQVPAPVRGSVAVYGEYALLRSAAVLLPHLREPRRPVRLPQDISPLVQGAYGDETGALPEGWAEALESARERYEKHRADQSERASVFRLGAAERPGRSLVGWVAAGAGDADDTRAGRAQVRDSRESLEVVVVQRRADGKLVTLPWLAGGRGGLELPRDRVPVPRAARAAAGCGLRLPMAFSPAEVMDRAITELEELYVPAWQSKESPWLAGQLILALDEDCQTRLAGFSLRYSRTDGLEVTRD

SEQ ID NO: 13713 - protein, 796 aa, Clostridium  methylpentosum; identical to SEQ ID NO: 12357

SEQ ID NO: 13714 - protein, 946 aa, Slackia exigua; identical to SEQ ID NO: 12406

SEQ ID NO: 13715 - protein, 805 aa, delta proteobacterium NaphS2; identical to SEQ ID NO: 12443

SEQ ID NO: 13716 - protein, 688 aa, Natrinema versiforme; identical to SEQ ID NO: 12778

SEQ ID NO: 13717 - protein, 805 aa, Clostridium  hylemonae; identical to SEQ ID NO: 12363

SEQ ID NO: 13718 - protein, 817 aa, endosymbiont of Tevnia jerichonana; identical to SEQ ID NO: 12523

SEQ ID NO: 13719 - protein, 684 aa, Mesotoga infera; identical to SEQ ID NO: 12230

SEQ ID NO: 13720 - protein, 956 aa, Austwickia chelonae
MPAVQGWSDSALSLWGKLSREEGLSLPLVTHLEDAAAVAGHLWDHWLPDIVKLRVQAELQGDARLARSLVMWLAGVHDLGKAAPAFVGKARPAGADHVIRHIESHGLLCPEVPRDDYAHHGVMGQVLLEEWLLKRHPSRRDSVRSLAVVIGGHHGMPPTAETLQAVRANRLPRRQSRAWGDAAWDAVRAEILTGMAARHDLDEVFAALPSSGLPVPVQVDLSAVVIIADWFASDESRFPYVTLEGGDARRAEALAELVLPPPWSPALPDLGDPEKLMQQRFPHLAAYPIRPMQRAVIAAAAAAEEAPLIVVEAAMGQGKTEAALQAAEILAARFGCGGVFVALPTMATSDAMFTRVLTWLRHLPGGVDTSVFLAHSKSGLNDDYRELLRDRYARFAEVYDEHGSGRPARDTGSLTPVADAWLQGRKRGVLANHVIGTIDQVLFGGLQSKHLALRHLALSGKVVVVDEVHAADVYMRSFLCLVLDWLGAYEVPVVLLSATLPSAQRRQLVEAYVRGRHGRALGRSAAIEFPAPATYPCLTVATRSVATVAVEDGSASMRVGLSSLPDDKLVDVLRDELVDGGCAAVIHDTVGRAQETYAALSAEFGADVHLVHSRFIGPDRMRLEKQIRSMLGPPGGAAGRPQRCIVVGTQVLEQSLDVDFDVMISDIAPIDLVLQRAGRLHRHRRPERDRPPGLRRPRLLLAGVEGFGEGDGPPSFDRGCVAVYGEYRLLRSMAVLAPYLDGARQVSLPEDIPVLVGAGYDDDVPPPTGWSPKWEKARSDDEARHAASVAKAPVFQVKPARSERFLASWSASPVRAEGDDLDRCGRGQVRDSEDSLEVVLLCRGDDGLLHLLPGLPECSGAALPGVLGRSDDLVARVAASCTVRLPRAVVHPGVIDQAISELEQVPEVAGWQDNRWLSGQLVLPLDASLRASLCGASIRYDRVLGLLVSSKNSDRK

SEQ ID NO: 13721 - protein, 928 aa, Xenococcus sp. PCC 7305; identical to SEQ ID NO: 12769

SEQ ID NO: 13722 - protein, 782 aa, Desulfallas gibsoniae; identical to SEQ ID NO: 11988

SEQ ID NO: 13723 - protein, 733 aa, Desulfallas gibsoniae; identical to SEQ ID NO: 11989

SEQ ID NO: 13724 - protein, 759 aa, Gloeocapsa sp. PCC 73106; identical to SEQ ID NO: 12768

SEQ ID NO: 13725 - protein, 865 aa, Frankia sp. EUN1f; identical to SEQ ID NO: 12416

SEQ ID NO: 13726 - protein, 938 aa, Veillonella seminalis; identical to SEQ ID NO: 12752

SEQ ID NO: 13727 - protein, 855 aa, Anaerostipes caccae; identical to SEQ ID NO: 12332

SEQ ID NO: 13728 - protein, 786 aa, Thermoanaerobacter siderophilus; identical to SEQ ID NO: 12634

SEQ ID NO: 13729 - protein, 765 aa, Thermanaerovibrio velox; identical to SEQ ID NO: 12584

SEQ ID NO: 13730 - protein, 939 aa, Kineosphaera limosa
MYAPGEPWSANTAAIWGKTGDGDTWLPLWRHLEDSAAVAGLLWDRWLPGSVKALIADSLSGGCSDGRVLVSWLAGIHDIGKATPAFQIKAPQMLDPLHRLGFDLDVPRSESSKAPHGALGYVILREWLATQRSGPASIRARIALSVVVGAHHGVLPDTHTMKALQDRPDYLGGPLWREAQNEILQRMAVRTGAAERLADWLATPLSATAQAALAATVVVADWLASDETRFPYLDRITEGARWGDLRLPTPWRPGPPPRDAAELLAQRFPALAGFSPTPIQHAAVEAAWTAVRPPLIVLEAEMGSGKTEAGLAAAEVLAHRFGQGGVFVALPTMATSDAMFGRVRDWIDQLPGPGSLSMFLAHGKAGLNDAYRGLVDDQRCVGIYDEEPGPREEGERAVATVNSWTRGRRKGVLAPFVVGTIDQVLFGALRSKHLALRHVALAGKVVVIDEVHAADTYMREYLTSILTWMGAYGTPVILMSATLPSGQREQLVAAYAAGAARTHGQLPRPSEAPETLEPHGYPRTMMLDSAVREVPTEQVAGRPRAVHLEEHPDELDHLVTLLRAELIDGGCVAIVRSTVTRAQEAWVALRGAFSDTEVVLVHSRFLAVDRARRESELRDRLGRSGRRSEGTRPNRLIVVGTQVLEQSLDIDVDLMVSDVAPVDLVLQRMGRLHRHQRELEDRPPRLREPRLILVGADWATTPPEADRGSRRVYGDALLLRSVASLRAHGSLIQLPEDIPRLVDHAYDPDLPAPVGWEERWARAEAQFLSRAEEARSRANDFRLEAPFTHEGLLARSGFFRKGDPDDGNGGRNQVRDSDDSLEVVVVRRVDGAIRAMPGAALASDTVLATDQPPEPRIARALAGCTIRLPAWSTVRDPDALIRALESTSFVGWQQDCPWLAGQLTLVLDEHGHAQVADLDLAYDDERGLVVRMRPASRQW

SEQ ID NO: 13731 - protein, 724 aa, Pseudoramibacter alactolyticus; identical to SEQ ID NO: 12463

SEQ ID NO: 13732 - protein, 693 aa, Halobiforma nitratireducens; identical to SEQ ID NO: 12799

SEQ ID NO: 13733 - protein, 825 aa, Paenibacillus dendritiformis; identical to SEQ ID NO: 12602

SEQ ID NO: 13734 - protein, 443 aa, Ureaplasma parvum; identical to SEQ ID NO: 11529

SEQ ID NO: 13735 - protein, 804 aa, Selenomonas infelix; identical to SEQ ID NO: 12558

SEQ ID NO: 13736 - protein, 803 aa, Selenomonas noxia; identical to SEQ ID NO: 12425

SEQ ID NO: 13737 - protein, 803 aa, Selenomonas noxia; identical to SEQ ID NO: 12559

SEQ ID NO: 13738 - protein, 849 aa, Lactobacillus iners; identical to SEQ ID NO: 12453

SEQ ID NO: 13739 - protein, 848 aa, Hungatella hathewayi; identical to SEQ ID NO: 12561

SEQ ID NO: 13740 - protein, 751 aa, Thiorhodospira sibirica; identical to SEQ ID NO: 12548

SEQ ID NO: 13741 - protein, 793 aa, Thiorhodospira sibirica; identical to SEQ ID NO: 12546

SEQ ID NO: 13742 - protein, 894 aa, Synechococcus sp. WH 8016; identical to SEQ ID NO: 12549

SEQ ID NO: 13743 - protein, 715 aa, Marvinbryantia formatexigens; identical to SEQ ID NO: 12388

SEQ ID NO: 13744 - protein, 727 aa, Thermaerobacter subterraneus; identical to SEQ ID NO: 12723

SEQ ID NO: 13745 - protein, 755 aa, Salinisphaera shabanensis; identical to SEQ ID NO: 13195

SEQ ID NO: 13746 - protein, 905 aa, Caldithrix abyssi; identical to SEQ ID NO: 12590

SEQ ID NO: 13747 - protein, 724 aa, Desulfotignum phosphitoxidans; identical to SEQ ID NO: 12935

SEQ ID NO: 13748 - protein, 747 aa, Cardiobacterium valvarum; identical to SEQ ID NO: 12587

SEQ ID NO: 13749 - protein, 983 aa, Actinobaculum massiliense; identical to SEQ ID NO: 12754

SEQ ID NO: 13750 - protein, 891 aa, Roseomonas cervicalis; identical to SEQ ID NO: 12433

SEQ ID NO: 13751 - protein, 821 aa, Thiorhodococcus drewsii; identical to SEQ ID NO: 12517

SEQ ID NO: 13752 - protein, 786 aa, Methanotorris formicicus; identical to SEQ ID NO: 12598

SEQ ID NO: 13753 - protein, 808 aa, Paenibacillus lactis; identical to SEQ ID NO: 12551

SEQ ID NO: 13754 - protein, 728 aa, Paenibacillus lactis; identical to SEQ ID NO: 12550

SEQ ID NO: 13755 - protein, 867 aa, Haloarcula californiae; identical to SEQ ID NO: 12797

SEQ ID NO: 13756 - protein, 802 aa, Fictibacillus macauensis; identical to SEQ ID NO: 12632

SEQ ID NO: 13757 - protein, 786 aa, Candidatus Jettenia caeni; identical to SEQ ID NO: 13278

SEQ ID NO: 13758 - protein, 797 aa, Candidatus Jettenia caeni; identical to SEQ ID NO: 13279

SEQ ID NO: 13759 - protein, 711 aa, Pseudomonas syringae group genomosp. 3; identical to SEQ ID NO: 12498

SEQ ID NO: 13760 - protein, 961 aa, Gluconobacter thailandicus; identical to SEQ ID NO: 13281

SEQ ID NO: 13761 - protein, 791 aa, Thermosinus carboxydivorans; identical to SEQ ID NO: 12314

SEQ ID NO: 13762 - protein, 802 aa, Crocosphaera watsonii; identical to SEQ ID NO: 12566

SEQ ID NO: 13763 - protein, 762 aa, Marinobacter sp. ELB17; identical to SEQ ID NO: 12318

SEQ ID NO: 13764 - protein, 794 aa, Kamptonema; identical to SEQ ID NO: 12113

SEQ ID NO: 13765 - protein, 757 aa, Opitutaceae bacterium TAV1; identical to SEQ ID NO: 12631

SEQ ID NO: 13766 - protein, 772 aa, Porphyromonas uenonis; identical to SEQ ID NO: 12368

SEQ ID NO: 13767 - protein, 437 aa, Prevotella multiformis; identical to SEQ ID NO: 12483

SEQ ID NO: 13768 - protein, 726 aa, Oceaniovalibus guishaninsula; identical to SEQ ID NO: 12678

SEQ ID NO: 13769 - protein, 596 aa, Candidatus Arthromitus sp. SFB-2; identical to SEQ ID NO: 12608

SEQ ID NO: 13770 - protein, 831 aa, Photobacterium marinum; identical to SEQ ID NO: 12766

SEQ ID NO: 13771 - protein, 765 aa, Caminibacter mediatlanticus; identical to SEQ ID NO: 12320

SEQ ID NO: 13772 - protein, 720 aa, Bacteroides salyersiae; identical to SEQ ID NO: 12636

SEQ ID NO: 13773 - protein, 957 aa, Streptomyces zinciresistens; identical to SEQ ID NO: 12525

SEQ ID NO: 13774 - protein, 791 aa, Caldalkalibacillus thermarum; identical to SEQ ID NO: 12503

SEQ ID NO: 13775 - protein, 743 aa, Caldalkalibacillus thermarum; identical to SEQ ID NO: 12502

SEQ ID NO: 13776 - protein, 782 aa, Haemophilus sputorum; identical to SEQ ID NO: 12654

SEQ ID NO: 13777 - protein, 495 aa, Sulfurihydrogenibium yellowstonense; identical to SEQ ID NO: 12378

SEQ ID NO: 13778 - protein, 713 aa, Prevotella multisaccharivorax; identical to SEQ ID NO: 12508

SEQ ID NO: 13779 - protein, 925 aa, Lachnoanaerobaculum sp. OBRC5-5; identical to SEQ ID NO: 12669

SEQ ID NO: 13780 - protein, 739 aa, Parabacteroides goldsteinii; identical to SEQ ID NO: 12695

SEQ ID NO: 13781 - protein, 712 aa, Enterocloster asparagiformis; identical to SEQ ID NO: 12361

SEQ ID NO: 13782 - protein, 650 aa, Halococcus thailandensis; identical to SEQ ID NO: 12800

SEQ ID NO: 13783 - protein, 742 aa, Paraburkholderia hospita
MSWQASGSTESRSFDLLDERIRRWIWREGWTELRDAQERAVPALIDADRDVIIAAATAAGKTEAAFLPILSNLLRDTPCSGSVLYVSPLKALINDQWSRLDNLCDALEIPVTGWHGDVSSGRKHRFIKKPTGVLLITPESLEAMFVTRGASLEATFGALRYVVVDELHAFIGSERGMQLQSLMRRVDRACGRKVPRVGLSATLGDMRLAAEFLRPRAAQDVQIIESGSAGQELKILIKGYVEKPPRIQFEPGIENPGLEDVVPASTVDVANHMYKVLRGSNNLIFPNSRRQVELYADLLRRACERDGYPNEFWPHHGSLSKELREQTEQALKAGDRPASAVCTTTLELGIDIGAVKSVVQVGAPPSVASLRQRLGRSGRRKGEAAILRCYCVEAELHSGSDLSDRLRESLVQSVAMVNLLLRGWFEPPRARGMHPSTLVQQILSIIAERGGANAGELWDTLVAKGPFGTIDKPTFAAILRSLGAKDLLVQEAGGLLLHGVAGERLVNHYEFYASFSTDDEFRIVAGARVLGSVPVSRPLAPGQGLVFGGQRWRVQDVDAGKKTVYVTPDQGGVPPVFDGGGSLVHDEVRREMFNVLKDGAPVVFLDTTGRELLEEARRYFASNELATRSVFTHGGSAVLATWSGDWINDALVVLLRAERLDAWNQGPTISVRVAGSVKDTLQRIAALTPAQTTDALRAIGNIDNEKWDWTLPDDVKRNAYASLRLDMPGAQALARRLATACE

SEQ ID NO: 13784 - protein, 810 aa, Brevibacillus sp. CF112; identical to SEQ ID NO: 12641

SEQ ID NO: 13785 - protein, 597 aa, Cronobacter malonaticus; identical to SEQ ID NO: 12151

SEQ ID NO: 13786 - protein, 597 aa, Cronobacter malonaticus; identical to SEQ ID NO: 12152

SEQ ID NO: 13787 - protein, 718 aa, Enterocloster citroniae; identical to SEQ ID NO: 12556

SEQ ID NO: 13788 - protein, 876 aa, Haladaptatus paucihalophilus; identical to SEQ ID NO: 12471

SEQ ID NO: 13789 - protein, 728 aa, Aciduliprofundum boonei; identical to SEQ ID NO: 12349

SEQ ID NO: 13790 - protein, 890 aa, Streptococcus ictaluri; identical to SEQ ID NO: 12563

SEQ ID NO: 13791 - protein, 365 aa, Streptococcus ictaluri; identical to SEQ ID NO: 12562

SEQ ID NO: 13792 - protein, 822 aa, Haloferax prahovense; identical to SEQ ID NO: 12787

SEQ ID NO: 13793 - protein, 875 aa, Natronorubrum sulfidifaciens; identical to SEQ ID NO: 12777

SEQ ID NO: 13794 - protein, 739 aa, Rhodanobacter sp. 115
MAASQAFLQLDPRIQRYLWAEGWGALRDVQEQAIPLILPGNQDVLVAASTASGKTEAAFLPALTHLLGQPDEGLIVYISPLKALINDQFGRLDRLCENLGIPVWPWHGDVTSTSKRKFMQKPTGVLLITPESLEATLCNRGTSIAALFKRMTFFVIDELHAFIGTERGKQLQALMHRIEIVLGRTVPRIGLSATLGDMGLAARFLRSSCPVAIVDATSTGSQLLILVKGFEEHPTTGETSNKSKLEAERAPLAIAQHMFKILRGSNNLVFPNSRREVERYTHLLNGLCEQAQVPKEFWPHHGNLSKEIRYETEAALKQRERSATAVCTSTLELGIDIGAVKSVAQIGTPPSVASLRQRLGRSGRREGEPAILRGYVIEDALDERASLETRLRLDTVQTAAAISLLLENWFEPPAVHGEHYSTLVQQLLSSIAQYGGLQAAHAFRLLCTPPGPFERVSKDAFAELLRTLGQKEILTQDHAGLLLHGRVGDKIVNHYSFYAAFTSDEEFRIVSGGKALGTLPVSQIMTPGQRILFGGRTWLIEAIDEEHKTIHVASAKGGTPPLFDGSGGRVHTRVRQRMRDIYVAQDALPFLDTTAQRFLGEGRKTFATLALADRLLLDHGSQAILLTWLGDATNEAIACLLMSHGIQAFTGRLGVEIHRAGHSLQEIKNLLADIASRPVAPVDELLTKAGNLVHQKWDGLLSPHLLRQSYASSNLELDEALDWLQATFKSRSYQVSSDT

SEQ ID NO: 13795 - protein, 734 aa, Limnobacter sp. MED105
MSGNSTSFYLLDERIQRFIWADGWEELRDAQEAAIPLILNADKDVIIAAATAAGKTEAAFFPALTHLLQDSPGEGLIVYISPLKALINDQFGRLDRLCENLEIPVWPWHGDISSTSKTKFVAKRHGVLLITPESLEALLCNRGSSIASIFKNIRYFIVDELHAFIGSERGKQLQSLMHRIEHALGRTVSRVGLSATLGDMRLAADFLRPGKGQGVAMVESKSSGNELKLLIKGYEEPLVIRVPGQEDEEPEPITPVQIGNHLFKVLRGSNNLVFPNSRREVERYTHLLNKLCEHNQVPNEFWPHHGSLSKEIRAETEAALKQKEMPASAICTNTLELGIDIGSVKSVVQIGPPPAVACLRQRLGRSGRRKGEPAILRGYCVEEEIGQNSSLSDLLRLGTVQTTAMVQLLLENWFEPPRTGGLHLSTLVQQILSSIAQTGGATAGELYGLLCSSNTPFLGITKAEFVDLLRGLGTKDLVVQDSSGSLLHGQLGEKFVNHYSFYAAFAADEEFRIVAGGRQLGTIPVAVMLTPGQRILFAGKTWRVDQIDEELKTIYVTRTSGGAPPLFSGGAGRTHTRVRQKMRDLLESSDMPVFLDETAKRFLKQARDAYSRIGLDSKLLIDQGQETQLMTWLGDGANEAIACLLTHRGFIATAAGPGVEVHKGSRSAQEILKVLAELGINQLPPLEILLTNAKNLQREKWDWALPDNLIRKAYASLYLELDEALRWVRALSVG

SEQ ID NO: 13796 - protein, 405 aa, Enterococcus sp. GMD5E; identical to SEQ ID NO: 12728

SEQ ID NO: 13797 - protein, 568 aa, Hydrogenivirga sp. 128-5-R1-1; identical to SEQ ID NO: 12331

SEQ ID NO: 13798 - protein, 773 aa, Hydrogenivirga sp. 128-5-R1-1; identical to SEQ ID NO: 12330

SEQ ID NO: 13799 - protein, 985 aa, Wohlfahrtiimonas chitiniclastica; identical to SEQ ID NO: 12774

SEQ ID NO: 13800 - protein, 845 aa, Haloferax mucosum; identical to SEQ ID NO: 12792

SEQ ID NO: 13801 - protein, 862 aa, Haloferax elongans; identical to SEQ ID NO: 12790

SEQ ID NO: 13802 - protein, 727 aa, Maritimibacter alkaliphilus; identical to SEQ ID NO: 12308

SEQ ID NO: 13803 - protein, 883 aa, Burkholderia sp. SJ98
MQTEATKNDTCIAWGKRPRDGDEHSPFHPLCDHMLDVAACFMAIARCGRIRDALTSTAGRALSEQDIERLAALTYLHDVGKANSGFQAKRWKGPAPREWPQKAGHGSEALYAFSCDEALLAGLPIEAMSNWAGGVDELLHASLGHHGRPIPEPKGVDPLIWRPVRDASGHEIYRPANALKQIGDALRRHFPLAFASGGEPLPSTPSFVHLFAGLVQLADWLGSDTRFFEYSEPGSARTLQAALERASRAVGAIGLETSALRAQLIRDGFSFQSAFGIEAPHATQSALGEEGLGPLLVLESETGSGKTEAALWRFAKLFEAGKVDSLYFALPTRVAATQVYERVRKFVARLWPTYAPVTVRALPGYESADGNEKSALPDFKVLWSDHPDETKAHQRWAAESSKRFLAATIAVGTIDQALLAALQMRHAHLRHAALCRSLLVVDEVHASDTYMSQVLEQLLEAHRTTGGHALLLSATLGSSQRARFQSIANGGKHVSAPGIETAADAEYPALTDGTSIKKLRASGEPKTIHWQTLNAIDDHARVARLAFDAAKQGARVLIVRNTVPAAIATQKAVEALVNASGDRAWLFDIDGVPTLHHSRFSRQDRPRLDARVEERMGKIRNGVHACIVVGTQTLEQSLDIDADMLITDICPMDVLLQRIGRLHRHKREGKDRRPDGFERARAWVLIPESGSFEACLDAPRNGLGRLKNGGGVYPDLRMIEATRRLISEKPSRMIPLENRELVERATHPDCLRSIQQELDAAWEQQAQQLEGGKGAERTIARLHALPYDAAFAKLAFPEGEERIATRLGAVDKLVEFDPPELGPFGEDVRQIAMRFHMLPNGLDADATPISIIRRDDGGFEFDLGAARYSYRRFGVEKIGPRKS

SEQ ID NO: 13804 - protein, 717 aa, Rhodovulum sp. PH10; identical to SEQ ID NO: 12666

SEQ ID NO: 13805 - protein, 932 aa, Leptospira; identical to SEQ ID NO: 12714

SEQ ID NO: 13806 - protein, 758 aa, Leptospira; identical to SEQ ID NO: 12713

SEQ ID NO: 13807 - protein, 789 aa, Clostridium sp. L2-50; identical to SEQ ID NO: 12326

SEQ ID NO: 13808 - protein, 773 aa, Desulfotomaculum hydrothermale; identical to SEQ ID NO: 12219

SEQ ID NO: 13809 - protein, 580 aa, Rhodanobacter thiooxydans
MLFSALVDADFLDTERYMDPDKFASRNTWPPLGNLATLFDAHMAKLSISAAATPVNRLRADILRQCRAAAARDPGLFSLTVPTGGGKTLSGMAFALEHARLHGKRRIVHVIPYTSIIEQTADVFRDIFGEAVIEHHSNAESSPGDETAASRLACENWDAPIVVTTNVQFFESLFASRTSRCRKLHNIVDAVIVLDEAQLLPPEFLQPILDVLNLLTRHYGASVVLSTATQPALASRQYFDARQSLRGLDKVREIIAEPDALYAALERVTVQLPRDWHQATDWPKLAETLAAHDSVLAIVNTRNDARALWEAMPRGTLHLSALMCGAHRSQVIEDIKMRLKVGTTTRVVSTQLVEAGVDVDFPVVYRALAGLDSMAQAAGRCNREGRLDGKGKVVVLVPPKQAPPGLLRQGENASRDVLHDIPDVPFTRAKFAAYFERLYHGCQLDKAGICDKLFMANKKLSADDLAVEFRSAAECFKLIDDEDSLPIVVRYRGKNGQNGEIDGLLGRLKQDGPQRWLMRKLQRYTVSLRRGQALALLARGDIEGLLPGLYVQVSEWLYDPETGLNPEPILLRPQDTIWGN

SEQ ID NO: 13810 - protein, 924 aa, Halorubrum californiense; identical to SEQ ID NO: 12784
  misc_feature (864)..(864): Xaa can be any naturally occurring amino acid

SEQ ID NO: 13811 - protein, 949 aa, Lactobacillus equicursoris; identical to SEQ ID NO: 12158

SEQ ID NO: 13812 - protein, 427 aa, Lactobacillus gigeriorum; identical to SEQ ID NO: 12145

SEQ ID NO: 13813 - protein, 735 aa, Acidocella sp. MX-AZ02; identical to SEQ ID NO: 12694

SEQ ID NO: 13814 - protein, 918 aa, Mucilaginibacter paludis; identical to SEQ ID NO: 12600

SEQ ID NO: 13815 - protein, 810 aa, Jonquetella anthropi; identical to SEQ ID NO: 12400

SEQ ID NO: 13816 - protein, 796 aa, Jonquetella anthropi; identical to SEQ ID NO: 12585

SEQ ID NO: 13817 - protein, 926 aa, Streptococcus sp. C150; identical to SEQ ID NO: 12472

SEQ ID NO: 13818 - protein, 857 aa, Megamonas funiformis; identical to SEQ ID NO: 12603

SEQ ID NO: 13819 - protein, 894 aa, Prevotella maculosa; identical to SEQ ID NO: 12592

SEQ ID NO: 13820 - protein, 881 aa, Haloferax; identical to SEQ ID NO: 12785

SEQ ID NO: 13821 - protein, 847 aa, Haloferax
MTGVADVGQQLVENAGENPYGDDWSAVIETLAWTHDIGKLTEYFQTYLEHKTRTLAPTEELTYHGTFGGFVTAWALAVRGMSRQTTAAGFYAVAKHHSVLPNMRSDFADFCLDRPYVDQQYELAQTQLDSIDDTAAEAADVVIRQATNGAFGWDDYTAKGLETVRTTLNDIRKSGLDAEFYGCALRAWSTLVAADKADASGLGDSPQLRTTPRPDSRALDAVVSSLSDTELPDGTSASAYLDVPQRPLPDENWHYSDRLAALRTAANGRATSTLLERHAAGDRVFELTLPTGFGKTFSGLRAGLKLADKLDSRVIYALPYTSIIDQVDEEVQKVFGVSPLNPEYTVHHHLADTRTSLSGTDDPSSGRDTLHAESWRSGLVLTTFTQLFESLAGPGNVQSMKLPALQDSVIIVDEPQAISLDWWGLVGRVTQHLSEEYNATTVLMTATQPRLLTHLPNAPTPTPLVDMHTTCTGLLRDAPRVQFDLHDSLTEYLDGTDATPLSLVDAAEAIDTNLGSSTNELAIVNTVSCATALSESLLDGRLALGSELLEYLRSTDGEEFNAAAYLQHLATRHPDAEGVVASLTTRLRPVDRRALLQCLDLILDDETTTPFDDVPTVTVSTQLIEAGVDLSFDRLYRDYGPLPSMVQAAGRCNRRFGGPTASVTVWRLDSPADDNYVPSQLIYGDRSLLRPSKVALGELRYGDGSVISEQDMLTTGVETYYEALHTQRDTADRADDLVTAFDRAQGKKLRNESVVSQDYPTQDVFVLVSGNDMEAHDAYARHRKDEKWSSARSAFHSLKPTLVSVPVDEESDEKTPLVIRVDEDSQDYDLETGGGVDLSGRIDALEK

SEQ ID NO: 13822 - protein, 795 aa, Salimicrobium jeotgali; identical to SEQ ID NO: 12677

SEQ ID NO: 13823 - protein, 767 aa, Rhodopirellula europaea; identical to SEQ ID NO: 12802

SEQ ID NO: 13824 - protein, 746 aa, Rhodopirellula europaea; identical to SEQ ID NO: 12819

SEQ ID NO: 13825 - protein, 791 aa, Rhodopirellula sallentina; identical to SEQ ID NO: 12820

SEQ ID NO: 13826 - protein, 774 aa, Desulfovibrio sp. 3_1_syn3; identical to SEQ ID NO: 12448

SEQ ID NO: 13827 - protein, 819 aa, Eubacterium sp. 3_1_31; identical to SEQ ID NO: 12595

SEQ ID NO: 13828 - protein, 845 aa, Fusobacterium nucleatum; identical to SEQ ID NO: 12509

SEQ ID NO: 13829 - protein, 766 aa, Synergistes sp. 3_1_syn1; identical to SEQ ID NO: 12580

SEQ ID NO: 13830 - protein, 764 aa, Synergistaceae; identical to SEQ ID NO: 12579

SEQ ID NO: 13831 - protein, 728 aa, Clostridiales; identical to SEQ ID NO: 12380

SEQ ID NO: 13832 - protein, 719 aa, Bacteroides fragilis; identical to SEQ ID NO: 12405

SEQ ID NO: 13833 - protein, 801 aa, Fusobacterium gonidiaformans; identical to SEQ ID NO: 12457

SEQ ID NO: 13834 - protein, 735 aa, Fusobacterium gonidiaformans; identical to SEQ ID NO: 12458

SEQ ID NO: 13835 - protein, 894 aa, Halorubrum kocurii; identical to SEQ ID NO: 12801

SEQ ID NO: 13836 - protein, 721 aa, Desulfonatronospira thiodismutans; identical to SEQ ID NO: 12440

SEQ ID NO: 13837 - protein, 915 aa, Peptoniphilus duerdenii; identical to SEQ ID NO: 12450

SEQ ID NO: 13838 - protein, 814 aa, Nocardioides sp. SLBN-35; identical to SEQ ID NO: 12578

SEQ ID NO: 13839 - protein, 765 aa, Acidovorax sp. NO-1; identical to SEQ ID NO: 12577

SEQ ID NO: 13840 - protein, 769 aa, Caloramator australicus; identical to SEQ ID NO: 12148

SEQ ID NO: 13841 - protein, 717 aa, Caloramator australicus; identical to SEQ ID NO: 12149

SEQ ID NO: 13842 - protein, 590 aa, Ectothiorhodospira sp. PHS-1; identical to SEQ ID NO: 12601

SEQ ID NO: 13843 - protein, 851 aa, Lachnospiraceae bacterium 6_1_37FAA; identical to SEQ ID NO: 12484

SEQ ID NO: 13844 - protein, 713 aa, Clostridium sp. D5; identical to SEQ ID NO: 12479

SEQ ID NO: 13845 - protein, 710 aa, Indibacter alkaliphilus; identical to SEQ ID NO: 13014

SEQ ID NO: 13846 - protein, 778 aa, Thermoanaerobacter; identical to SEQ ID NO: 11626

SEQ ID NO: 13847 - protein, 1001 aa, Actinomyces sp. ICM39; identical to SEQ ID NO: 12642

SEQ ID NO: 13848 - protein, 795 aa, Nitritalea halalkaliphila; identical to SEQ ID NO: 12630

SEQ ID NO: 13849 - protein, 946 aa, Actinomyces sp. ICM58; identical to SEQ ID NO: 12643

SEQ ID NO: 13850 - protein, 809 aa, Clostridium sp. MSTE9; identical to SEQ ID NO: 12637

SEQ ID NO: 13851 - protein, 531 aa, Metallosphaera yellowstonensis; identical to SEQ ID NO: 12596

SEQ ID NO: 13852 - protein, 996 aa, Slackia sp. CM382; identical to SEQ ID NO: 12664

SEQ ID NO: 13853 - protein, 749 aa, Desulfovibrio sp. U5L; identical to SEQ ID NO: 12622

SEQ ID NO: 13854 - protein, 758 aa, Neisseria wadsworthii; identical to SEQ ID NO: 12547

SEQ ID NO: 13855 - protein, 595 aa, Neisseria shayeganii; identical to SEQ ID NO: 12540

SEQ ID NO: 13856 - protein, 423 aa, Bacteroides oleiciplenus; identical to SEQ ID NO: 12753

SEQ ID NO: 13857 - protein, 741 aa, Succinatimonas hippei; identical to SEQ ID NO: 12474

SEQ ID NO: 13858 - protein, 749 aa, Thiorhodovibrio sp. 970; identical to SEQ ID NO: 12616

SEQ ID NO: 13859 - protein, 910 aa, Pyramidobacter piscolens; identical to SEQ ID NO: 12413

SEQ ID NO: 13860 - protein, 823 aa, Pyramidobacter piscolens; identical to SEQ ID NO: 12414

SEQ ID NO: 13861 - protein, 739 aa, Clostridium sp. DL-VIII; identical to SEQ ID NO: 12565

SEQ ID NO: 13862 - protein, 744 aa, Desulfovibrio carbinoliphilus; identical to SEQ ID NO: 12571

SEQ ID NO: 13863 - protein, 811 aa, Cecembia lonarensis; identical to SEQ ID NO: 12674

SEQ ID NO: 13864 - protein, 714 aa, Cesiribacter andamanensis; identical to SEQ ID NO: 12933

SEQ ID NO: 13865 - protein, 769 aa, Acetomicrobium hydrogeniformans; identical to SEQ ID NO: 12420

SEQ ID NO: 13866 - protein, 756 aa, Lachnospiraceae bacterium oral taxon 500; identical to SEQ ID NO: 12493

SEQ ID NO: 13867 - protein, 787 aa, Lachnospiraceae bacterium oral taxon 500; identical to SEQ ID NO: 12492

SEQ ID NO: 13868 - protein, 613 aa, Lachnospiraceae bacterium 2_1_58FAA; identical to SEQ ID NO: 12507

SEQ ID NO: 13869 - protein, 807 aa, Lachnospiraceae bacterium 5_1_57FAA; identical to SEQ ID NO: 12506

SEQ ID NO: 13870 - protein, 712 aa, Lachnospiraceae bacterium 3_1_57FAA_CT1; identical to SEQ ID NO: 12505

SEQ ID NO: 13871 - protein, 752 aa, Anaerostipes hadrus; identical to SEQ ID NO: 12464

SEQ ID NO: 13872 - protein, 789 aa, Erysipelotrichaceae; identical to SEQ ID NO: 12451

SEQ ID NO: 13873 - protein, 746 aa, Fibrisoma limi; identical to SEQ ID NO: 12140

SEQ ID NO: 13874 - protein, 855 aa, Anaerostipes caccae; identical to SEQ ID NO: 12264

SEQ ID NO: 13875 - protein, 774 aa, Clostridiales; identical to SEQ ID NO: 12557

SEQ ID NO: 13876 - protein, 774 aa, Desulfovibrio sp. 6_1_46AFAA; identical to SEQ ID NO: 12522

SEQ ID NO: 13877 - protein, 743 aa, Eggerthella; identical to SEQ ID NO: 12466

SEQ ID NO: 13878 - protein, 623 aa, Klebsiella sp. 4_1_44FAA; identical to SEQ ID NO: 12583

SEQ ID NO: 13879 - protein, 833 aa, Neisseria; identical to SEQ ID NO: 12541

SEQ ID NO: 13880 - protein, 418 aa, Tannerella sp. 6_1_58FAA_CT1; identical to SEQ ID NO: 12277

SEQ ID NO: 13881 - protein, 922 aa, Peptoniphilus sp. oral taxon 836; identical to SEQ ID NO: 12444

SEQ ID NO: 13882 - protein, 725 aa, Anoxybacillus gonensis; identical to SEQ ID NO: 12818

SEQ ID NO: 13883 - protein, 924 aa, Megasphaera genomosp. type_1; identical to SEQ ID NO: 12421

SEQ ID NO: 13884 - protein, 742 aa, Lysinibacillus fusiformis; identical to SEQ ID NO: 12751

SEQ ID NO: 13885 - protein, 827 aa, Neisseria sp. oral taxon 020; identical to SEQ ID NO: 12758

SEQ ID NO: 13886 - protein, 778 aa, Porphyromonas sp. oral taxon 279; identical to SEQ ID NO: 12660

SEQ ID NO: 13887 - protein, 804 aa, Selenomonas sp. oral taxon 138; identical to SEQ ID NO: 12757

SEQ ID NO: 13888 - protein, 548 aa, Parvimonas sp. oral taxon 393; identical to SEQ ID NO: 12516

SEQ ID NO: 13889 - protein, 406 aa, Weissella ceti; identical to SEQ ID NO: 12759

SEQ ID NO: 13890 - protein, 1804 aa, Moraxella macacae
MKFKPMLNPLSKLSIDNNIDNKTIWLDLEINPNDETLLLGAFVVDLDFWVFDHKQLIAQKAEIIDLLNKSLYLGGHNVLEFDLPHLAKFLSVDDLVLKNWQQKCIDTLYFSSLLQPQKPTHALLKLYKAKKPANDPVLDCQESQKLWTTCQTAWQNLPSVLQQIFYRLLPNIQSLQNQGFVVSDEPFCLDDLTKFLPTGNHAKLLETIHLALKDFALDNLLVDNLFDNHWQHLGLCVFVNWLRFFDHPQARRPAWILHHALYQKSFQRAELAFWQMDQVTDDWLNEQFSYFFGFKNKNNTPATLRDGQLSIIRAVFLEKDVQLGVLPTGGGKSLTFQLPALILSRYQRQLTIIISPLKALIADQVINLKAGLQAVKLDNFIPRIAYLSSEQTYSTQKQILEQIWQGEIDILYLSPERLRTHAVRTLLKNRPPAFWVLDEAHTLSQWGADFRPDFLRIGKHILACYESQTRTKLEQKLTQTTDLFTQADDTDLAFIAPKISLVTATASAKVKDDLNQELITKLQPILNHKTLKQYGIPKNELSVWRDEIWPYFLHVNQDDKLSEITKLLKERQQAYRAKNISGNHEQGVALVYVRSRKKCKVYADHFNDLGFVAKAYHAKLSENEKQNILDDFKQDRLDVVVCTNAFGMGIDKAGIHTVIHNEPPNNLDSYVQEIGRCARKTGETGEAYLLWHEKDIEKLFHHERKSRIPNSKTLNDCWTIIKPTLSKNSDERWFCAQILQETLEQTESENLTTQVRVALLALERYGLLVEKEQQPAWISLKLLEINEQKPLVDSNLRQIYDALKPLTQTYHCHLHGEMSQTQLSQNSQIFSRFYLPELALLLGFSVKDLLAKLRKLVEFGAIQWEVMVKLRLLKNAQKTKQQFDKIDDDLQILTQIITQFSEQIQEEMDGSFLLNTQLLDAWLAQQQIVIKPTHILNLLAQFNLIRYRQHSKYQCKVASTQDTKLYLEAHDMQDNWQAWLILAKQCYQNLQPIFEYILPKLPDLPKQESKKDKKDKSTQVAESKTFVLQNLAQDNQLSADILLGYLEILQRLKLIEIGRLSDDNSALFFIDYNYEKNKRVRYDQTAYQYLQQHYEDRCQRIHVLNHWLTLDLANKRQMLEDYYRLSLTDLVARYFDDVELTKKPYLEDYKPKIIAKHFSDAQKAIITDASRANLVLAGAGSGKTTVVVHRVAYLLMIEQISPDKILVLAYNRLAVHEIRERLYNLVSFHADGVTIDTFHGLARQITGYTEKKFDDAMANDASLLQQICKRYPYLYKEKDNDKRRKNASYQWLLEQAVKELQDSPQYYQYIMVDEFQDIDTIQYDIIANLADLSESNDETDDENDENNSKAIEQQGYLMVVGDDDQNLYSFRGASVEFIQQFEQNYQLNEQQKHYLLHNYRSSDNIVALSNEFIIQALDANKRLKQNQHASIATSPYQNLPIRFGKFSQIYKNNEYAWDMAHWLAQDIQKTLQNLKQNQKIAVIAPRWHIFDAVQYYLEQLGIKGQRYNQDESGEFNPLNSVIGQALSQYLNQNPEEKILGQASAYLENWRVNANMNHLDTAWQMILQSCADIQDVTHDKLLSILQRTQYDNKTPVVLISYHSAKGLEFDYVYVIDFEKQSNRAKTQAEMDDYSRQLYVALTRAKRQLTVLQAQNCHQVLAENLNKFGEKIQIPNVPKPQYLQFHRYLQLNEMYLSNPNLVTEEGRKKIEQILCKATWGAQRTNSAGVFESKNFGFVAVDNTSVVLFSKKFKDQNTAQLEMMDFTTTLFFQGDIEKWYQEKASYFGDKKSHFVVVPYVKFLINLD

SEQ ID NO: 13891 - protein, 792 aa, Peptoanaerobacter stomatis; identical to SEQ ID NO: 12574

SEQ ID NO: 13892 - protein, 792 aa, Peptoanaerobacter stomatis; identical to SEQ ID NO: 12575

SEQ ID NO: 13893 - protein, 792 aa, Peptoanaerobacter stomatis; identical to SEQ ID NO: 12576

SEQ ID NO: 13894 - protein, 792 aa, Peptoanaerobacter stomatis; identical to SEQ ID NO: 12661

SEQ ID NO: 13895 - protein, 935 aa, Stomatobaculum longum; identical to SEQ ID NO: 12589

SEQ ID NO: 13896 - protein, 817 aa, Lactobacillus equicursoris; identical to SEQ ID NO: 12157

SEQ ID NO: 13897 - protein, 892 aa, Fulvivirga imtechensis; identical to SEQ ID NO: 12767

SEQ ID NO: 13898 - protein, 764 aa, Xanthomonas translucens; identical to SEQ ID NO: 12750

SEQ ID NO: 13899 - protein, 782 aa, Mogibacterium sp. CM50; identical to SEQ ID NO: 12662

SEQ ID NO: 13900 - protein, 783 aa, Selenomonas sp. CM52; identical to SEQ ID NO: 12663

SEQ ID NO: 13901 - protein, 925 aa, Lachnoanaerobaculum sp. ICM7; identical to SEQ ID NO: 12652

SEQ ID NO: 13902 - protein, 719 aa, Oxalobacteraceae bacterium IMCC9480; identical to SEQ ID NO: 12491

SEQ ID NO: 13903 - protein, 703 aa, Pseudomonas sp. TJI-51; identical to SEQ ID NO: 12480

SEQ ID NO: 13904 - protein, 1115 aa, Frankia sp. QA3
MGGAPVGGMPVSGATGWRRPATAVDALRVELAVPVASFRDPMFPGVSRCLPVPPPSTVRGMLAAATGRASETVPLGLAASATANGVDLETYHPIAADGSNPAIGGRVAPGKGGMTIRERPFLTGVQVTLWIPGAQGRRIEAALRRPVWGLRLGRSQDLVHLVGPPRWTVLHPAERAVVGHAVAPADGHAAPQAVSLRMAVAVSADRLSTDYRSFLWCADAAGTHAVHGAYRDDLDGQAVWLLDGDTTTDHEEPAASELGTVLAKSADRSPGGQPERLTAHSEAVRDAARAVAARIGPAGPIAAEPRFWEWAERAALLHDTGKVAEGFQRQVRPGGEAWGERHEVLSLAYVDLFDPETAASQAAGSRAATDRLMAATGVLFHHRALTSNQAPRRTSEEPLTYRYLDDTDWRRRFGQSTDDDVRQGKPRIQIPRQRHAELLAWLADQLALTPDPSARGKLWERARALFLATRDHWIDPVPERDGLLAVLLQGAVTLADHAGSAHVPLQTHMPLPRRFLDRIPAPYDHQRAAAAAEGHLIVLAPTGSGKTEAGLAWASVRLDGMPGQPRLVWVLPYRASIDAAADRFRDDLDPPPSHDPPPSHEAPPSHEAPPGHDPSSGHGEPRPGPGERSNPVRPDIGILHATAARTLLERAVAEDCAPPAEAALKARARAGAMRLFAQRVRVATPHQLLRAAIAGPRYSSVLLEQTNCLIVLDELHAYDPVTFGRICAAMRLWSQLGSQVAVLSATLAKPMIELVQDSLDGSVEVVRAAPGTAPDRHRLVLANEPITAPTSLDAVRRWLAEGRSVLVVANTVRTAQQLYADLVPAARAASRDIDGKADPDAAVLLHSRFKARDRAAIERRILARHPERQPGDPARRAGGLVVSTQALEVSLCLDFDRGASELAPIEAVAQRAGRVNRRGRHPDGPVEFRVHPVEKHLPYEEEALVAAWSALRSTADTGPTISEQTVAAWLDHVYATDWGRRWAATARQHRDAFSTSFFTFRRPFDDRSEFAQGLAEQFDTVHVLHRDDLAEYRELADRDHGDPLLAEGLLIPIGFHQYLRLAKAGRAEVHRSLRLATVDAPYSAETGLDLTVLDDENARADDRSGIRPDFLDTVL

SEQ ID NO: 13905 - protein, 1005 aa, Pauljensenia hongkongensis; identical to SEQ ID NO: 12469

SEQ ID NO: 13906 - protein, 789 aa, Prevotella sp. oral taxon 473; identical to SEQ ID NO: 12755

SEQ ID NO: 13907 - protein, 925 aa, Lachnospiraceae bacterium oral taxon 082; identical to SEQ ID NO: 12591

SEQ ID NO: 13908 - protein, 759 aa, Nitrobacter sp. Nb-311A; identical to SEQ ID NO: 12309

SEQ ID NO: 13909 - protein, 723 aa, Pseudooceanicola batsensis; identical to SEQ ID NO: 12307

SEQ ID NO: 13910 - protein, 1028 aa, Marinomonas sp. MED121
MNRVSDNSWKYLPVIKSLTAMAALLHDWGKASLLFQQKLDPEIKTKFKGDPIRHEWISCILFKVFVTNSAKEGSDEEWLSTLISDGIKDADFQQKGLENIDKPLVALPTAASLIAWLIVSHHRLPLPRDRHLCDQQRDKKNASLSDLLNRMTQAWGYENPSEIYNVLLPKCFKFPEGLLSESEQWITQLKLQAEALRRQLPLVAEIMKNGSWRVVLHHARLSLMLGDHYYSSQDKDKNWQSSIDLYANTNRETKALKQKLDEHLVNVAQTATTTASLLPYFESNPLKVKGLAALSVQSDTPRSFRWQDNAVMSLVNWRARTKDKSQGYFVVNMASTGSGKTIANAKIMQAVSEDQQSLRFILALGLRTLTLQTGDEYRNRLNLEKSDLAVLIGSKAVFELHKSGNNLDKDEGCFEGANQGSESLESLQDESDVLHWQGVLPEDKLSTVLTKEKDRKLLHAPVLACTIDHIMAATETKRGGRYILPCLRLMSSDLVIDEIDDFSGDDLIAIGRLVHLAGMLGRKVMISSATISPDLALGFYNAYQQGWNVFAASREQSSKINCVYVDEFNTQCELVESGSKEIVQFQTFQHHFIEKRVNELKQQTPKRKADIIPCNRVEGADLGEQYFEHVKQAILIKHSQHSTIDNQSQIRVSFGVVRIANIRPCMELTQHLLGCEWPDEIEIRCMAYHSQQVLLLRHEQEKHLDQVLKRKEKAGETPAAFSDPIIRQHLSSCHSNNIIFILVATPVEEVGRDHDFDWAIIEPSSYRSIIQMAGRVRRHREGPIEQANVGLLQYNYRGYQDKEERVFNRPGYETDRATQLISHDIKQLLDEKSLLHSLDAVPRIQKHQNLDPNSSLADLEHFATARTLGIADINKEQSLIKQKQGRFNRRVRAGESQSFWSNHLQGHLVGYWWLTALPQYFKRFRKSEPSVQLYLIKKEGVTAFHQRDDHGGYNPIELIFNIKHHPMDDRQESRLWLRREYSALVSQYSQSEEGEFITSLKFGEINFTDRGEQGEYSYNDQFGLVRTR

SEQ ID NO: 13911 - protein, 977 aa, Pseudoalteromonas tunicata; identical to SEQ ID NO: 12310

SEQ ID NO: 13912 - protein, 787 aa, Rubrivivax benzoatilyticus; identical to SEQ ID NO: 12501

SEQ ID NO: 13913 - protein, 746 aa, Ferroplasma acidarmanus; identical to SEQ ID NO: 11995

SEQ ID NO: 13914 - protein, 803 aa, Ferroplasma acidarmanus; identical to SEQ ID NO: 11996

SEQ ID NO: 13915 - protein, 661 aa, Clostridioides difficile; identical to SEQ ID NO: 12099

SEQ ID NO: 13916 - protein, 802 aa, Clostridioides difficile; identical to SEQ ID NO: 12097

SEQ ID NO: 13917 - protein, 773 aa, Clostridioides difficile; identical to SEQ ID NO: 12098

SEQ ID NO: 13918 - protein, 784 aa, Clostridioides difficile; identical to SEQ ID NO: 12177

SEQ ID NO: 13919 - protein, 802 aa, Clostridioides difficile; identical to SEQ ID NO: 12207

SEQ ID NO: 13920 - protein, 773 aa, Clostridioides difficile; identical to SEQ ID NO: 12208

SEQ ID NO: 13921 - protein, 841 aa, Clostridioides difficile; identical to SEQ ID NO: 12185

SEQ ID NO: 13922 - protein, 802 aa, Clostridioides difficile; identical to SEQ ID NO: 13061

SEQ ID NO: 13923 - protein, 773 aa, Clostridioides difficile
MLYAKSNPVETLREHTDELLKQMNVLRESYGKNINSLDFLEEEIFWQLLDFVIEFHDIGKAFSPFQELIKSRMDTKINEPKIVTHLENNVGHNYLSPAFIDYSYIDRKKNKELRAVLNQVIVYHHERDIFIDKDFKNLIQKILDEDLINKVYELQHEFKVRYPIKTERLSKVYLQSVEKRIDKNHKYYNLYIMLKGILHRLDHSASAHEVVECNNVINIGEQTENYLMKEFGNLREAQSFAKSNRNKNIILIASTGMGKTETALIWIDKDKAFFTLPLRVSINALFDRAKNIVGVGESNDTFLGLLHSTAIDYLEESNQENSSEIVDLAKLLSCKLTFSTIDQIFKFPFLYRGYEKVYSTLAYSKVVIDEIQAYSPEIAAVLVKGIEMIHKIGGRFMIMTATMPTIYIDELKKRGVMNSNLAELTCNTEKIRHCVSIVENSIDENLGKIIQSGMNKKVLVIVNTVKSAVEKYELIEEIVKPKGIDVNLNLLHSMYIQEDRAKLEKYIKEFANSDRNGIWITTQLVEASLDIDFDELHTENSTLDSLFQRFGRCYRSREYEENSPNIFIYTEKATGIGSIYDKDIVEKGLELLKTFINGKECVKMKEKYKVEMVKILYSKESLEGTAFEKRFTSALNILDTITPYSLGSKDAQNILRNIEGYTVIPEDIYNKIEETLIKDYEELGQELINAYSNDDRQLINKIKSKRKKARREIIKKTVNLPIYKAKQNVIDIQVKGLEDLKILLYKYDIYENKHTKQIFGKGVLISNEIDQFI

SEQ ID NO: 13924 - protein, 684 aa, Clostridioides difficile
MNLSEEDKLYIYKSIMLHHGNYEDYMRLSTSKVQEEIYEYIEKGILEKEEFNLKDIESYINDILNVDFKFGEDVLDYDYIDKLSESMFIDSDYNNGQIEDSVLNYRKFKYILYKGMLNLIDHSASSRQKGIKFYNDFTDEEIDNMILDEIYKSQGNLEKNNIEFNTIQKRLRELSGRNVLTVAFTGSGKTAADYRKTFKRKFFLVPNKISAESFYRKNIFQNKNDLNTRNSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDVDFHLMTATLPKSYKEQMINKGIIFQEESNENVTDKGEIAFIESNKEENICEGKDVKVSFIKEKEIKSIVEGALENKQKILIIKNTIDSVNRTYEFLKENLSDKYSGVDIDVLHSRFKFKDKKEKYSKILNGKGDIWISTQSVEISLDLDFNIIISDLATMDSLIQRMGRCNRNNKYEYGNFYILPSEDKIYDNKLKNTTKSILNNVIKTNSIFTMGIRKTILDDYYDNSVVKKYFEDNFISCDKEIKNIYGINKEIFDGLDLIFNFEPYKNIVDSKKEAAKIFRDVDVSYKIILEEDFYKEDRELQQDSIQVSGFIFNRLYYYRLISKVEGYMVLKSSSKFEYNSTVGLILK

SEQ ID NO: 13925 - protein, 503 aa, Listeria monocytogenes
MKIIVVIAETGMGKTEAGLLWLGNNKGFFTLPLRAAINAIYERITKNIVTTNQAERVGLLHSETYSQYLLHEGNAEMDIDEYYTRTRQMSLPITICTLDQLFDFVFRYAGFEHKLATLSYSKVIIDEIQMYSSDLLAYLILGLSYIDKFGGKFCIMTATLPGIVTDLLLENGVDFVQPEDKFVSSRIRHSMEMVHTEIESEFIKPFFNNNRILVICNTISKAKKIYSELKEHFQGEEIHLIHSQFIKKDRSAKEDAIFKDGQKDSTKKCIWVATQVVEASLDIDFDLLFTELSDVNGLFQRMGRCYRNRALDVDTNVYVFDGGAKVCSGIGTFIDKLIFENSKTILNEHAGVLTEEKKMELVERVYSTEALRGSEFYNDLRKTINYVKAFDSYELDKADVRRRFRNINSVSVIPEEVWQDNVEEINSYFAILRKTSKEISTKEKMIARTNLAEFMVSIPDYLYKKGESVVREINRYESVIEFKCGYSDEIGIIMYEKQEDLFF

SEQ ID NO: 13926 - protein, 774 aa, Ruminococcus flavefaciens
MFAAHISTDMKREQSVIEHCRNTAELCAGYCKLFGAENIGRLSGLLHDIGKLCTDFDNYIRGTSGFSRGEVDHSYAGAKYITGNTDKARSGVARLIARVIISHHGIHDWVDENCRDYFHIRIANDKNYDQIKENLSQIISDDEFDEFLKKADDEYRAICQKIKNISKNKTDCAFYLGSLERLIESALVDADRTDTASFMDNEEYPEFPGNTELWHSMKSNMEKKLDSFSDRTDVISKQRKSISDRCADFAKNNVKICRLIVPTGGGKTLSSLRFAIEYCLEHGMEKIFYTAPFMSILEQNSEEIKGIAGDDNFIEHHSDALAEKSDNSEELSAYELHTERWDKPVIATTMVQLLNALFLGKTSSVRRFHRLAKSVIIIDEVQSIPLKCVNMFDLAVNFLSNICGAAIVLCTATQPVTDDVRFPMLMDEKESMTGDFTADFELFRRTEIIPEIDEYGYSYEEAADFCIEKFTSSGDLLVIVNTKSSALKMYELIKEKCGDDVEVVHLSTNMCPQHRRDKIEAIRGLLNEKKPVICVTTQLIEAGVDISFRCVVRSLAGLDSAVQAAGRCNRHGENKDKCPVYLIKLKEEKLGNLKEISTAQDITQRIIDNKKNEDISLPDVVSDYFRELYDIEKNDLSYSVPENETLVNYLSLNTNRYEMLPDPKTCSQFESQAFKTAGKLFKVIDENTRDVIVPYNNEAEEIVSRLENGHENISLLLRKAQKYTVSIYIGTERKLYENNALRDISCGAVILDRIHYNDEVGIDIEGAEKELLIF

SEQ ID NO: 13927 - protein, 740 aa, Ruminococcus flavefaciens
MDVFDRYAPFVQDFIYRNNWESLRAIQAAAGEAIFNTDENVLLSASTASGKTEAAFFPILTLFSEDMPKSVGAIYIGPLKALINDQFMRLNELCEEADIPVWHWHGDVSQSHKSKMMKNPSGILQITPESLEAMLMRKHSAIQKLFGDLRFIVIDEVHSLMRGDRGGQTLCLIERLSRLAGVNPRRIGLSATIGDLEATGEFLASGTGRGTVIPKIQQKGVKWRLSMEHFYIAQDKADSDENNDDSAHAIDDKTDTAPEYADQGMGYIFEHTKGKKCLIFVNSREECEAVTTTLRSYCEARNEPDRFLIHHGNLSAAYRETAEAAMKDEDIYMTTCTTATLELGIDIGRLERAFQIDAPFTVSSFLQRMGRTGRRELPPEMWFVIREELPEPRSMLPETVPWKLLQGIALIQVYLEERWVEPPKLDRLPFSLLYHQTMSTLASNGELTPRQLASQVLSLKYFHRISQEDYKVLLRHLIETEHIQQTEEGGLIVGLAGERMVNSFKFYAVFQENEEYTVRWGSQELGTIVMPPPVGEKIAIAGHVWIVEEVDHKRRLIYCEQIKGKVPAYFGDCPGDINTKILLRMRQVLREDRSYPYLMKNAVTRLDRARQSARNSCITDSPIVCLGGDMWALFPWLGTYAFFAVERFLKLRCADRLGLRGLDSYRPYYIQFTMKVSPDEFIRILKEEAEVEFSPMELVYQGEVPVFEKYDEYLPEELVKKGFAYGILGIDEMKAWIRSL

SEQ ID NO: 13928 - protein, 548 aa, Saccharolobus solfataricus; identical to SEQ ID NO: 11711

SEQ ID NO: 13929 - protein, 501 aa, Saccharolobus solfataricus
MLSLADFYNDFITRHGFEERKGIEETLLNLENGHSVILKAPTGYGKTTLTMILANAVSSDIDLGSRVIHVLPYRAIVQDLYLKLKNYADRGVIYTKNIGAQDMDYQDSPFFMKKVNVTTLDTFILNLFKLPTVDFKLIFKNYGSHYEFPRALIYSSIVIFDEFHLLGEDGKSLGAGLAALEVLRDAGVPIVVTSATIDKGLERVLMNKLGKNVKVVNADDFKIDRKIYVNVLENDEISITEEKVKEGKRVLLVYNTRMGAIEAYKKLKGRGLSPILIHSKFSKKDRIDKVNKINEAKLVVSTQVIEAGIDTSFDVLITEASPSHNLIQRAGRVARYGKGGRGKLEGEVYIFPFSGKVYDEREVKETVERVRELKTIDENLLIERDYTEVIDSILAKDLSVIDNSVFVDSKKVKSIYEKICSITRNASIILGFPPNSNDVNDAIPLTEEEAIKIIESKGSSAFVGNGNVKLYNKKCLQLEMLKNDILGVRIQDYNSEIGGVY

SEQ ID NO: 13930 - protein, 807 aa, Streptomyces clavuligerus
MAPGALTNPPPRASLNDVRAKSTPAEDRERLTTHSRTVHAAVGLIEDRIANAGVLADSPAFWSQVRRAALLHDAGKIAEGFQRQVEPRGIPWGERHEVLSLAYADLLAGAAAWSEDDLTMVATLVATHHRALHNDGGTGHGGKPALSRIYNKETDWEEAFGTSVEDVDGRPVVQVPRFLHRELLAWFCGFLAVDPPSTRPGDPSLAQRARHLLQRLLDTWHHPVRPHRGLLAVLAQGALTLADRSGSAHIGLQTHMPLPYDYLARLPYHPHSHQRQAAETLGHLTLVAPTGSGKTEAGLAWAATQIGTMPGRPRVVWTLPYRASLNAIRRRLSEDLIPVPGERKADIGLLHGTVAQTLLADGLDDDCPGREPNTPPTADQARKARAQAGAMRLFTQRVRVATPHQLLSGAIAGPAYSSVLLEQANCVFVLDELHAYEPRTFGRLCAAMRLWERLGSRFAVLSATLAEVMIRIIEESVEQPVTVHRSPEGSGPVRHRLTLDELPIDAPESVQRIRDWLNEGHSVLAVVNTVARAQELFGQLADDARAARPGDPHAALLLHSRFRNGDRDTIERALLRRHPERRPGDGALRGGLVVATQAVEVSLQLDFDRAAVECAPVEAVAQRAGRVNRRGLHPDGPVEFRVHRVDGPRPYDPDAMDAAWAALRGLVADGATALSEQDIDELLRRAYATEWGKGWEEQARAARDAFAARFLTFTDPFHDRSEFARELSEAFDSTEVLHHDDAEEYRALTRGKAGDPLLASRLLIPLRLGQLRQFDCSFDPYLKVNMTDSAYDPTLGLQPPAARETIL

SEQ ID NO: 13931 - protein, 647 aa, Gemmata obscuriglobus
MLGAVGSHHLKFGDQSFAPDDGTGAAVRVLFDHDDFRRDLVSLTAARLQLSGAPAIPAPRYWGFGGGTTTFDPTELREGLRDGRLRRLSRAPDQRMLNAVRAALIAADAAGSGLPRTGRRIDWIGGQFPETPGCDSVTVAGVIDRRIADLTSRNKWVHWNEFQNQCETLSARALLLAPCGAGKTLAAWRWIAGRVKQRPVNRVLFLYPTRATATEGFKDYVSWAPEADAALMHGTAGYDLNGMFAVEDPRAKKAFTTTDPRLFALQHWPKRIVSATVDQFFGFMAYGYGPMCLLPVLADSVIVVDEVHSFDRSMFSALLGFLSAFDVPVLCMTATLPEPRQKQLVAAGLTLSNPRPDDLKTIADTPRYRVARVNEREVEDRIRAAVGSGKRRVLWVVNQVSRAQAIAARLTDLSLSPICYHSRFKLDDRVKRHQETVKAIRAGEPAAVAVTTQVCEMSLDIDADLLVTEACPITSLIQRMGRCRRGRDEVTSKGPGEVLIYAPAKERVYSSDDLAGLDGFISFLIGLPSPASQADLEIGLDRFGPKGADAPKLNSFLASGAYAEASEDSFRDIEAFNVSAVLASEVGAYVTAAESKDCMTRAKAPGFVVPVPRKLRPVQDPRLPHYLFAADDRHYDPQTGYWDYPIC

SEQ ID NO: 13932 - protein, 715 aa, Streptomyces globisporus
MARVFAERFGAEDVAGYLALVHDVGKGCCAWQDRLIFHAEPTGKPVGIPHKEAGTVLAARTVGRQLAAVVQGHHGGLPDQDKIKDLLAELRGSGVEADRAREATEAVARVVPEILREGRIPPPAWLAGLESPQRQALALDVFTRMVFSCVVDADYLDTEAHFAGREPRTGARADMGMLLKRFEQRRLRLLARRTASPVDELRERVYAQALAAAAGAPGMYVLHVPTGGAKTIAAGGFALRHAVEHGLGRVVFAVPYISITQQNAEVYRELLDPAPDSGEQPVVLEHHSSVELEEEDGAGAWARMAAENWAAPVVVTTTVQLFQSLFARKPSVMRKLHRLAGSVIVLDEVQALPDRLLIPILSVLRDLVEHFGASVVLTSATQPSFWSLAQLDGLPRRSMIEDVTGLFEELRRVEYDWRLGPDVTWESIAQEIASEGGEQVLTIVNTTRDSARLHRLLNSTEGEARVTAPVWHLSTRMTAEHRREVIEHVRGELTVGRPVHVVSTSLIEAGVDVDFPRVYRAWAPAEALQQAAGRCNRDGRLGRGRVVVFRPVDGGVPKDLSYTAALEATAEFFGPGGASAPDDLEALEWYYEKRWALQGTDGRSMGEGIQQLRRVWDFPAVAEAFQMVDNKYAQSVVVIRAEKADEERDAIESDIALLRSSYPVGPEPLRRLQPHMATLPRHEVAMALQAGLAKPVIGDLVVWRGYYDPVRGLSG

SEQ ID NO: 13933 - protein, 706 aa, Clostridium cellulovorans
MMFENYYDIIGFKKPREIQKEIKNVLKNKKENVLVISGCGSGKTEVGHYALLNWNGIRSIFVEPMKTLATSIQERLNEYNKILNINEKWTIQHSGIEEDKYLENKFCVTTIDQVLSGWLGIGRQSFIRGKNIVQSNFVFDEVQLFQPDKALLTTINFLDSINSQGNKFLIMTATMPKYLIDFLLERYNMKLIEAYEETIADREIYVNYSSKVDYLQINSRTESQIVICNTQAQQEEVYNNIEDKSRCIILNSKLLKYDRSKIESKNLLEDDVSEKSLYKYFGKYAKKNNKILIATSIVEAGVDISANYLYSYACPIDNFIQRCGRCARWGGIGQVVIINSNDIVYDSKIVKKTIEFFADRPSLKFTWEIQKAVVTNILNPFYMDVINEINVRKNKYNLIDGSRGKLIRDIQNVNIIVDKDISFNSFKKQSISINISVLEKLSKNNALYVIDYGKNRNSPVQKKINDDIIGQTIVIQGNDCIYDELGFRYKEGSVCNTFQYDSNATDKYDKFNFDYKEESWINHATSVRALVKQKMLNDRFSSYVLENIDDISNVCGLHDIGKLDEQWQGPKWAGAKSILLAHFPFKKANTLIFKNRNHRAIGYIVLKNNLEDRILLNVVLQHHGRIISNNHDIIIDKFGLHKNSMLCLYEYGFYGGVVKEGNDNISYEEILTPKDTEWNNFLYIVGTLMESDIESINLFHNTKFLG

SEQ ID NO: 13934 - protein, 722 aa, Clostridium cellulovorans; identical to SEQ ID NO: 11760

SEQ ID NO: 13935 - protein, 912 aa, Verminephrobacter aporrectodeae
MAINETPSLPAGDGLLPVAGWIAWGKKPRHPSPGQPPAIHPLLDHQIDVASVFVALCATAGVRRALEAAAGRPLQATDVERLGAIAFLHDIGKANTGFQGCYWEHAERPRYWTVPKKPGHSAQGWALFTHSMAAAPRIREGLPLLQMNTWGDTWALLHASISHHGRPVTDIASESIWQPVHDGQNLIYDPAETVAAMGHCMQRIFPRAFAEHAPELPDKPEFVHLFAGLVQLADWLGSDTREGFHPYTRPGEDRSATAPERARHALRAVGLDVGDCAARVAATGFDFAQAFDVPTPRPMQLALADAGLGPVVVLEAETGSGKTEAALWRFLSLWRAGQVDALYFALPTRVAATQLYERVLAFVRRVWPRDPPVTVRALPGYPAADGQTATALPDFCVLWSDAPGADEAERRWAAESPKRCLAATIAVGTVDQALLSALQTRHAHLRLAMLARSLLVVDEVHASDAYMTRLLERLLRTHVAYGGQALLLSATLGASARSRYLAIGSGSSGAATLPSLDCALAKPYPAIGHGSAAGPVLRPVQGNPRHKLVHWQTLDLIDEPQRIATLAVQACAAGARVLVVRNTVPAAIATLRAVEALAAEQGLDCLFKLAGTSTLHHSRFSRQDRPLLDAEVQAQIGKRRAPRGGLVVIGTQTLEQSLDIDADLLITDLCPMDVLLQRLGRLHRHARPSADAPGEQRPAGFEDPRAWVLTPPGDDLAPLLQRQRHGLGPIRIQGDSMAGVYVDLRVLEATRRLVMAEPTRHIPADNRMLVERATHPEALTAIAEEMGKSWENFGNKYKGALEATKTMANLHALSVEQALEDMRFPDEGRIGSRIGAADRIVSFDPPVPGPFGQAVAQLAIRHHLLAHALPTEAQVEDLKLLDEGKGFSFHLGTAQYSYSRLGLERIATNPDE

SEQ ID NO: 13936 - protein, 830 aa, Haemophilus sputorum
MNFNYIAHVRKADGQPQSLQTHLTETSEIAKLLAAKLDLEQEGELLGLMHDFGKYSHKFQKYIHDETGLFNPDLDDEESTPNGSKVDHSTAGAQWVYRELRKIGAEQGIGELFGQMLGLCIASHHGEGLIDCLDGEGNPKWIERFNKTDELTHLAECEQNADEVVQQKAHELAGENLIRNLLKAVKLILSDSTTNDKIKEFYLGCLTRFLFSCLIDADRINSSDFEREAQKEVRRLTEKPDWQMVIDQVEAKLAGFQNRYPIDEIRRRISSDCLKRAVDPQGIYTLTVPTGGGKTLASLRYALHHAQKHNLDRIIYIIPYTSIIDQNAQVVREILGEDWVLEHHSNLEPEKQSWQDKLLCENWDKPIVFTTMVQFLDAWFGGGTRGARHIHPMTNSVLIFDEIQTLPVKCVHLFCNVLNWLTKFGKSTAVLCTATQPLLGELGLQNFPEDKRGAITARGLLRLPENAEIMGKYQDLDKLFADLSRVEIRFNEKSGGWNVEEAGTFLLEQFQTTPSCLFIVNTKKWAQELYQYCQKQNVPPEALFHLSTHQCAAHRKAIFDTIKARLENKEPVICISTKLIEAGVDISMACVIRALGGLDSIAQAAGRCNRHKEVDKGLVYVLNLQETDFSQILPDIAVGKEKAATIFREFEEKDILQPKAMSRYFELYFYNRSDEMVYLINEKDKNDGLLHWLSDNCFNAGAKFKGYFKNDILRKRDLYPLLMQSFKSAGRIFQVIDAPTRSVIVPYGKGKEYITTLCGAWDVKEMSEAKKKAQSYSVNVFPKVWNKLQEKKALHETIKGSGIYYLDECHYNNEFGLSLDKISEMTCYIS

SEQ ID NO: 13937 - protein, 808 aa, Bacillus coahuilensis
MIYIAHIRESDGEIQTVRNHLVEVKELAENMGEKLGVKHIAGLAGMLHDVGKYSGEFQNYIIEAVENPENPPKRGSVDHSTAGGKLLYDLLHVTNIRQYTGILAEIVGNVIISHHSYLKDFFNSELESDYLKRVRDKELPQFELTKRIFFNQVISEEEFLAYVEKSSNELKLFLQKDSSKTSEFKFMFLTKMIFSILIDADRTNTRLFEENKQYIQQENSLLFSTYYNSLMKKIQAFNSNSHKISPINTLRNELSEQCDAFAEKSSGIYTLSIPTGGGKTFASLRYALKHAKLYDKKRIIYVVPYTTIIEQNAEEIRKILQDNENILEHHSNVVDDLDDNDEDQDGLMSRSQKLKYAKDNWDSPIIFTTMVQFLDVFYAKGSRNIRRLHNLCESVIIFDEVQKVPTHCVSLFNNALNFLKDYGQSSMILCTATQPALDFVEHKLSINNDAEIIEQIDDVVEKFKRTEIIDIATSESFTEDKLSKFIGEQLIKSKNILIILNTKKAVKRLYERLKETHLNVPIYHLSTSMCAAHRKTILEIVRAQLKEGKQLICISTQLIEAGVDISFECVIRSLAGLDSIAQAAGRCNRHGELEVGRVYVVDYCEENLDRLKEISVGKQISRKIFVDLNTDTTSYGGHVLSTKAMARYFQEYYLHFSADLNYYIPKFKKEMTNLLMGERRDNSYRKAFIHKFNIPDVQLFILNSYGSASEYFKVIDQVTTSVVVPYGQGIDIIAQLNSSNSIDDLGKIMKIAQQYSLNLFEHDKRKLIENKGLVPLLDGKIFALTEGAYNKEFGLDPENESGYVSAIY

SEQ ID NO: 13938 - protein, 354 aa, Bacillus coahuilensis
MWEPSKRSRLTWDGTLSSPQQEASDQVVRTIVSKGSLLVWAVCGAGKTEVTFKGIDRALMRGDRVCFATPRTDVVLELAPRLRRAFKGIEVAALYGGGEDMGKATQLVVTTTHQLYRFKQAYDTMIVDEIDAFPYSYDRSLQHAVQAARKSTSALIQLTATPSKHQIRTHPFIRIPARFHGYPLPLPEFKWCGNWQKSIEKERIPRVILQWVNQRLMDQTPIMLFFPSIKHMLAALPLFQQLNRHCLSVHAEDRERKEKVMKLREGRCPLLLTTTILERGVTISGVDVGVVGAEDDQFTESALVQIAGRVGRKKESPAGNVTFFHFGKSLAMERAYLHIDDMNNEGRRKGLLHP

SEQ ID NO: 13939 - protein, 534 aa, Pseudomonas amygdali
ADMLAPKPMDRLVCGDVGFGKTEVAMRAAFIAVHGGRQVAILVPTTLLAQQHYNSFRDRFADWPVTVEVMSRFKSAKEVSAAVADLAEGKIDIVIGTHKLLQDDVKIKNLGLVIIDEEHRFGVRQKEQLKALRSEVDILTLTATPIPRTLNMAVSGMRDLSIIATPPARRLSVRTFVMEQNKPTIKEALLRELLRGGQVYYLHNDVKTIEKCAADLAELVPEARIGIGHGQMRERELEQVMSDFYHKRFNVLIASTIIETGIDVPSANTIIIERADKFGLAQLHQLRGRVGRSHHQAYAYLLTPPRKQITPDAEKRLEAIANTQDLGAGFVLATNDLEIRGAGELLGDGQSGQIQAVGFTLYMEMLERAVKSIRKGEQPNLDQPLGGGPEINLRVPALIPEAYLPDVHTRLILYKRIANAADEEALKDLQVEMIDRFGLLPEPTKNLVRITLLKLHAEQLGIKKIDGGPQGGRIEFATETPVDPLTLIKLIQSQPNRYKFEGATLFKFLVPMERPEERFNTIEALLERLTPKTA

SEQ ID NO: 13940 - protein, 726 aa, Pseudomonas amygdali
MWSQGWTSLRDAQEWAIPALIDADRDVIIAASTAAGKTEAAFLPILTHLLNNTDAPGAVLYISPLKALINDQWDRLTRLCEHLEIPVVGWHGDVSASRKHRFLKSPSGVLLITPESLEALFVNRGSALAGLFQPLRYIVIDELHAFIGSERGKQLQSLMHRVETVVGKKLPRVGLSATLGEMALAREFLRPGQGQRMDEIISQTSGQDLQVQVRGYTMLPMKKLAANLQMVVTKDNDNDQDEEQKEDVSGTRHAIAAHMYKVLRGSNNLIFPNSRDKVEWYADRLRHLCENDGLPNEFLPHHGSLSRDLREDTERALKAGSPPASAVCTTTLELGIDIGNIKAVAQIGPPPSVASLRQRLGRSGRRAGEPATLRAYCQEDTLTPDSDLSDQLRQNLVQTIAMIRLLIEKWFEPPRANGLHASTLVQQCLSTIAQQGGAHASQLWNELIASGTFAAVDKNDFMALLKTLGEKKLIVQDSSGLLLPGEIGEKLINHYEFYSAFSSDEEFRLLLDGKPLGSIPVSRPLTLGQRIIFAGKRWQVMDVNLEKKVITVKRARGGEPPVFDGLGAKIHDRVRKEMRAVLTEVTPCPFLDANAQVLLAEARQTFHRLGLADQCLTGSTSNSYLLTWAGDYTNDALCLLLNQAGVMCTASGLVLEISASQESVLTALGRIAELDATDVEPLLKDVKNLIREKWDWALPNSLLIKSFASSQLDIPNAIALAKTLTA

SEQ ID NO: 13941 - protein, 725 aa, Sphingomonadales
MSTAFDKLARPIQKWIRQQGWKELRDIQARATHVLMDGNHDLIVAASTAGGKTEAAFLSLLSQVLDKPSEDSGFDVLYVAPLKALITDQARRLEDICRDTDLPITPWHGDVSSSVKAKATKRPRGVLLITPESLEALFIRRGLEIPKLFGATRAVILDELHSVLDSERGIQMRSLLTRLEIALKRPIRRVGLSATLGDMELAKAYLRPDSPDEVEQVIAEGGSAELQLQLRGYVAGDKDDESPSATDAISQHLFEHLRGSDNLVFGGARQAVEIYSDRLRALCEKEYLPQEFYPHHASLSREHRDFVERRLKDGTAPTTAICTSTLELGIDIGDVTCVGQIGAPFSVASLRQRLGRSGRRPGKPAILRQYAVEAKLTPTSNFSDRLRLGMVRAIAMIELLLEGWCEPPQREALHLSTLVHQILSVIAERGGIRAQQLYGILCQIGPFRQVDTQLFLDVLRALGQPEVALIEQASDGLLLLGANGEKLVEHYSFYAVFQTPEEYRLISGGKELGTLPIDNMIAPGMLLIFSGRRWLVQEVLDRDRVILVAPAKAGVPPIFGGDPGNIHDRVIERMFDVLEGQKRSIYLDATALELLDEARSNYTELQFVPGRIAQLSDNAAVIATKTGSVRTTTLALALRANGFTVQTHDGFLEVFGKDESPELIDALSALADGKEVDLFAHSPNLLFEKFHPHLTEDLLRRDALSSRLDAGCLSNLAASILGDQS

SEQ ID NO: 13942 - protein, 904 aa, Treponema primitia
MWGKPSNQNLTNFFKFFLTQHEFEVYYHHMAQIKNISSNANKILPLSSCLAKTLTLPDNKTIPGIDVFGHCIIVGEVTKLLVKYSIPQIRGKLFPPGVELVAAVHDLGKICPTFAEKLYRHTDNYQPNSLTGLENANPDLEKQWGYHSGLSQSSLSAFPKLPKYIPEIAGRHHGYSPDSTLPADSDYFGGKPWQKLRVKFVEKLKRYFGVDWPVVQNDTHAALLSGLTSVADWIGSGQAFDGFRHIEDITDLPNRVKSALDAAGFVPPLIRRGLSFMEIFRFEPNPIQARFIETISGPGVYVLEAPMGIGKTEAALYGAYKLLAARKASGIYFALPTRLTSEKIYERVNPFLLSILEETSPLRQALLIHGSAWLYETEMGEDAQPEASWFHAKKRSILAPFGVGTIDQALMAVMNVKHGFVRTFGLAGKVVILDEVHSYDSYTGTLMEKLVADLRNLGCTVIILSATLTGERRKELLGIKKGASLPAYPLISYHAEDEKNHHELLIQVSENVTVELNSIQHDDEAVNEALKRAEQGQQVLWIENTVAEAQDRFALLNCLAVERGVECGLIHSRFTKNDRDQHEKYWVTLFGKDAKDKRKEKGRILVGTQVLEQSLDIDADFLVTRLCPMDMLLQRIGRLWRHASNKKLRPGTARQEVWILSPGYEQVLENYKKELGKTAFVYAPYVLLRTLEVLKNHAPSLKLPEEIRPLVEAVYCNRKEDGLLVRLQWDLEKRREQLQGLARQGLSQGGRTLPESKAETRYSDQLTVDVLLLKDAKEEQNGKDKKILLVLSDGTSLELIKGLKNYNKKEWHRIAVLLNHHVVTVPEKRAPLPASPGVLDWFKEYIYIGNKEEEFLRVAIINKSENLVGLYNAIISKKYTLSYNSKIGYRSEEINPSKKEEEDW

SEQ ID NO: 13943 - protein, 390 aa, Treponema primitia
MNSEDSGFAGLGVSPFFMGRLKERSIFEPVEIQRRVIPRLIRGERVLFRSPTGTGKTFAYLIPLFQKLMENAESDAGVLILAPTYELCAQIKQEAEFLLSGAGSFKISLLIGATALSRQIDTLKKDKPRALVGNPGRVLQLAKMGKLRLGNLGFLVLDEADRLTADELYDETRELVSLIRGSPQTVACSATLPDKCRERLLPIMGEGVSVEETRANEILRDKIEHWAFYCEERDKIGLLRSFLAALRPKKALVFTARSAQVGNIVSKLQYHGIPALGLYGDMDKKMRKQAMDDFRRGRSSVLVASDLAARGLDIPDVTHIIALDTLQDPDAYIHRAGRTARAGKQGIMATFGDEGEMRNLVKLEKKLGIIVYPKELYAGKVQAPPPMDPE

SEQ ID NO: 13944 - protein, 741 aa, Treponema primitia
MDFIAHVRKLLNEQWAKPQSLNEHLQGTAELAAEFAKSFDSAEWAYVLGMSHDTGKGTVEWQRYICNKSGYDEEASSESPGRLEHSGAGAKLVEESFDRGTGRILSYCVAGHHAGLADYIGSPSALVNRLQQVKTDKIAEEFKFPLSSLKPQKSPWKFKPQELDASLWIRMLFSCLVDADRLDTENYMDSEKSASRKGYRSITELQQRFNNYMEGKAKSLGRNLRLYEARQRVLSDCRAAAVWQSGFFSLTVPTGGGKTLSSMAFALKHAEQYKKDRVIYVIPYTSIIEQNADVFREVFGDDELVEHHSSLAEEDSTIRGRLASENWDAPIIITTAVQFFESLFANKAGRCRKIHNIANSVIVLDEAQLIPTDFLAPILETLRLLVEHYRVSVVICTATKPALEKQQAFLQFPGLPKDSIREIIHDVPDLFGRLERVKVTMPPDQSTITEWKELSEELSAYKQVLCIVSDRKSCRELHALMPKGTYHLSALMCAQHRSDVIKKIKEKLAAGKAIRVISTQLVEAGVDIDFPVVYRAMAGLDSIAQAAGRCNREGKLNAADELGKVVVFNAPRKPPPGTLRKASETAQRMCKEGLNNPLDPSVFLPYFSELFWKSNSLDARGIMKYLVSSRFEFQFKSAAEQFKIIDDKNQMSVLVPYGEGGKFIDLLKNIKNGSSFENILLRKLQRYSVNVYNYQYTVLQGRGSLEKIVPGVFALTTTIEYDPTIGLLIDEMPNNPEDFII

SEQ ID NO: 13945 - protein, 809 aa, Kurthia massiliensis
MYIARIVEDGKGEFREQSLKNHLLGAEQLGKQYGQDIGFDKLTGLTAVLHDLGKYSEDFQVYIREAVYQPEKNVKRGSVPHAFAGGHFLFKNINYDLIDESKEDVERVLECMANAIYSHHGKLKDVVTPNEQSELYLKMIKEIPDYKEIESHFFNEIYDEKYMQEYIAAAVTQFYKGVDKLIDNIYEESNEEADEDELEAYTAFMTKFLFSTVLDADRTNSRCFEENVVEDIEKVDWVMFEKNLDNHLETLQKTAKKNNIMELRKKMSNECYEFGKEKTGIYTLSIPTGGGKTLASLRFAFQHAQKHQKKRIVYVVPFTTIIEQNAREVQSFLPENTVLEHHSNVVELNEDEEKDNVYDPQFIKWKIAKDNWEAPIIFTTMVQFLNTFYDGVARNTRRLHNLENSIVIFDEVQAIPVKCINMFNNALSFMKRTMNTTSILCTATQPALDYVTQSLHIEQEIIKDLPEITKAFKRTEIIPMVKENGWTTDELADFVEDTFSSSMLIILNTKTVTKKLYEVLLEKNLGVELYHLSTNMCAAHRIEIIKQVRENLKNNVHTICVSTQLIEAGVDVSFEAVVRSFAGLDSIAQAAGRCNRHGLQDVGNVYVINHAEENLEKLETILEGSRFSQHILKDIENDATLFDSNALSQKAIKHYFEKFYQKFNSFLDYPTSVGNLHDLLLKKRFINAKIAEKVIGCAAFKTVGNQFKVIDQQTTDILVPYGKGADLIADLTDSAYINDLTQFLKQTQQYTISVYTHTVKQLEKEQLILPVQFGSKNNIKLYILKDLAYNDIFGLDIEAQSIKDNNFMF

SEQ ID NO: 13946 - protein, 789 aa, Saccharopolyspora spinosa
MGESLTVHSDTTLGAAVAVADRVGRLRGVPDWFWHAVVLAALLHDFGKIDPGFQLQVRHPGSKKYAWRQRHEVLSLGAVGVLLPERSELRLWVAAAVATHHRPLINQHKPEREILEPHLAEEGEPLEGRFTVTDDRDVLRALLRWFAGRAAVHGLLHEVPDLAAVTAGDVLAAVGELLAELDTRWGLYPSTAQAPAAASPGLPLVLLQGAVTLADHVASAHGELLTTHPVDAFTTTFLRSLTAGADIVDGQRVLHTHQQHARAAKRAHLLLRAPTGSGKTEAGTMWAEEAVRQIAQLRGGRPRLLYVLPYLASINAMSDRFRAVCPGEVGVLHSKAGVYHLHRLGEDVDDAPARALEAVDATRLHRQLMRVTTPYQLLRAAFAGVTDSATLLDSANSVFLFDELHAYEPRRLGMILAMMRLWSHDLGGRIGVLSATLPDRFAGLLEDTLGHDTVEEIDGFATTTAPPRHRLKLGDEHLTSPNTFERIADDLQDGHAVLVVANNIADAITIYEQLRDLAPARDEAGIPAAWLLHARFENGDRARVETEITKWFASTGAAPRPGLLVATQAAEVSLDVDLTVLHTSGATIEALLQRFGRINRRGLRPPASVWVYEPDYRTARGNQVRADGVYDPEPTRNTWELLSAHGDGGVLDESETQAWLNKLYTSDWGDTWEKQVRDFRDEFTRAFLTYTEPFTDRSHLKTQFFAQFDGFEAIRRDRVDDYLHKLRQGKTGEGRLLASSFHIPLPDHCRRHAEFSKDLGIHVIDGVYDQTTGLTEILGTTDYQPGEIL

SEQ ID NO: 13947 - protein, 829 aa, Paenibacillus peoriae
MDYIAHIRESDHEIQTVADHLMETQQLAETYGDKIGIQHITGLAGMLHDLGKYTEKFQNYIRLAVQSPDIPPKRGSVDHSTAGGKLLYNLFHIQPQGTVDKQDFMNKALLSEVVGNAIISHHAYLQDFLDPTLESKFLDRVRDRELEGFDHAVSLFYEQVMEESAFFRYVNQAGTELADYMEREDHPNIELKMMFLSKFVFSALIDADRTNTRCFEENNVKDEKNSNAPINGQQLFQTYYERLMERINDLQSGENADTTINLLRKQMSEQCEQFADKPSGILTLSIPTGGGKTLASLRYALKHAVTFEKKHIIYVVPFTTIIEQNAREVREIIRDDANILEHHSNVVMDEVEDIDAEGHELEDVVMNTHQKLKLAKDNWDSPIIFTTMVQFLNVFYAGGSRNVRRLHNLSESVIIFDEVQKVPTHCISLFNQALNFLKTYASSSIVLCTATQPELDFVHNKLDIEPDGEMVHDLDHVIEKFKRVEIVDKATDDTINTEKLADFVEQILADEPSVLVILNTKAVVKNLYHRLTEGNSAIPVYHLSTSMCPAHRNRILEEVKQLLEHKKPVVCISTQLIEAGVDISFDCVIRSLAGLDSIAQAAGRCNRHGRDGTKQVYVIDHEEEKLKDLKEIKIGKEITRKMFIDLKRDKTCYGGNILSGHALEIYFQKYYTELASDLNYYIPKLRKNMTELLSVSRNENTYYRSYYDEKDAFLPLFLANSYKTAAEHFQVIKDHTTAVIVPYGDGEKEGKEIIADLNGQQSIEDLSSLLRRAQQFTINITNTDKNQLSHNKGLVSFLDEKIWALTDGAYDDSYGLNVQNDSSHGGFIL

SEQ ID NO: 13948 - protein, 812 aa, Xanthomonas vasicola
MDSRRLRPDAARIGRNRADAQRRRDADAPLQGQTASACSHQGPKWSNAMELFAHSSKRQDRSDWQRLADHLFAVGERAARNAAPFGGQLLAGLAGQLHDLGKYTQKFQARLDGDPARVDHATWGARIACERYGTAGTLLAYGIAGHHAGLADGRPGHPAQSRPSLHERLSEDYRERELPPLLSDWERELSLPAKLALPDGFIGHPRQERRPFQLTVLTRMIFSCLVDADFTDTGDFYRRLEGRQSRAEETGTRPILPELRQCLDAHLATLPTKGGINPLRAQILSEVRAKAGMRPGLFSLTVPTGGGKTLASLGFALDHAIAHGLRRVIYVIPFTSIVEQTVQVFRHALGVQERDDIVLEHHSAFFDDPTKAPQSIDKRKLAIENWDAPIVVTTAVQFFESLFADRPSRCRKLHNIAGSVVVLDEAQTLPHALLRPCVALLDELARNYRVSPVLCTATQPTLRLDQGFAGGLDHVRELVDDPPALYARLRRVQVRHVGTLDDAALTDHLRQREQVLCIVNNRRHARHLFDAIADRPGARHLTTLMHARHRSAVLADLREDLKAGRPCRLVATSLIEAGVDVDFPTVLRVEAGLDSIAQAAGRCNREGLRPVEVSQVQVFTPANPDWAPPKDLDLFAEVFRGIERTHRDDLLAMDSVTAYFAELYRRLGDGRLDREEVLGLLRDADIKGLPLDTLARKFKMIQTTMRPLIVPYAPYAEGCDKEVPEVADILRQLEHAEHLGVAGAARRLQPWLVQVPEQAYRALWQANAIAPVAQARYGEQFVRLVNPRLYDPRCGLRSDDSPQFLAAEALVQ

SEQ ID NO: 13949 - protein, 764 aa, Xanthomonas vasicola
MELFAHSSKRQDRSDWQRLADHLFAVGERAARNAAPFGGQLLAGLAGQLHDLGKYTQKFQARLDGDPARVDHATWGARIACERYGTAGTLLAYGIAGHHAGLADGRPGHPAQSRPSLHERLSEDYRERELPPLLSDWERELSLPAKLALPDGFIGHPRQERRPFQLTVLTRMIFSCLVDADFTDTDDFYRRLEGRQSRAEETGTRPILPELRQCLDAHLATLPTKGGINPLRAQILSEVRAKAGMRPGLFSLTVPTGGGKTLASLGFALDHAIAHGLRRVIYVIPFTSIVEQTVQVFRHALGVQERDDIVLEHHSAFFDDPTKAPQSIDKRKLAMENWDAPIVVTTAVQFFESLFADRPSRCRKLHNIAGSVVVLDEAQTLPHALLRPCVALLDELARNYRVSPVLCTATQPTLRLDQGFAGGLDHVRELVDDPPALYARLRRVQVRHVGTLDDAALTDHLRQREQVLCIVNNRRHARHLFDAIADRPGARHLTTLMHARHRSAVLAELREDLKAGRPCRLVATSLIEAGVDVDFPTVLRVEAGLDSIAQAAGRCNREGLRPVEVSQVQVFTPANPDWAPPKELDLFAEVFRGIERTHRDDLLAMDSVTAYFAELYRRLGDGRLDCEDVLGLLRDADIKGLPLDTLARKFKMIQTTMRPLIVPYAPYAEGCDKEVPEVADILRQLEHAEHLGVAGAARRLQPWLVQVPEQAYRALWQANAIAPVAQARYGEQFVRLVNPRLYDPRCGLRWDDSPQFLAAEALVY

SEQ ID NO: 13950 - protein, 776 aa, Leptospira inadai; identical to SEQ ID NO: 13047

SEQ ID NO: 13951 - protein, 733 aa, Acaryochloris sp. CCMEE 5410
MTAPATSNFYRLHPRVQQWIASKKWPSLREIQELAIPPILAGDKDVIITAATAQGKTEAAFLPVFSQLVDQPTKGIQVIGLGPLKALINDQHRRLSAIGDCLDVPVCPWHGDISSGPKQRLLKQPAGVLLITPESLEALFVLRGQELGRLFASLSYIVIDEMHSFISIERGRQLQSLMQRVEQVVERPVPRIGLSATLGDMSLAAEFLRPGQQERVQLVQSFAKGDELKLQLRGYRSSPTPDPEEEEDETMPPPDALDIAQHLFQSLRGEKNLIFINSRRQVERYADILRNLSAEYRVPNEFMPHHGSLSKELRAEAEEALKRDHPVNVICTMTLEMGIDVGAVQSIAQIGPPSSVASTRQRLGRSGRRAGDPAIMRVYVSVPQLDSFTSPEQALYPDLVQAIAIINLLLEGWYEPPIAGRLHISTLIQQLLSSIAQQGGIRADQAWHDFCEEGPFQEMEQGLFIKLLRCLGERDLIQQSQDGLLLLGLKGERLVNHYTFYTAFSTTEEYRISTPENVLGTLPTSMPIAEEMVLLFAGRRWQVQSVDSEKQVVMVVPADGEGQAPRFGGSSGFVHDRVRQTMREIYRSTDMPVYLDDTAKTLLHEARTQFRDCGLDQEYIVGEDEQVLLFPWRGSLVMNTLQMLLLDSGLKASQEGLAIKVKGVEPDELMPYLQSLVNLGPANPLRLADVVRTKRSEKYDWVLTDELLNHNYVARFFDPQGTWETVSEICGGG

SEQ ID NO: 13952 - protein, 522 aa, Thermococcus zilligii
MRAYEEAVKRLAEAKGFVPEKRPLLEEAFDFLTSSPKPFLVLNAPTGYGKTLLSFALALHSLTDASLFDRVIHVLPMRSIIEDVQRTAEEAFGFSRTKMMGSSGEFMHLFPLNVTTADTFTWDLMKLNTKKRHSVKAGKEFGYDYLTQASILTSLVIFDEAHFLLEDESMATAFDAAVEFLASQGVPIVVMTATLSQGHREFFRKYAEKCGYDFKVLSPGGEDPFVERELKKDISIEFGEGDPLKFIEPGERNALIVNTVKRAVELYDRAISNPGLGFKRDRILLIHGRMTPSHKRSIINRLRELGREDFLLIGTQAVEAGVDFSADVMITDRAPVNSLLQRFGRLARHAGDKSGRALVMKDSPTGPYSEEMVDRTLKLIAGKSIHPRVPSTYEMAVTEVYGSSPSSINRLIDKNVKGKLFRLMSDPSKRAPDVLGEVEQLVAKGVPVMRNFLVPLSVENETVLISPEKLFELYSRGAVEVRGFKSEIKTLKDAYEVAKGVALGNNIEILFTGSYDQERGIV

SEQ ID NO: 13953 - protein, 891 aa, Gluconobacter frateurii
MDMTDLAQFWAKTDMQTGTLHPMHPVLAHCLDVAAVAISLPENMLPLINHQPLDRRLLGFLASLHDIGKLGATFQFLRPDLWPAALGHTPAALPPGPRHDAAGLQLLGQISTHPVLRTLFPDWSLTEKLRIFTGVAGHHGKPVSRAYQRPANLTSLEEKTLEAAQSFLTVMASLFQPPPFPEDTTEAAMDSLAWRLAEYLPIADWIGSNRTWFPYINPQDLKDPSAYFWNKALPQAQKAVLQAGLGSVRTTPFQTAKTLLPHLEKHALSPLQHWAETVPLPDGPTLIVIEDMTGSGKTEAALILSHRLIARGHASGLFLALPTMATANAMFERVAAAYGKMFHPLDRPSLALAHGKARLSERFTQTILSEKPSFSTPKHQKQPGESACSEWLASENRRALLAQVGIGTIDQALMAVLPVRYTTVRRQGLSNKILCCDEIHSFDPYMTEEMKELLTLHASRGGSVILLSATLSHALRTTLVNAFRKGLGLPGTTLQETHYPLTTLVSTAASPMETSCEPRPGLGRTVTINRLSDPDEAEARIMNLASTGAAIAWIRNTVDDAIASAEALRAKSVKVQLFHARFAMVDRLAIEQDILRKFGKQSSPEERSGVLVSSQILEQSLDVDFDALITDLAPADLLIQRAGRLWRHHRSNRALSSPQLDIISPPPISDPDANWIRRVLPGTAAVYRDPSLLWRTARALFSRNMLRTPEDVRPIIEEVADTTSPDSVPAALEKEMLTTQGKNIGAQGLGRQTVLKTGEPYDPGTGQWDTDLQARTRLETDPTVVVRLALLKNGTIHPYADDDDPARAWALSEIRVARTRLTSCPPPEGLQTAIETARACWPRWEREAVNDILVLVLFAAEEGEFEGVGRDKDDNALALRYHKVTGLMFAA

SEQ ID NO: 13954 - protein, 758 aa, Thermophagus xiamenensis
MKQILPGVKQTLMGPLAKSNPPQTIKEHIEEALEIKEKFKKAFPRIENLASAKNFWDILTTSIIFHDIGKAHNEFQNLLRGKKHRWNNQRHELFALPFIESLNLSEKWLVYLTVAGHHKDFDTLIRKIESYGSDGDNFELDLGGTEEIISFEKEFETNIPVEIVSELLKKFGYQHLKPVIHNPKRILVEFTRKHFKDKTEQIKLMLLAGAFKQCDHLASAGFTNIFNLSVDDFKFLQTYKLYQHQKDASSVIGNAILTAPTGSGKTETSLLWLQNQLKKTGNGRVFYILPYVASINAMFKRLEKEIPAKIGLLHGKLSAFIETKFENDDSVDEKHKEIIKNQFRTLVSPFKIVTPFQLLKNIFALKGFEKNLFEWAGGYFIFDEIHAYNPKVFAQIISLLKFATKYLDVKVFIMTATLPSFLKKALETAIGNFTSLKANQKLYNSFNRHRIIVKKGLLGDNLSLIQNHLEKNLKVLVVCNTVKQAQLVYKQLSSPKKLLLHSAFTAQDRSNKEHQLSNNDITLLVGTQAIEVSLDLDYDVIFTEPAPLDALIQRFGRVNRKRQKGICDCFVFEDRNEADKFIYPNKNVIDRTIQILKEKEFQNSGIIQESELQEMIDFVYPEWDLEDKEEFDKTTSLLDYFINNELKPFIYSEKQEEDFYEQFDGVKVLPSTLLSYYRELLEKNNFIQAENLKVQISSRRFYALLHNEGIDIRREAFENIETHKLKEQKVLVINRNYDSELGLLLDIEKKEDIEESFL

SEQ ID NO: 13955 - protein, 737 aa, Sphingomonas elodea
MGALHDIGKCAEAYQRYIRTPSTSKAQARGPDHSTAGAQEATRLFGKAIGRLMAYGIAGHHGGLMDGSALTARETKLVEDYSGWEAYVPPLPDETALLASLTKTRRNAIEPAFSPFFLGRMLFSCLVDADFLETERFYAAAAGLPPPERGGRVDPRHRDAVRAYMARHRRNDTPVNQLRSRILDHAVTKAALAPGLFTLTVPTGGGKTLTSLSFAMEHAIAHGLERIVYVIPFTSIIEQTSEVFRTALGPELAGDVLEHHSSFDWDAEPPVAEGDAEEEGASGLAKLRRDAQNWDVPIVVTTAVQFFESLFAARTSRARKLHNLAKSVIVIDEAQSIPVHLLRPCMAAIDELAKNYCATVVLCTATQPALRVQDGALPQPARAPSDKGADRIEGLDIPPDRELAPDPAGLYTELRRVAVEWFQAPVPDNAIAARFAEQSRMLCIVNSRAHARELFDAIRHQPGARHLTTLMCARHRRDVLASVRADLEEKGRPVRLVATSLIEAGVDVSFPEVWRAAAGLSNIAQAAGRCNRSGELTGLGRTVVFEPEAVAGRRSVPRDLTPFYDAAREVLKNPALDPLSLDGVIEYYRWLYWRKGYAALDRATGTGSDYPILPAIHETVSRRGINCPFRTISDAFQMIDEAMDPVLVPYDPVAEEALEALANADFPPAGTLRRLQQYVVPVPKRVRAAMLANGDARVVRAEYGDRFVRLRDLSLYDRDVGLQLLAPEWRTSEQNIM

SEQ ID NO: 13956 - protein, 733 aa, Sphingomonas elodea
MTSVSEAGSYDRLHPEIRRWIREQGWPGLREIQDITIRTVLDTRDDVIVMAGTASGKTEAAFLPLLTQTAESSRPGLKLLYISPLKALINDQFRRLELLCERLSLPLTKWHGDAPQGPKTRLLRAPAGVALITPESIEALLLRKPADAARLFSGVEAIVVDELHAFLQGPRGLHLASLLRRLDLIFVSRARRIGLSATLGDAEAACRWVNSQRPGDVAVLKASTGGPSVRLQIRGYEEPPEKGGSDDFAEDGAQDALSRIADHIFATLRGSNNLVFAASRRTVEALADRLRQRSERDAVPEEFFPHHGSLSKELRETLETRLKTGGLPTTAIATTTLELGIDLGSVKSVAQVGAPRSLAGLKQRLGRSGRRGDPAILRIYVREKHLTADVDPLDRLRLETARAVASVRLLQQNWVEPALEDPSLPTVSLHQTLSLISSRGGVRAAAAHKLLFGQDSILRLAPSDYADLLRGAARDGVDLLEQAPDGLLLLGSEGEKLVDSRDFYAVFATDEEWRLVAGGRPLGTVPLTNVLGIGSLVGFAGRRWRVEVVDDRAKVLEVVPHRSGKLPRFDRPANEPLHDRLTAMTLEVFLDDDRPAFLDAAGGEFLDQGRAAFRELGLQRRNVIETGADTHLLTWHGTAVNSLLSIVLMSAGIDAEAHDVGVTAVGISAPELKQLLGSLPECPAIDDLASFVVGLRSAKLDDFIDEDLLRRFWARRNEKNRLSVTNILTDIRI

SEQ ID NO: 13957 - protein, 761 aa, Leptospira broomii; identical to SEQ ID NO: 13048

SEQ ID NO: 13958 - protein, 940 aa, Acinetobacter ursingii
MIVTFISQCEKKAIPRTRRVLDAFADRIGDNTWQTVITEDGLIAVKKLLRKTVTKSTAVSCHWIRGRRRSELLWVVGNRNKFNIQGIVPVNSTQKEVFMDVMTMKAKKDEFYANTQLQPLAEHSFAIGYLAQQLFKKVVDNNEYENLSKVAFLAGCLHDLGKLDPHFQDWVKKGKQKDPEEDGQHIDVKFTFEKHPRHNEISLILFNFFEKQCKGLNNRQKECLQHVIYWHHAKPYRSNDEFSGVHKAYDFLAKNISNEQFENIIKQTTSLLKRINSVAKHYEDIDVIEKNLNWEIESFADQLEDFNYIYKGKEFPEFKLYSNNDETSQLRNKIDNNAQHNLLRACVISADRIVSKQTAQDLMDYIVEKRLDELLDDQEILSDLSVHLKNASTKFPDSERTQKQNEVARQLADLKDIAVLAGPAGCGKTKIALEWARLKDAKKIIWVCPRVQVCQGIFEELTQDYLPDAKVEILTGEFKYINENGKIKKEPEPFSGDVVVTTIDQILGSIVTHTNVNSLLPFMDAHVVFDEYHEYIGMEIFNLLFAELIANKNMRKQYEKNTLLVSATPHYYYLENILNVHEDDVVEMSSFNQSHYKIDFIEYDESVIEGNPFYKTYSDQTFIISNTAQTAQLGFVYQKDHENSVLFHSKYKRSDKKRWFDEVFDSFKKKGSQKYDVLRSGPIVQASLNITSKHMLSEMTSPENMLQRMGRLDRFGENQAVNILQVAITENLKNGSCKGSLAYFLNQLNSLQTTKAWYDFLQDRLNEKVFKLAELYKLYREFYKKQVQLDDRSAVIQDMDKALKKSIDLMNKKVTEPTKVMKSKMAERKSKISKNSLRGDSRFVQLAVLNLNDFKQPIFENKYAYTPPVDDTTEYDNLTESLNIIKDLGLINFIAQKHGNVDSTHPVKGIPEKKQASSLCSLGKLCKRCRFSFVSKLYRR

SEQ ID NO: 13959 - protein, 693 aa, Pedobacter agri
MPSSRSGLFYLGLLYYPKPDNSGNTFVAGLRQAQTDINKRLQRMAGQIVLKSYCNCFSKKNIRDYMDQTKTKGYKKIKAWLKANKRKPFQFQEDAWQNYLNGYSGLVNAPTGFGKTFSLFLAVVIEALNASEASNKKAKDRLQLIWITPLRSLAKDLARAMRETLTELELDWHVGVRNGDTSQAEKVQQKKSMPEILLITPESLHLLLAQKGSSTLFKNLKCIVADEWHELLGSKRGVLVELAVSRIKGLQKLEQQQFLRVWGISATIGNIEEALDVLEPNQEAKRIIIKADLEKKILIKSILPDDIETLPWAGHLGLKLAYKLLPIIEKSKTTLIFINTRGQSEMWYQHLLNIEPELAGRIAIHHGSIDFELRNWIEDALHTGQLKAVIATSSLDLGVDFKPVDTVVQVGSPKGVARFLQRAGRSGHSPHEVSKIYFMPTHALELVEAAAIKEAAKTNNIESREPFIMVFDLLVQYLVTLAIGDGFDDKIIYEEIKNTHAFKLILPEEWTWVMQFITSGGDSLGAYNEFKKVTKDEDGLWKVKSRQLAMRHRLHIGTIVSDAMLKVKFLSGGYIGMVEEYFVTRLKAGDNFRLAGRVLEFIHVKDMTVIVRVSKQSNAISPSWNGGRLPLSSNLGSVLRKKYNEALDKTHQDEELDVVYPLFLLQEKRSHVPRNDELLIELINNKEGFSVYV

SEQ ID NO: 13960 - protein, 815 aa, Lactobacillus malefermentans
MYIGHIGQDDDRIQELSTHLLSVRDMCYQWGKEIGLAHVCGLAGWLHDMGKYSDTFQDYIIKSHDNDPSAIRGSVDHATAGAIFLANYSQNPGELDEVLVELVGNVVMAHHNSKGALDYINPEVLDSPFTKRINKSNTDLIYSPQMIEASERFFSDFDTSEFSKYYQAAIDEIRPLENTIIQTQAFFLRYVLSTLIDADHTDTADFESNNTYKQTVQSSSILSHYFDINEEAVQTQIKENSTVSNPRTKKLNQLRQKMSDACYQTASEATGIYSLSVPTGGGKTLSSLRFALRKAKLQGIQRIIYVVPYTTIIEQNANAIRKRLNWNANDSANILEYHSTIMNEPKDPAYYYARDSWDSPIIITSQVAYLDALYGRGSKNIRHMHQLINSVIIFDEIQTLPLNCIELNNDAIQWLEQQNTTSLLCTATQPALEKLPHGLSIAKEIVPDLSFAQNAFKRVEIKPVFNEAQQLKVHSLSDLISLTEEQLHYQNSVLVILNTKKVVRAAYEALPEQPGLKKFHLSTSMCPKNRQDKFEEIKKQLDATKNSENNKVAVFATNLIEAGVDLSFECVIRSVAGIDSIVQAAGRCNRNNEVDLGKTFVVKMATDVEYIGGPLRLLKDKSDITDALIQKNHNQDLLADSVITDYFTRLYAEKRSELPYPVNTSKTEISLYPLICDLDKDPKKESIKAYVKKFGNLPPTLFSTAPNTVANYFRVIDSETTNVIVQYNTESIRLVSELISEKSKFENISKLLKKAQPYCVSVFGDPNNSRSALGQLLSTGDVQFYPEQGIYVAADNAYSKDLGLVGTGNFDYLDY

SEQ ID NO: 13961 - protein, 732 aa, Lactobacillus suebicus
MEYLAHKNDDGSIQTLREHLQQTANLAYKLAPGNLKNIAYLLGLLHDIGKYQPEFQSHIQKQDHNKVDHSSMANAILINYFEQVNDDMSRLCIEAFGGIIMAHHVGYLPNFGNELLQETDYEKRSKRFDFESVNDCYLSFLKDNNMSENQVENLFQKAKQQYIDYIKSHSNNVYVMYWTERLLLSILINADHSDTSGIIPTASYAKWIHSKYNILLNNLETKSIETNVDKVRQIISSQCDEAANSIQPNIRTLAAQTGLGKTFASLRWGLKTCMMTDQKQIIIVVPLLSVIEQNVKEIRNILNVDSSDLTVIEDDSNTNHHTLDDYELNNWDAPIIITTTVNFLKVCFGSGTSHVQHFSNIANAVVIFDEVQAIPTKSLDLFSILLDWFNSFSTSKVLLSSATLPDFRVLLPTLKVSDRASLVSKRIKISPRYEIKYHMDHVVDPEDIVKFASERAKTGTVLIIVNTKSLANEIYNKLDFNNKKLITTDICHAERLDNLADIADLLKKDKPVICVSTQIMQAGVDLSFDYLIRDLAGLDSIIQSAGRCNRNGNKHLGCVDVFNISEDLNKLPEINASRQAMLEIDDKNDVNKYFKKYFGLINTKFYITLSNGKTSILQDLINSTNINYSLGKEIHSQLYGTVARNYEPIDNEAKYTILIQCKGRGEDEDKGVRIVNELMDAYNNNDPKMIKKMTQLAQDYMVKKYNKPDRHEYKEVVPNELYCKISKDSLIF

SEQ ID NO: 13962 - protein, 697 aa, Halomonas sp. KM-1
MGLLHDLGKYTVPFQRRLEGSPERVDHSTAGAHVAIEKYPQLGHLLAYLIAGHHAGLANGRDSGERTPLKNRLEADLPPLDPIWQQEIVLPEFLPPPERFQRRNARAFFQYAFLARMLFSCLVDADFIDTEAFYAVNERGVPLARGGGPPLGALRDALDKHLAGFKGDSDVNRLRGEILSHVCSQAALTPGRFSLTVPTGGGKTLASLAFALDHAIAHGMDRVIYVIPFTSIVEQNAAVFRHALGQHGEAAVLEHHSAFDTDNQRDQRSIDKLRRDSENWDAPIIVTTAVQFFESLFAAKTSRCRKLHNIANSVVILDEAQTMPLPLLRPSVTALDELALNYRTSVVLCTATQPALAETDVPESSFKGGLRNLRELAPEPEKLYRQLERVHVRHVGPMTDEELRDQLLATDQVLCIVNNRRHAQALYESVAEQPGAYHLTTSMCAVHRRQILAEIRQVLEQGRPCRVISTSLIEAGVDVDFPRVLRAEAGLDSIAQAAGRCNREGKRAVGDSEVLIFSTVNEEWEPPPELKQFAQATVEVLRHHGDDPLSLAAIEAYFRLLYWQQGPQRLDRHGLLKLVEDGRLDGLPFETLEQKFRMIENNQRAVIIPFDGKARAALRDLEHVEGVGGIARKLQPYTVQVPRQGFAALERVGAISAVKSDKFGEQFMVLINEDLYDKRLGLNWSDPTFRASESNVW

SEQ ID NO: 13963 - protein, 831 aa, Streptomyces sp. S4
MQPPRQGRGQLQGGADWEVAQAGLLERVTVELGFGGLAEVQPVAVPARAVQLHVSGLIVMADWIASDKEHFPGLPDVSQVSMKGARERAGSAWTRLGLRGGWGALAGPGPEAFRERFGVEARPSQRLVMQAARDMEGPGLLVVEAPMGEGKTKAALMAAEILAARFGADGVFVGMPTQATSDPMFGQVRAWLQALGRGDDLASQVALLHGKRMFNKEWRGLVEGRERVGGEFGFAGVDEFGCEGDVYGMGGQARGVGERSGAGGPAEWFLGAKRGLLCPFVVGTVDQLLLAATRSRHVMLRMAGLAGKVVVLDEVHAADVYMSQFLVEGLRWLGQAGVPVVLLSATLPPGQRRELVEAYVAGAGSREELRLEALPEPGGYPSVTSAWSAVEGPCVRVDSCEGWRPDLSVALAVCSEPVPGPRASRVQERQAQEEADVAVVDLLRAQLEGGGCALVVRNTVARAQSLYSALAGVFGAGEVMLLHGQLAAGARAERTERCLGLLGVSGPGVGEGRPHRLVVVATQLAEQSFDVDVDLLVSDVAPVDLLLQRIGRLHRHGGRVRPPGLVVPQVFLTGLGGGLVEGTDAGSVCGGPAFVRGSEVIYGRHLLLRTAAAVADALRPGPECGSGSGAGVWQVPGGVPGLVAAVYGDEELVPAGWRDDAGAARVEWEERQRERAQSAVPFLLTRRGDKEGVTLAGLHRVAVAASGGAEGGLDGVVRDGEMGEEVVLVVREGEGEVVRTLSGRALSVNGDVADELIDDVLAGTVRLPGGPASSAAGALGPLPGWVGHPRLRYARALVLDGLGWGELGEHRVHYDDVLGLTVELASRWPVR

SEQ ID NO: 13964 - protein, 718 aa, Leptospira interrogans; identical to SEQ ID NO: 12833

SEQ ID NO: 13965 - protein, 735 aa, Fusobacterium gonidiaformans; identical to SEQ ID NO: 12460

SEQ ID NO: 13966 - protein, 760 aa, Enterococcus; identical to SEQ ID NO: 12995

SEQ ID NO: 13967 - protein, 811 aa, Enterococcus haemoperoxidus; identical to SEQ ID NO: 12996

SEQ ID NO: 13968 - protein, 809 aa, Enterococcus moraviensis
MYIAHVRKSDGEKQLLKDHLTECAELSADWGGKIGLRKTSYLAGLLHDLGKYSNEFQVYLKKAVADPKSVTRGSVDHSTAGGKLLFDYCHKNSRDPFSYILAELVGNAIISHHSSRGLQDFFTPEGEANSDYLRRVDEIEVVDYEQIKSRFFQEIMSEEQFQKLLLEAIKELKGFYQKDGKSRVKQNDTFFLLKFIYSCLLDADRTNTMLFEENKVFKRHENDVLLQSYSQSLEEYIATFTADTPINQLRGQMSDQCKAFAERKTGIYTLSIPTGGGKTLASLRFALNHAIKYGKERIIYVVPFTTIIEQNAATVREILKDEVNILEHHSNVFTDQEEMKERQTEESEAEKEALEQKQALLKDNWESPVIFTTMVQFLNTIYSRGTRNPRRFHNLTNAVIIFDEAQGVPTNCTHLFNESLNFLKNYGTTTSVLCTATQPSLENVGRALAKESDGEMVANLSEVESKFKRVEVIDRTTDDTWTLEELAEFSQEILTEKENLLIILNTKKAVRRLYQYLENKPLENIELYHLSTSMCAKHRKNLLDELREKLTNSDTKLICITTQLIEAGVDISFQSVIRSAAGLDSIAQAAGRCNRHGETRQQPVYLINLSADLENLTHLPEIKQGQEITLDILKESSELEQKELLSHDVQKRYFDRYYDCFKDELNYPVKKTSLNLFSLLGEGANALEHYKRTHGSAPLLAFRSSPKTVGKYFQVIDSPTTSVLVPYEKGNDLIADLNGELRPEEYAPTLKKAQQYMVNVFQHELMELQKTGSIYPLLNGDVLALTSNAYNLKFGIDLEAEAASGYLGF

SEQ ID NO: 13969 - protein, 703 aa, Pseudomonas sp. HPB0071
MSEFDKFHPALQHHIVNSLGWNGLRPLQEATIQPVLDGEHAILLAPTAGGKTEAASFPVFSRMLSESWEGLSVLYICPIKALLNNLEQRLSYYGHLLGRSVALWHGDISAARKSKIVASPPDILLTTPESLEVMLVSNKVDHQQLFANVRTVIIDEVHAFAGDDRGWHLLSVLERISVLAGREIQRLGLSATVGNPDTLCDWLAGSCNARRSVINPPAENNVIPDVQVDWVGSLKNAAVVISRLHKGEKRLVFVDSRSKVEELAVELRCLGVATYISHSSLSLEERRAAEEAFSQGNDCVIVSTSTLELGIDVGDLDRVIQIDAPYTVASFLQRIGRTGRRAGSSRNCLFLATKEDAFLRALALLQLWRQGYVEPIEPPARPVHIYAQQTMALALQQKGIIAADVDQWVGRMPGFAGVTPDDRAGVISYMLGAGILHSDEGLIGIGKAGERAFGEKNFMELFSVFTTPPMVKVFSGKQELGEVHQLTFAVRDNGPALLTLGGRSWQTTYIDWPRRKAFVEPSEVRGKSQWVSDAQPLRYELCRAIADVLISDLVPEGLSSRAQGLLADLRDQYGWMESGKSTLLLDADGNAIWWNFAGKLLNSAMKDLLADEADKLIADNECMTFRHVYSAEALVRAIREILAGDAHNLAVLLDESFVQELKFAECLSQKEIDRELGERYSVDSDFKQFSRVSLAVLWVKDEA

SEQ ID NO: 13970 - protein, 872 aa, Pyrococcus abyssi; identical to SEQ ID NO: 12076

SEQ ID NO: 13971 - protein, 529 aa, Pyrococcus abyssi; identical to SEQ ID NO: 12077

SEQ ID NO: 13972 - protein, 728 aa, Methanocaldococcus jannaschii; identical to SEQ ID NO: 11532

SEQ ID NO: 13973 - protein, 614 aa, Methanocaldococcus jannaschii; identical to SEQ ID NO: 11533

SEQ ID NO: 13974 - protein, 759 aa, Archaeoglobus fulgidus; identical to SEQ ID NO: 11531

SEQ ID NO: 13975 - protein, 546 aa, Archaeoglobus fulgidus; identical to SEQ ID NO: 11530

SEQ ID NO: 13976 - protein, 526 aa, Pyrococcus horikoshii; identical to SEQ ID NO: 12033

SEQ ID NO: 13977 - protein, 572 aa, Saccharolobus solfataricus; identical to SEQ ID NO: 11535

SEQ ID NO: 13978 - protein, 515 aa, Saccharolobus solfataricus; identical to SEQ ID NO: 11536

SEQ ID NO: 13979 - protein, 515 aa, Saccharolobus solfataricus; identical to SEQ ID NO: 330

SEQ ID NO: 13980 - protein, 668 aa, Chlorobaculum tepidum; identical to SEQ ID NO: 11543

SEQ ID NO: 13981 - protein, 861 aa, Chlorobaculum tepidum; identical to SEQ ID NO: 11544

SEQ ID NO: 13982 - protein, 876 aa, Corynebacterium diphtheriae; identical to SEQ ID NO: 12079

SEQ ID NO: 13983 - protein, 778 aa, Porphyromonas gingivalis; identical to SEQ ID NO: 11549

SEQ ID NO: 13984 - protein, 732 aa, Methylococcus capsulatus
MPIAHVRKGENGEWIIHDLAEHLHGVAKLADAFARHFRSGDWAHLAGLWHDLGKYRQAFQGYIRTQSGYDPEAHIEGGKGRVDHSTAGAIHAIERLGPHGRILAYLIAGHHAGLPDWSGTPSSLFQRMEQPQAKEWLNEIRAQNPPADLLERERPRSRPPGGALHLWLRLLFSTLVDADFLDTEAFMDPARANQRGATCALPDLLAAFNTYMEGKTAAAPDTPVNRLRAQVLAQCRTKAEEAPGLFSLTVPTGGGKTLSSLAFALEHAVHHGQRRIVYAIPYTSIIEQTADIFREIFGEAVIEHHSNLDPDRETAKSRLMSENWDAPLVVTTNVQLFESLFAARTSQCRKLHNLVDSVIVLDEAQLLPPEFLDPILEVLRDLTAHYGVTMVLSTATQPAFKPRQGFGWKFDGLENVREIMADPELLYRDLKRVAVKLPDDLHAPEDWPTLAERIRGHEQVLVIVNRRDDARELAEFLPEAVHLSANLCGEHRSRLIADIRERLRLKAPLRVVSTQLIEAGVDVDFPVVFRAMAGLDSIAQAAGRCNREGRLADGLGRVFVFVPPKPSPPGLLRKGEDAARELLFDQAEDLLTPELFERYFGLYYAKLNDLDKAGILDLLRKDERALQIQFRTAAERFRLIDDQAQQTIIVRYCDAEKWLSMLKNQGPERWLMRKLQRYSVNIPKSLFQKLLATDEVAQVHPGIYAQNVDGLYDSRFGFIGGQAGPNPLDLII

SEQ ID NO: 13985 - protein, 881 aa, Methylococcus capsulatus; identical to SEQ ID NO: 11555

SEQ ID NO: 13986 - protein, 544 aa, Sulfurisphaera tokodaii; identical to SEQ ID NO: 13300

SEQ ID NO: 13987 - protein, 501 aa, Sulfurisphaera tokodaii; identical to SEQ ID NO: 13301

SEQ ID NO: 13988 - protein, 609 aa, Pyrobaculum aerophilum; identical to SEQ ID NO: 11538

SEQ ID NO: 13989 - protein, 554 aa, Pyrobaculum aerophilum; identical to SEQ ID NO: 11539

SEQ ID NO: 13990 - protein, 658 aa, Pyrococcus furiosus; identical to SEQ ID NO: 11540

SEQ ID NO: 13991 - protein, 732 aa, Caldanaerobacter subterraneus; identical to SEQ ID NO: 11541

SEQ ID NO: 13992 - protein, 776 aa, Clostridium tetani; identical to SEQ ID NO: 11546

SEQ ID NO: 13993 - protein, 866 aa, Clostridium tetani; identical to SEQ ID NO: 11547

SEQ ID NO: 13994 - protein, 693 aa, Chromobacterium violaceum; identical to SEQ ID NO: 11548

SEQ ID NO: 13995 - protein, 755 aa, Nanoarchaeum equitans; identical to SEQ ID NO: 11550

SEQ ID NO: 13996 - protein, 786 aa, Thermus thermophilus; identical to SEQ ID NO: 11552

SEQ ID NO: 13997 - protein, 702 aa, Desulfovibrio vulgaris; identical to SEQ ID NO: 11553

SEQ ID NO: 13998 - protein, 719 aa, Symbiobacterium thermophilum; identical to SEQ ID NO: 12034

SEQ ID NO: 13999 - protein, 936 aa, Symbiobacterium thermophilum; identical to SEQ ID NO: 12035

SEQ ID NO: 14000 - protein, 760 aa, Mannheimia  succiniciproducens; identical to SEQ ID NO: 11554

SEQ ID NO: 14001 - protein, 719 aa, Bacteroides fragilis; identical to SEQ ID NO: 12036

SEQ ID NO: 14002 - protein, 914 aa, Nocardia farcinica; identical to SEQ ID NO: 12037

SEQ ID NO: 14003 - protein, 732 aa, Photobacterium profundum; identical to SEQ ID NO: 12080

SEQ ID NO: 14004 - protein, 927 aa, Photobacterium profundum; identical to SEQ ID NO: 12081

SEQ ID NO: 14005 - protein, 893 aa, Haloarcula marismortui; identical to SEQ ID NO: 11556

SEQ ID NO: 14006 - protein, 817 aa, Thermus thermophilus; identical to SEQ ID NO: 12038

SEQ ID NO: 14007 - protein, 828 aa, Aromatoleum aromaticum; identical to SEQ ID NO: 12083

SEQ ID NO: 14008 - protein, 533 aa, Thermococcus kodakarensis; identical to SEQ ID NO: 12039

SEQ ID NO: 14009 - protein, 900 aa, Thermococcus kodakarensis; identical to SEQ ID NO: 12040

SEQ ID NO: 14010 - protein, 763 aa, Xanthomonas oryzae; identical to SEQ ID NO: 11557

SEQ ID NO: 14011 - protein, 950 aa, Corynebacterium jeikeium; identical to SEQ ID NO: 12084

SEQ ID NO: 14012 - protein, 897 aa, Dehalococcoides mccartyi; identical to SEQ ID NO: 12086

SEQ ID NO: 14013 - protein, 814 aa, Carboxydothermus hydrogenoformans; identical to SEQ ID NO: 11560

SEQ ID NO: 14014 - protein, 692 aa, Pelodictyon luteolum; identical to SEQ ID NO: 11561

SEQ ID NO: 14015 - protein, 885 aa, Rhodospirillum rubrum; identical to SEQ ID NO: 11564

SEQ ID NO: 14016 - protein, 752 aa, Rhodospirillum rubrum; identical to SEQ ID NO: 11565

SEQ ID NO: 14017 - protein, 724 aa, Moorella thermoacetica; identical to SEQ ID NO: 11563

SEQ ID NO: 14018 - protein, 743 aa, Hahella chejuensis; identical to SEQ ID NO: 11566

SEQ ID NO: 14019 - protein, 917 aa, Methanosphaera stadtmanae; identical to SEQ ID NO: 11568

SEQ ID NO: 14020 - protein, 763 aa, Xanthomonas oryzae; identical to SEQ ID NO: 12041

SEQ ID NO: 14021 - protein, 751 aa, Frankia casuarinae; identical to SEQ ID NO: 11570

SEQ ID NO: 14022 - protein, 807 aa, Desulfitobacterium hafniense
MKMSPLIPFAQCIARPDEQGRTHLLKDHLLGVKEAVEQRLKSECCPYCHDRIFIRLAGLAGVCHDMAKAHRKWQSYIRGQDKGGPNHAPEGAFLFSYLGFHLLQQESKWPSYAVFWLWLTRDIADHHGALKHLDEKHRIGAGTWEKMDLSGITKFMEQIYPELCQVPITAEALDQWIDRLYDVLQEAYDGLDLGYSPDYGKAMAQLTFWRELTTALIAGDRFHVAPMERVGFSQEDHIRHDRAMDEFCRNNGEQVMADIRSQAQRQILNQLARDPRRRIYTLEMPTGYGKTITALKIAAWLGREQGYERIIYVAPYLSILEQTSGVMEKAMGASVLEHHSLAVLEEKQKDEDREEEGQFHSGQLMMEAWANPVICTSFQQWSKALFPGKAQDTLRRAYLHNSVVIIDEPQIFAPESWNVFLCGLESVAQLYNLRIFFLSATMPPFDYGLSEQPGCLAVNPVQQIERYQVEQKGEMDERGVADYLLKRSEILAADERGLSQAAILNTIADAYLVYKQLAAKVEPSQLKLLHGMMIPLHKRVEIEKIKHFQAENKREGQYVVSTQIIEAGVDLSFDHIMRALPILPSLIQAAGRVNRNGSGRRGILTLMTFLRGGEKNTRGFIYPSELQKLTDKLLQKQDVWLESELLELIKEYYRRMFARNSYEAGKQAIIDAYEGNWPLLGQQFKPFGEDYFKLPVFVPWQTEEEDQAYFPQRFVELQERLGLYEAEDIYACYEDRDYYSRLSFKGRKEFMILLNHYVVNVPAKLAFSLVGKELYLKNRIPCLWSGNDYDPVAGLAKRAVEGFDAII

SEQ ID NO: 14023 - protein, 745 aa, Methylobacillus flagellatus; identical to SEQ ID NO: 11571

SEQ ID NO: 14024 - protein, 971 aa, Deinococcus geothermalis; identical to SEQ ID NO: 11573

SEQ ID NO: 14025 - protein, 772 aa, Deinococcus geothermalis; identical to SEQ ID NO: 11574

SEQ ID NO: 14026 - protein, 767 aa, Myxococcus; identical to SEQ ID NO: 11575

SEQ ID NO: 14027 - protein, 746 aa, Myxococcus; identical to SEQ ID NO: 11576

SEQ ID NO: 14028 - protein, 1097 aa, Frankia alni
MSAAAGWRQPSEAVEALRVELAVPIASFRDPMFPGVSRCLPVPPPSTVRGMLAAATGRPSETVPLGLAASATANGVDLETYHPIAADGSNPASGGRVAPGKGGMTIRERPFLAGVRVTLWIPGAAGRRIEAALRRPVWGLRLGRSQDLVHLVGAPRWTVLHPAERAMVGHAVAPPDGHAAPQAVSLRLAVAVSADRLSTDYRSFLWCADAAGTHAVHGAYLDGLDGQAVWLLDGDADGDADGDAAAGSAADASELDTILAKSADRSVDDEPERLTAHAQAVRDAARSIAARIGPAGPIADEPRFWAWVEQAALLHDAGKVAEGFQRQIHPGGRPWSERHEVLSLAYVDLFHPEPPAEAETATDAGAATDRLMTATGVLFHHRSLTTSGLGGKEPLVSRYFEDADWARYFWRGTPDDIRDGKPRLQIPRRRHAELLAWFADRLDLAPDPAEGRRLWERARALFLATRDHWIDPVTDREGLLAVLLQGAVTLADHAGSAHVPLQTHMPLPRRYLDRIPAPYDHQRAAAAVEGHLILLAPTGSGKTEAGLAWASARLDGMPDQPRLVWMLPYRASIDAAADRFRDDLVPPPNHNLPPVHGEPPPGPGEPDRPDTPDRPDIGILHATAARTLLERAVAEDCAPPAEAALKARARVGAMRLFAQRVRVATPHQLLRAAIAGPRYSSVLLEQANCLMVLDELHAYDPVTFGRICAAMRLWSQLGSQVAVLSATLSMPMIELVQDSLGGTVEVVHAAPGTAPDRHRLVLADAPITAPASLDAVRRWLAEGRSVLVVANTVRTAQQLYADLAPAARAAAPDVDGRDADADAAILLHSRFRARDRAAIERRILARHPERQPGDPARRSGGLVVSTQALEVSLCLDFDRGASELAPIEAVAQRAGRVNRRGRHPDGPVEFRVHPVEKHLPYEEEALAAAWSALRSTADTDPTISEQTVTAWLDHVYATDWGRRWAATARQHRDAFSTSFLTFQRPFDDRSEFARGLAEQFDTVHVLHRDDLPEYRELADRDRGGPLLAEGLLIPIGFHQYLRLAKAGRAEVHRGLRLATVDAPYSAETGLDLSVLDDENARFDDRSGHRPADLDTIL

SEQ ID NO: 14029 - protein, 717 aa, Syntrophomonas wolfei; identical to SEQ ID NO: 11577

SEQ ID NO: 14030 - protein, 781 aa, Syntrophomonas wolfei; identical to SEQ ID NO: 11578

SEQ ID NO: 14031 - protein, 931 aa, Leptospira borgpetersenii; identical to SEQ ID NO: 11580

SEQ ID NO: 14032 - protein, 931 aa, Leptospira borgpetersenii; identical to SEQ ID NO: 11579

SEQ ID NO: 14033 - protein, 804 aa, Methanothrix thermoacetophila; identical to SEQ ID NO: 11581

SEQ ID NO: 14034 - protein, 873 aa, Clostridium novyi; identical to SEQ ID NO: 11582

SEQ ID NO: 14035 - protein, 805 aa, Bifidobacterium adolescentis; identical to SEQ ID NO: 12042

SEQ ID NO: 14036 - protein, 667 aa, Chlorobium phaeobacteroides; identical to SEQ ID NO: 11583

SEQ ID NO: 14037 - protein, 566 aa, Thermofilum pendens; identical to SEQ ID NO: 11584

SEQ ID NO: 14038 - protein, 745 aa, Desulfovibrio vulgaris; identical to SEQ ID NO: 11585

SEQ ID NO: 14039 - protein, 792 aa, Acidovorax citrulli; identical to SEQ ID NO: 11586

SEQ ID NO: 14040 - protein, 939 aa, Hyperthermus butylicus; identical to SEQ ID NO: 11587

SEQ ID NO: 14041 - protein, 834 aa, Methanocorpusculum labreanum; identical to SEQ ID NO: 11588

SEQ ID NO: 14042 - protein, 577 aa, Staphylothermus marinus; identical to SEQ ID NO: 11591

SEQ ID NO: 14043 - protein, 802 aa, Clostridioides difficile; identical to SEQ ID NO: 12087

SEQ ID NO: 14044 - protein, 773 aa, Clostridioides difficile; identical to SEQ ID NO: 12088

SEQ ID NO: 14045 - protein, 820 aa, Methanococcus maripaludis; identical to SEQ ID NO: 11592

SEQ ID NO: 14046 - protein, 783 aa, Desulfotomaculum reducens; identical to SEQ ID NO: 11593

SEQ ID NO: 14047 - protein, 731 aa, Desulfotomaculum reducens; identical to SEQ ID NO: 11594

SEQ ID NO: 14048 - protein, 484 aa, Pyrobaculum arsenaticum; identical to SEQ ID NO: 11595

SEQ ID NO: 14049 - protein, 745 aa, Pseudomonas stutzeri; identical to SEQ ID NO: 11598

SEQ ID NO: 14050 - protein, 908 aa, Caldicellulosiruptor saccharolyticus; identical to SEQ ID NO: 11596

SEQ ID NO: 14051 - protein, 777 aa, Caldicellulosiruptor saccharolyticus; identical to SEQ ID NO: 11597

SEQ ID NO: 14052 - protein, 701 aa, Acidiphilium cryptum; identical to SEQ ID NO: 11601

SEQ ID NO: 14053 - protein, 763 aa, Thermotoga petrophila; identical to SEQ ID NO: 11602

SEQ ID NO: 14054 - protein, 927 aa, Roseiflexus sp. RS-1; identical to SEQ ID NO: 11603

SEQ ID NO: 14055 - protein, 783 aa, Roseiflexus sp. RS-1; identical to SEQ ID NO: 11604

SEQ ID NO: 14056 - protein, 904 aa, Roseiflexus sp. RS-1; identical to SEQ ID NO: 11605

SEQ ID NO: 14057 - protein, 765 aa, Methanococcus vannielii; identical to SEQ ID NO: 11608

SEQ ID NO: 14058 - protein, 772 aa, Methanococcus aeolicus; identical to SEQ ID NO: 11609

SEQ ID NO: 14059 - protein, 800 aa, Fervidobacterium nodosum; identical to SEQ ID NO: 11613

SEQ ID NO: 14060 - protein, 744 aa, Pseudothermotoga lettingae; identical to SEQ ID NO: 11617

SEQ ID NO: 14061 - protein, 885 aa, Pseudomonas mendocina; identical to SEQ ID NO: 11599

SEQ ID NO: 14062 - protein, 492 aa, Metallosphaera sedula; identical to SEQ ID NO: 11600

SEQ ID NO: 14063 - protein, 805 aa, Pelotomaculum thermopropionicum; identical to SEQ ID NO: 12043

SEQ ID NO: 14064 - protein, 738 aa, Pelotomaculum thermopropionicum; identical to SEQ ID NO: 12044

SEQ ID NO: 14065 - protein, 798 aa, Alkaliphilus metalliredigens; identical to SEQ ID NO: 11606

SEQ ID NO: 14066 - protein, 743 aa, Alkaliphilus metalliredigens; identical to SEQ ID NO: 11607

SEQ ID NO: 14067 - protein, 811 aa, Actinobacillus succinogenes; identical to SEQ ID NO: 11610

SEQ ID NO: 14068 - protein, 740 aa, Pseudomonas aeruginosa
MSLPPSNSDSAGFGLLDPAIQRWVWREGWTSLRDAQERAIPALLNADRDVIIAASTAAGKTEAAFLPILTNLLKHDDPAGSVIYVSPLKALINDQWGRLETLCQELDIPVIAWHGDISASRKRRFLKSPSGVLLITPESLEAMFVNRGTGLAGVFANLRYLVVDELHAFIGSERGKQLQSLLHRVELVVERTVPRVGLSATLGDMALASSFLRPGKEQGVEIIESKTSEQVLKVQVRGYVEALSQQETANSEEAQRDDDSGVEQAIAAHLYQVLRGSNNLVFPNSRGKVEWYADQLRRLCERDGVPNEFWPHHGNLSKDVREEAEKALKAGNRPATAVCTTTLELGIDIGSIRTVGQIGSPPSVASLRQRLGRSGRRQGESAILRSYCKERSLSDDSSLSDRLRQGLVQSVAMIRLLIANWFEPPKVQGCHYSTLVQQILSIIAQRGGATAGELWRSLVATGPFSTVAQPDFLMLLRAMGEHDLVVQESSGLLLPGESGERFINHYDFYSAFISDEEFRLVCDGKALGSLPVSRPLIVEQRIIFAGRRWQVTDVDANAKVVVVRPSPGGAPPVFDGIGARVHDHVRQEMRQLLSEEAPCPFVDAVGQNLLGEARRCFSELGLASRGLVDVGAVTAVFTWHGDWTNDALVILLEWHGLRCDRAGLVLEVNGSVERVQEALRLIAESPVPPLPELLSDVQNMMCEKWDWVLPPNLLAASYASTYLDVESARKVAVRLGRERQ

SEQ ID NO: 14069 - protein, 741 aa, Bacillus cytotoxicus; identical to SEQ ID NO: 11611

SEQ ID NO: 14070 - protein, 792 aa, Campylobacter hominis; identical to SEQ ID NO: 11612

SEQ ID NO: 14071 - protein, 859 aa, Roseiflexus castenholzii; identical to SEQ ID NO: 11614

SEQ ID NO: 14072 - protein, 779 aa, Roseiflexus castenholzii; identical to SEQ ID NO: 11615

SEQ ID NO: 14073 - protein, 543 aa, Ignicoccus hospitalis; identical to SEQ ID NO: 11616

SEQ ID NO: 14074 - protein, 733 aa, Campylobacter concisus; identical to SEQ ID NO: 12313

SEQ ID NO: 14075 - protein, 733 aa, Acaryochloris marina; identical to SEQ ID NO: 11620

SEQ ID NO: 14076 - protein, 929 aa, Salinispora arenicola; identical to SEQ ID NO: 11618

SEQ ID NO: 14077 - protein, 582 aa, Caldivirga maquilingensis; identical to SEQ ID NO: 11619

SEQ ID NO: 14078 - protein, 804 aa, Herpetosiphon aurantiacus; identical to SEQ ID NO: 11621

SEQ ID NO: 14079 - protein, 730 aa, Petrotoga mobilis; identical to SEQ ID NO: 11623

SEQ ID NO: 14080 - protein, 844 aa, Lactobacillus helveticus; identical to SEQ ID NO: 11622

SEQ ID NO: 14081 - protein, 782 aa, Gluconacetobacter diazotrophicus; identical to SEQ ID NO: 11652

SEQ ID NO: 14082 - protein, 899 aa, Gluconacetobacter diazotrophicus; identical to SEQ ID NO: 12093

SEQ ID NO: 14083 - protein, 823 aa, Sorangium cellulosum
MRPPLLAKSYDHRDFKGAPPDFALLTQHSRDVAAACASLAEVVGPAALEAAGLDAREGERFAATLRLCGWMQDLGKANSDFQAMVRGQTQIQQLVRHEVVSGFLVWLDPAIRGWLAPMEESLLVATWGALGHHRKFDDEAGINLGTALTVHAAHEDFATILRDMAADLGLPEPPSFARDFTIGRNRRGDADRAAGPMRQQMVDGFRDAEAAFQDESARRFVALVKGFGIAADVVASAVARRGVTAARYSLPESIGRSLSTTLTRGDLTALIHRWAWRTYDRDAPADLSQLPPGFGYRPFQERVAASPSRVTLAEAGCGSGKSVAAYLWAREWAARREAAGASGFRLFFCLPTTGTSTEHFKDYALEADVPAELVHSRASVDLHTLATTADQEEDDDQDARAGATRRDRTAPAESALRAERDKIEALALWDARVAVATADTVLGLMANARRALCALPAIVQSAIVFDEIHAFDDQLFGHLLVFLRNFPGIPVLLMTASLPEARRRALAEVRSDLHIVPGPPDLETLPRYLLVEAEGVEACWPEIDGCLREGGKVLWVRNRVEWANAAYRSARERFQGMSVDVYHSRLRYRDRSRRHRRVIDRFKRAGVPALLVATQVAEMSLDLSADLLVTDEASVPAMIQRLGRLNRRATPESPGSPKQALIVPITAKRDIAPYSEEEIEASRVWRSGLMKLGRALHQRDLSEQFALVASGRSLDYSAAEEAAVFLGVPERTGLWRTRPGSTRGAGYTVTVLLERDMDAHRREHGARVPAAEWLREHEVSIPIAQGVVSWPRVAGLPVAPEDAVTYDYDDSTGEGTGARWRES

SEQ ID NO: 14084 - protein, 801 aa, Chloroflexus aurantiacus; identical to SEQ ID NO: 11624

SEQ ID NO: 14085 - protein, 784 aa, Chloroflexus aurantiacus; identical to SEQ ID NO: 11625

SEQ ID NO: 14086 - protein, 907 aa, Microcystis; identical to SEQ ID NO: 12045

SEQ ID NO: 14087 - protein, 784 aa, Thermoanaerobacter; identical to SEQ ID NO: 11627

SEQ ID NO: 14088 - protein, 837 aa, Heliobacterium modesticaldum; identical to SEQ ID NO: 11629

SEQ ID NO: 14089 - protein, 754 aa, Heliobacterium modesticaldum; identical to SEQ ID NO: 11628

SEQ ID NO: 14090 - protein, 795 aa, Candidatus Desulforudis audaxviator; identical to SEQ ID NO: 11631

SEQ ID NO: 14091 - protein, 763 aa, Synechococcus; identical to SEQ ID NO: 11632

SEQ ID NO: 14092 - protein, 564 aa, Candidatus Korarchaeum cryptofilum; identical to SEQ ID NO: 11633

SEQ ID NO: 14093 - protein, 794 aa, Leptothrix cholodnii; identical to SEQ ID NO: 11634

SEQ ID NO: 14094 - protein, 491 aa, Pyrobaculum neutrophilum; identical to SEQ ID NO: 11635

SEQ ID NO: 14095 - protein, 566 aa, Pyrobaculum neutrophilum; identical to SEQ ID NO: 11636

SEQ ID NO: 14096 - protein, 773 aa, Exiguobacterium sibiricum; identical to SEQ ID NO: 11637

SEQ ID NO: 14097 - protein, 722 aa, Xanthomonas oryzae; identical to SEQ ID NO: 11638

SEQ ID NO: 14098 - protein, 706 aa, Porphyromonas gingivalis; identical to SEQ ID NO: 12046

SEQ ID NO: 14099 - protein, 729 aa, Sulfurihydrogenibium sp. YO3AOP1; identical to SEQ ID NO: 11639

SEQ ID NO: 14100 - protein, 906 aa, Geobacter lovleyi; identical to SEQ ID NO: 11640

SEQ ID NO: 14101 - protein, 594 aa, Chlorobium phaeobacteroides; identical to SEQ ID NO: 11641

SEQ ID NO: 14102 - protein, 723 aa, Chloroherpeton thalassium; identical to SEQ ID NO: 11642

SEQ ID NO: 14103 - protein, 860 aa, Prosthecochloris aestuarii; identical to SEQ ID NO: 11643

SEQ ID NO: 14104 - protein, 888 aa, Anaeromyxobacter sp. K; identical to SEQ ID NO: 11644

SEQ ID NO: 14105 - protein, 828 aa, Borrelia duttonii; identical to SEQ ID NO: 11645

SEQ ID NO: 14106 - protein, 828 aa, Borrelia recurrentis; identical to SEQ ID NO: 11646

SEQ ID NO: 14107 - protein, 728 aa, Thermodesulfovibrio; identical to SEQ ID NO: 11649

SEQ ID NO: 14108 - protein, 543 aa, Thermodesulfovibrio; identical to SEQ ID NO: 11650

SEQ ID NO: 14109 - protein, 801 aa, Dictyoglomus thermophilum; identical to SEQ ID NO: 11647

SEQ ID NO: 14110 - protein, 755 aa, Dictyoglomus thermophilum; identical to SEQ ID NO: 11648

SEQ ID NO: 14111 - protein, 897 aa, Gluconacetobacter diazotrophicus; identical to SEQ ID NO: 11651

SEQ ID NO: 14112 - protein, 726 aa, Anoxybacillus flavithermus; identical to SEQ ID NO: 11653

SEQ ID NO: 14113 - protein, 801 aa, Thermosipho africanus; identical to SEQ ID NO: 11654

SEQ ID NO: 14114 - protein, 784 aa, Dictyoglomus turgidum; identical to SEQ ID NO: 11655

SEQ ID NO: 14115 - protein, 876 aa, Thauera sp. MZ1T; identical to SEQ ID NO: 11656

SEQ ID NO: 14116 - protein, 740 aa, Desulfovibrio vulgaris; identical to SEQ ID NO: 11658

SEQ ID NO: 14117 - protein, 781 aa, Chloroflexus aggregans; identical to SEQ ID NO: 11661

SEQ ID NO: 14118 - protein, 799 aa, Chloroflexus aggregans; identical to SEQ ID NO: 11662

SEQ ID NO: 14119 - protein, 912 aa, Methanosphaerula palustris; identical to SEQ ID NO: 11659

SEQ ID NO: 14120 - protein, 860 aa, Desulfovibrio desulfuricans; identical to SEQ ID NO: 11663

SEQ ID NO: 14121 - protein, 887 aa, Anaeromyxobacter dehalogenans; identical to SEQ ID NO: 11665

SEQ ID NO: 14122 - protein, 773 aa, Thermomicrobium roseum; identical to SEQ ID NO: 11667

SEQ ID NO: 14123 - protein, 939 aa, Halorubrum lacusprofundi
MELPLISHPRETDKNRQHPADQTTEEGHLLLTAHSTSVPERATTLFAGPTERELWLWVAATLHDFGKATPQFQEHVRPDEEYEGPDAEKNHARLGALATWFVLNRASASDRDCLAATLAVARHHQALPNAAEYTANTLIEAFDEAVIQAQLDRIDDTWPEAADEFFAMAGQQFDTVDTVSWEAFYKWASNGEIIPGLQALSTEAELTGRRKSNKNLPEALYDRTIHYWASLTLADKSHAMTISDNELFGFDTLDLSTLEQYIAGLRATPPDDEHEAALNDERERARRQAVCGVHEWLDNDESAIATLTLPTGLGKTFTGLSAGFETRDILDGRNDRDHPRPLVYALPYTSIIEQTRELFENPELWGVDPTRSALTVHHYLSETVVIHGDHDDSDVDITDADQAGLLGESWRDGTILTTFVQLFESLTGPSNRQGLKLPALDSGIVILDEPQALPKDWWDAIPRLLSTLTDEFDTHIISMTATQPSVLREVNTVSLLEDGQTHNVTACEACSQRPAYETDLPPANEERYFDQAERVQYTLDKTALTHQINSDNGFIGYEEAATRIIDRTETGESTLTVCNTIASSAELTDIICENETVAHLGVAVREYLTSNNISAIDPEQSPKEIAYEVLASHRLIPPVDKTGSWSTPESSSLFVLTFNSRYRPFDRRILIHLLTMLSTAPVRFVCVSTQAIEAGVDVSFKTVFRDIAPIDSIVQAAGRCNRSYEWGKNGGRVIVWTIADPDEETPAEPTEKPPAGYVYERGSNEAGVRGHLRLISDVLADIGETEQIPDVSISLHAVEAYFEQIHTTKSVANTDIRDHIENAEARWLARQSLIGGYETVDVLVAVTEADKKTLEKITEAFCANDSFGFKKLDEASQLRVSLPVRTMEDAPKIQRIDHRDRGDEGAQVFEYRGGSGLEYGFDSGGLQGVEDTILGRFSV

SEQ ID NO: 14124 - protein, 753 aa, Desulfobacterium autotrophicum; identical to SEQ ID NO: 11671

SEQ ID NO: 14125 - protein, 755 aa, Sulfurihydrogenibium azorense; identical to SEQ ID NO: 11672

SEQ ID NO: 14126 - protein, 762 aa, Sulfurihydrogenibium azorense; identical to SEQ ID NO: 11673

SEQ ID NO: 14127 - protein, 661 aa, Azotobacter vinelandii; identical to SEQ ID NO: 11675

SEQ ID NO: 14128 - protein, 548 aa, Sulfolobus islandicus; identical to SEQ ID NO: 11677

SEQ ID NO: 14129 - protein, 501 aa, Sulfolobus islandicus; identical to SEQ ID NO: 11678

SEQ ID NO: 14130 - protein, 501 aa, Sulfolobus islandicus; identical to SEQ ID NO: 11676

SEQ ID NO: 14131 - protein, 501 aa, Sulfolobus islandicus; identical to SEQ ID NO: 11679

SEQ ID NO: 14132 - protein, 501 aa, Sulfolobus islandicus; identical to SEQ ID NO: 11680

SEQ ID NO: 14133 - protein, 501 aa, Sulfolobus islandicus; identical to SEQ ID NO: 11682

SEQ ID NO: 14134 - protein, 501 aa, Sulfolobus islandicus; identical to SEQ ID NO: 11685

SEQ ID NO: 14135 - protein, 704 aa, Lachnospiraceae; identical to SEQ ID NO: 11686

SEQ ID NO: 14136 - protein, 772 aa, Methylorubrum extorquens; identical to SEQ ID NO: 11689

SEQ ID NO: 14137 - protein, 871 aa, Dickeya chrysanthemi; identical to SEQ ID NO: 11693

SEQ ID NO: 14138 - protein, 763 aa, Aggregatibacter aphrophilus; identical to SEQ ID NO: 11691

SEQ ID NO: 14139 - protein, 914 aa, Rippkaea orientalis; identical to SEQ ID NO: 11696

SEQ ID NO: 14140 - protein, 1120 aa, Lancefieldella parvula; identical to SEQ ID NO: 11703

SEQ ID NO: 14141 - protein, 746 aa, Zymomonas mobilis; identical to SEQ ID NO: 11708

SEQ ID NO: 14142 - protein, 753 aa, Halothiobacillus neapolitanus; identical to SEQ ID NO: 11712

SEQ ID NO: 14143 - protein, 791 aa, Rhodothermus marinus; identical to SEQ ID NO: 11713

SEQ ID NO: 14144 - protein, 933 aa, Thermomonospora curvata; identical to SEQ ID NO: 11714

SEQ ID NO: 14145 - protein, 694 aa, Thermomonospora curvata; identical to SEQ ID NO: 11715

SEQ ID NO: 14146 - protein, 965 aa, Thermomonospora curvata; identical to SEQ ID NO: 11716

SEQ ID NO: 14147 - protein, 737 aa, Sulfurospirillum deleyianum; identical to SEQ ID NO: 11717

SEQ ID NO: 14148 - protein, 858 aa, Thermobaculum terrenum; identical to SEQ ID NO: 11718

SEQ ID NO: 14149 - protein, 847 aa, Bifidobacterium dentium; identical to SEQ ID NO: 11719

SEQ ID NO: 14150 - protein, 763 aa, Xanthomonas albilineans; identical to SEQ ID NO: 12096

SEQ ID NO: 14151 - protein, 762 aa, Spirosoma linguale; identical to SEQ ID NO: 11720

SEQ ID NO: 14152 - protein, 728 aa, Acidaminococcus fermentans; identical to SEQ ID NO: 11721

SEQ ID NO: 14153 - protein, 507 aa, Sulfolobus islandicus; identical to SEQ ID NO: 11722

SEQ ID NO: 14154 - protein, 941 aa, Methanobrevibacter ruminantium; identical to SEQ ID NO: 11723

SEQ ID NO: 14155 - protein, 768 aa, Hydrogenobacter thermophilus; identical to SEQ ID NO: 11770

SEQ ID NO: 14156 - protein, 542 aa, Ferroglobus placidus; identical to SEQ ID NO: 11724

SEQ ID NO: 14157 - protein, 787 aa, Methanocaldococcus sp. FS406-22; identical to SEQ ID NO: 11725

SEQ ID NO: 14158 - protein, 549 aa, Methanocaldococcus sp. FS406-22; identical to SEQ ID NO: 11726

SEQ ID NO: 14159 - protein, 892 aa, Dehalococcoides mccartyi; identical to SEQ ID NO: 11727

SEQ ID NO: 14160 - protein, 568 aa, Thermocrinis albus; identical to SEQ ID NO: 11728

SEQ ID NO: 14161 - protein, 778 aa, Deferribacter desulfuricans; identical to SEQ ID NO: 12049

SEQ ID NO: 14162 - protein, 801 aa, Deferribacter desulfuricans; identical to SEQ ID NO: 12050

SEQ ID NO: 14163 - protein, 730 aa, Nitrosococcus halophilus; identical to SEQ ID NO: 11730

SEQ ID NO: 14164 - protein, 760 aa, Aminobacterium colombiense; identical to SEQ ID NO: 11731

SEQ ID NO: 14165 - protein, 754 aa, Rhodobacter capsulatus; identical to SEQ ID NO: 11732

SEQ ID NO: 14166 - protein, 853 aa, Kyrpidia tusciae; identical to SEQ ID NO: 11733

SEQ ID NO: 14167 - protein, 806 aa, Kyrpidia tusciae; identical to SEQ ID NO: 11734

SEQ ID NO: 14168 - protein, 750 aa, Methanocaldococcus infernus; identical to SEQ ID NO: 11735

SEQ ID NO: 14169 - protein, 980 aa, Legionella pneumophila
MMVVFISQCEKKALARTRRVLDAFADRIGDKTWQTVITQEGLLAVKKLLRKTASKNTAVCCHWIRTRSKTELVWVVGRRQAFNHLGVVPVNFTSKEVIMDKLPIETGHLIANTKAQLLSHHLFSVGYVAYYLLEKMGVDDYKLRQSAFISGILHDIGKIDPAFQSWVCKKNNKLSENIVPEDGVHIDSPKRFSFESYPRHHELSWLLSEALLVESCSLSKHQRIQIAHGIYWHHTKPFRRDDKFIDAEKIFTIFNASLGNMTINDIYFQAKVVLKDVSVFVSKFNISSLMPDFAKIFVLTENNLPKFKKYDNILDDLERYKNDIRHNALNNLIRSAVISADRLVSSCSAEDLEEYLAEGSLKELVDNLEQGDGQLLNGIRSCLEGFEKRFPSSDQNRVQSEVAKKLSNLQKIAKINGLPNISVLEGPAGCGKTKISLEWALLTEAKKIIWICPRVQVCLGLLNDLTGSDYLPDCHIEIFTGEYKKILSGGIAFDDAPETNEDAYFSGDIVITTIDQAVNTVITHHKVVALTDLMQAHVVFDEFHELIHMPAFNLLFAELLEAKKKRVSQANTLLVSATPHYFFLKEFLDIPSEDIVAIESFNRSRYLIEFKTYNEKEVLSPLITEDQQSNTFIISNTAQDAQLGYLKHYSTENSVLLHSKYTKQDKAYWFNQVYESFKRNGNRRFDVLRSGPIIQASLNISCDRMLTELTCAENWLQRLGRLDRFGVNTEVNHYITVLPESIGREGKQTSHCARFLNQLCIWQSTKAWLKFLKDKLTDNGEVNINQLYKYYREFYSNPASQKALKEDFLKALKKSVDLINDKVIDPISIPQKTKRTDEIIKISANSLRSDSRFVQMAICRVTETLRYEFINDYAYSEDLDSSLLQTYLTASVESMRGYGEDNNNLVQYMRKKHHNIKYGSGYKQARNEWDLIKEARSPETPIYLSYTPNDLEHIGGMDVAHPQAIYYVISDKQPVGAMSI

SEQ ID NO: 14170 - protein, 733 aa, Thiomonas; identical to SEQ ID NO: 12095

SEQ ID NO: 14171 - protein, 764 aa, Brachyspira murdochii; identical to SEQ ID NO: 11737

SEQ ID NO: 14172 - protein, 735 aa, Thermincola potens; identical to SEQ ID NO: 11738

SEQ ID NO: 14173 - protein, 746 aa, Thermincola potens; identical to SEQ ID NO: 11739

SEQ ID NO: 14174 - protein, 604 aa, Thermosphaera aggregans; identical to SEQ ID NO: 11741

SEQ ID NO: 14175 - protein, 968 aa, Thermobispora bispora; identical to SEQ ID NO: 11740

SEQ ID NO: 14176 - protein, 738 aa, Arcobacter nitrofigilis; identical to SEQ ID NO: 11742

SEQ ID NO: 14177 - protein, 725 aa, Geobacillus sp. C56-T3; identical to SEQ ID NO: 11752

SEQ ID NO: 14178 - protein, 777 aa, Thermoanaerobacter mathranii; identical to SEQ ID NO: 11743

SEQ ID NO: 14179 - protein, 784 aa, Thermoanaerobacter mathranii; identical to SEQ ID NO: 11744

SEQ ID NO: 14180 - protein, 1084 aa, Meiothermus silvanus; identical to SEQ ID NO: 11745

SEQ ID NO: 14181 - protein, 850 aa, Meiothermus silvanus; identical to SEQ ID NO: 11746

SEQ ID NO: 14182 - protein, 747 aa, Starkeya novella; identical to SEQ ID NO: 11747

SEQ ID NO: 14183 - protein, 881 aa, Arcanobacterium haemolyticum; identical to SEQ ID NO: 11748

SEQ ID NO: 14184 - protein, 760 aa, Syntrophothermus lipocalidus; identical to SEQ ID NO: 11749

SEQ ID NO: 14185 - protein, 724 aa, Syntrophothermus lipocalidus; identical to SEQ ID NO: 11750

SEQ ID NO: 14186 - protein, 772 aa, Truepera radiovictrix; identical to SEQ ID NO: 11751

SEQ ID NO: 14187 - protein, 881 aa, Methanococcus voltae; identical to SEQ ID NO: 11753

SEQ ID NO: 14188 - protein, 911 aa, Ralstonia solanacearum; identical to SEQ ID NO: 12104

SEQ ID NO: 14189 - protein, 759 aa, Amycolatopsis mediterranei; identical to SEQ ID NO: 11754

SEQ ID NO: 14190 - protein, 425 aa, Leuconostoc; identical to SEQ ID NO: 12112

SEQ ID NO: 14191 - protein, 741 aa, Sediminispirochaeta smaragdinae; identical to SEQ ID NO: 11756

SEQ ID NO: 14192 - protein, 910 aa, gamma proteobacterium HdN1; identical to SEQ ID NO: 12111

SEQ ID NO: 14193 - protein, 811 aa, Thermosediminibacter oceani; identical to SEQ ID NO: 11757

SEQ ID NO: 14194 - protein, 777 aa, Caldicellulosiruptor obsidiansis; identical to SEQ ID NO: 11758

SEQ ID NO: 14195 - protein, 823 aa, Caldicellulosiruptor obsidiansis; identical to SEQ ID NO: 11759

SEQ ID NO: 14196 - protein, 705 aa, Clostridium cellulovorans; identical to SEQ ID NO: 11761

SEQ ID NO: 14197 - protein, 788 aa, Thermoanaerobacterium thermosaccharolyticum; identical to SEQ ID NO: 11762

SEQ ID NO: 14198 - protein, 803 aa, Thermoanaerobacterium thermosaccharolyticum; identical to SEQ ID NO: 11763

SEQ ID NO: 14199 - protein, 706 aa, Parvularcula bermudensis; identical to SEQ ID NO: 11764

SEQ ID NO: 14200 - protein, 782 aa, Parvularcula bermudensis; identical to SEQ ID NO: 11765

SEQ ID NO: 14201 - protein, 769 aa, Spirochaeta thermophila; identical to SEQ ID NO: 11767

SEQ ID NO: 14202 - protein, 572 aa, Vulcanisaeta distributa; identical to SEQ ID NO: 11768

SEQ ID NO: 14203 - protein, 810 aa, Gardnerella vaginalis; identical to SEQ ID NO: 11771

SEQ ID NO: 14204 - protein, 726 aa, Geobacillus sp. Y4.1MC1; identical to SEQ ID NO: 11773

SEQ ID NO: 14205 - protein, 827 aa, Geobacillus sp. Y4.1MC1; identical to SEQ ID NO: 11774

SEQ ID NO: 14206 - protein, 777 aa, Caldicellulosiruptor hydrothermalis; identical to SEQ ID NO: 11778

SEQ ID NO: 14207 - protein, 819 aa, Halanaerobium hydrogeniformans; identical to SEQ ID NO: 11779

SEQ ID NO: 14208 - protein, 1070 aa, Bifidobacterium longum; identical to SEQ ID NO: 11776

SEQ ID NO: 14209 - protein, 914 aa, Caldicellulosiruptor owensensis; identical to SEQ ID NO: 11777

SEQ ID NO: 14210 - protein, 743 aa, Rhodomicrobium vannielii; identical to SEQ ID NO: 11772

SEQ ID NO: 14211 - protein, 912 aa, Caldicellulosiruptor kronotskyensis; identical to SEQ ID NO: 11782

SEQ ID NO: 14212 - protein, 777 aa, Caldicellulosiruptor kristjanssonii; identical to SEQ ID NO: 11780

SEQ ID NO: 14213 - protein, 822 aa, Caldicellulosiruptor kristjanssonii; identical to SEQ ID NO: 11781

SEQ ID NO: 14214 - protein, 761 aa, Neisseria lactamica; identical to SEQ ID NO: 12114

SEQ ID NO: 14215 - protein, 768 aa, Calditerrivibrio nitroreducens; identical to SEQ ID NO: 11783

SEQ ID NO: 14216 - protein, 758 aa, Thermococcus barophilus; identical to SEQ ID NO: 11784

SEQ ID NO: 14217 - protein, 814 aa, Ethanoligenens harbinense; identical to SEQ ID NO: 11786

SEQ ID NO: 14218 - protein, 1037 aa, Thermaerobacter marianensis; identical to SEQ ID NO: 11788

SEQ ID NO: 14219 - protein, 782 aa, Ruminococcus albus; identical to SEQ ID NO: 11785

SEQ ID NO: 14220 - protein, 772 aa, Rhodopseudomonas palustris; identical to SEQ ID NO: 11787

SEQ ID NO: 14221 - protein, 734 aa, Alicycliphilus denitrificans; identical to SEQ ID NO: 11791

SEQ ID NO: 14222 - protein, 747 aa, Thermovibrio ammonificans; identical to SEQ ID NO: 11790

SEQ ID NO: 14223 - protein, 715 aa, Bacteroides helcogenes; identical to SEQ ID NO: 11792

SEQ ID NO: 14224 - protein, 725 aa, Nitratifractor salsuginis; identical to SEQ ID NO: 11793

SEQ ID NO: 14225 - protein, 1068 aa, Anaerolinea thermophila; identical to SEQ ID NO: 12054

SEQ ID NO: 14226 - protein, 793 aa, Anaerolinea thermophila; identical to SEQ ID NO: 12055

SEQ ID NO: 14227 - protein, 590 aa, Desulfurococcus mucosus; identical to SEQ ID NO: 11794

SEQ ID NO: 14228 - protein, 835 aa, Acidovorax avenae; identical to SEQ ID NO: 11798

SEQ ID NO: 14229 - protein, 540 aa, Vulcanisaeta moutnovskia; identical to SEQ ID NO: 11804

SEQ ID NO: 14230 - protein, 896 aa, Odoribacter splanchnicus; identical to SEQ ID NO: 11805

SEQ ID NO: 14231 - protein, 798 aa, Syntrophobotulus glycolicus; identical to SEQ ID NO: 11806

SEQ ID NO: 14232 - protein, 769 aa, Rubinisphaera brasiliensis; identical to SEQ ID NO: 11807

SEQ ID NO: 14233 - protein, 754 aa, Nitrosomonas sp. AL212; identical to SEQ ID NO: 11809

SEQ ID NO: 14234 - protein, 732 aa, Archaeoglobus veneficus; identical to SEQ ID NO: 11810

SEQ ID NO: 14235 - protein, 758 aa, Marinithermus hydrothermalis; identical to SEQ ID NO: 11813

SEQ ID NO: 14236 - protein, 601 aa, Desulfobacca acetoxidans; identical to SEQ ID NO: 11812

SEQ ID NO: 14237 - protein, 1046 aa, Coriobacterium glomerans; identical to SEQ ID NO: 11811

SEQ ID NO: 14238 - protein, 822 aa, Methanothrix soehngenii; identical to SEQ ID NO: 11816

SEQ ID NO: 14239 - protein, 800 aa, Methanothrix soehngenii; identical to SEQ ID NO: 11817

SEQ ID NO: 14240 - protein, 672 aa, Clostridium botulinum; identical to SEQ ID NO: 11818

SEQ ID NO: 14241 - protein, 916 aa, Verrucosispora maris; identical to SEQ ID NO: 11815

SEQ ID NO: 14242 - protein, 498 aa, Metallosphaera cuprina; identical to SEQ ID NO: 11819

SEQ ID NO: 14243 - protein, 641 aa, Pyrococcus sp. NA2; identical to SEQ ID NO: 11821

SEQ ID NO: 14244 - protein, 783 aa, Thermodesulfobium narugense; identical to SEQ ID NO: 11823

SEQ ID NO: 14245 - protein, 767 aa, Porphyromonas asaccharolytica; identical to SEQ ID NO: 11822

SEQ ID NO: 14246 - protein, 755 aa, Haliscomenobacter hydrossis; identical to SEQ ID NO: 11824

SEQ ID NO: 14247 - protein, 362 aa, Melissococcus plutonius; identical to SEQ ID NO: 12057

SEQ ID NO: 14248 - protein, 485 aa, Acidianus hospitalis; identical to SEQ ID NO: 11826

SEQ ID NO: 14249 - protein, 1001 aa, Tepidanaerobacter acetatoxydans; identical to SEQ ID NO: 11825

SEQ ID NO: 14250 - protein, 815 aa, Mahella australiensis; identical to SEQ ID NO: 11827

SEQ ID NO: 14251 - protein, 787 aa, Thermoanaerobacterium xylanolyticum; identical to SEQ ID NO: 11828

SEQ ID NO: 14252 - protein, 728 aa, Desulfotomaculum nigrificans; identical to SEQ ID NO: 11832

SEQ ID NO: 14253 - protein, 781 aa, Desulfotomaculum nigrificans; identical to SEQ ID NO: 11833

SEQ ID NO: 14254 - protein, 767 aa, Porphyromonas gingivalis; identical to SEQ ID NO: 12058

SEQ ID NO: 14255 - protein, 754 aa, Methylomonas methanica; identical to SEQ ID NO: 11834

SEQ ID NO: 14256 - protein, 902 aa, Desulfofundulus kuznetsovii; identical to SEQ ID NO: 11835

SEQ ID NO: 14257 - protein, 836 aa, Desulfofundulus kuznetsovii; identical to SEQ ID NO: 11836

SEQ ID NO: 14258 - protein, 724 aa, Novosphingobium sp. PP1Y; identical to SEQ ID NO: 12124

SEQ ID NO: 14259 - protein, 791 aa, Desulfotomaculum ruminis; identical to SEQ ID NO: 11841

SEQ ID NO: 14260 - protein, 322 aa, Bacillus coagulans; identical to SEQ ID NO: 11852

SEQ ID NO: 14261 - protein, 726 aa, Parageobacillus thermoglucosidasius; identical to SEQ ID NO: 11848

SEQ ID NO: 14262 - protein, 827 aa, Parageobacillus thermoglucosidasius; identical to SEQ ID NO: 11849

SEQ ID NO: 14263 - protein, 713 aa, Flexistipes sinusarabici; identical to SEQ ID NO: 11854

SEQ ID NO: 14264 - protein, 917 aa, Methanosalsum zhilinae; identical to SEQ ID NO: 11853

SEQ ID NO: 14265 - protein, 762 aa, Ramlibacter tataouinensis; identical to SEQ ID NO: 11843

SEQ ID NO: 14266 - protein, 725 aa, Pyrococcus yayanosii; identical to SEQ ID NO: 11844

SEQ ID NO: 14267 - protein, 526 aa, Pyrococcus yayanosii; identical to SEQ ID NO: 11845

SEQ ID NO: 14268 - protein, 692 aa, Pyrococcus yayanosii; identical to SEQ ID NO: 11846

SEQ ID NO: 14269 - protein, 726 aa, Thermodesulfatator indicus; identical to SEQ ID NO: 11847

SEQ ID NO: 14270 - protein, 716 aa, Runella slithyformis; identical to SEQ ID NO: 11857

SEQ ID NO: 14271 - protein, 730 aa, Pseudothermotoga thermarum; identical to SEQ ID NO: 11850

SEQ ID NO: 14272 - protein, 742 aa, Pseudothermotoga thermarum; identical to SEQ ID NO: 11851

SEQ ID NO: 14273 - protein, 895 aa, Zymomonas mobilis; identical to SEQ ID NO: 11855

SEQ ID NO: 14274 - protein, 746 aa, Zymomonas mobilis; identical to SEQ ID NO: 11856

SEQ ID NO: 14275 - protein, 1080 aa, Treponema caldarium; identical to SEQ ID NO: 11858

SEQ ID NO: 14276 - protein, 788 aa, Sulfobacillus acidophilus; identical to SEQ ID NO: 11859

SEQ ID NO: 14277 - protein, 926 aa, Streptococcus; identical to SEQ ID NO: 11860

SEQ ID NO: 14278 - protein, 765 aa, Methanococcus maripaludis; identical to SEQ ID NO: 11861

SEQ ID NO: 14279 - protein, 768 aa, Thermococcus sp. 4557; identical to SEQ ID NO: 11863

SEQ ID NO: 14280 - protein, 730 aa, Megasphaera elsdenii; identical to SEQ ID NO: 12127

SEQ ID NO: 14281 - protein, 541 aa, Pyrolobus fumarii; identical to SEQ ID NO: 11864

SEQ ID NO: 14282 - protein, 638 aa, Pyrolobus fumarii; identical to SEQ ID NO: 11865

SEQ ID NO: 14283 - protein, 593 aa, Pyrolobus fumarii; identical to SEQ ID NO: 11866

SEQ ID NO: 14284 - protein, 876 aa, Haloarcula hispanica; identical to SEQ ID NO: 11867

SEQ ID NO: 14285 - protein, 822 aa, Caldicellulosiruptor lactoaceticus; identical to SEQ ID NO: 11868

SEQ ID NO: 14286 - protein, 725 aa, Rhodothermus marinus; identical to SEQ ID NO: 11870

SEQ ID NO: 14287 - protein, 770 aa, Lactobacillus ruminis; identical to SEQ ID NO: 11871

SEQ ID NO: 14288 - protein, 783 aa, Sphingobium sp. SYK-6; identical to SEQ ID NO: 12062

SEQ ID NO: 14289 - protein, 741 aa, Roseburia hominis; identical to SEQ ID NO: 11872

SEQ ID NO: 14290 - protein, 743 aa, Candidatus Arthromitus sp. SFB-rat-Yit; identical to SEQ ID NO: 12065

SEQ ID NO: 14291 - protein, 787 aa, Bacillus coagulans; identical to SEQ ID NO: 11876

SEQ ID NO: 14292 - protein, 827 aa, Chloracidobacterium thermophilum; identical to SEQ ID NO: 11877

SEQ ID NO: 14293 - protein, 470 aa, Tetragenococcus halophilus; identical to SEQ ID NO: 12066

SEQ ID NO: 14294 - protein, 596 aa, Thermoproteus tenax; identical to SEQ ID NO: 12128

SEQ ID NO: 14295 - protein, 566 aa, Thermoproteus tenax; identical to SEQ ID NO: 14

SEQ ID NO: 14296 - protein, 767 aa, Methylomicrobium alcaliphilum; identical to SEQ ID NO: 12130

SEQ ID NO: 14297 - protein, 744 aa, Pseudoxanthomonas spadix; identical to SEQ ID NO: 11879

SEQ ID NO: 14298 - protein, 739 aa, Thermovirga lienii; identical to SEQ ID NO: 11881

SEQ ID NO: 14299 - protein, 923 aa, Niastella koreensis; identical to SEQ ID NO: 11887

SEQ ID NO: 14300 - protein, 694 aa, Tannerella forsythia; identical to SEQ ID NO: 11889

SEQ ID NO: 14301 - protein, 869 aa, Burkholderia sp. YI23; identical to SEQ ID NO: 11884

SEQ ID NO: 14302 - protein, 730 aa, Hungateiclostridium clariflavum; identical to SEQ ID NO: 11886

SEQ ID NO: 14303 - protein, 490 aa, Pyrobaculum ferrireducens; identical to SEQ ID NO: 11882

SEQ ID NO: 14304 - protein, 783 aa, Marinitoga piezophila; identical to SEQ ID NO: 11892

SEQ ID NO: 14305 - protein, 876 aa, Corynebacterium diphtheriae; identical to SEQ ID NO: 11890

SEQ ID NO: 14306 - protein, 721 aa, Desulfovibrio desulfuricans; identical to SEQ ID NO: 12476

SEQ ID NO: 14307 - protein, 584 aa, Pyrobaculum oguniense; identical to SEQ ID NO: 11895

SEQ ID NO: 14308 - protein, 959 aa, Pararhodospirillum photometricum
MRRVTSFRVTGVNIADISAPFPHFGSRTGGLPENVRYSTSLRDTFSYFFFCWGWGMEDWKKFWGKARPKGKIGAHPALYHALDVAACVEALLKADPGREALWAATLGVERETARAVAVCCAAVHDLGKLSAPFQIKVPALWPSCLGQPASPPSPSHDTAGWLWWQAKAPSEATSLAPLMRAAFGHHGEPPHKSDDLSPLRLAMAFPPAASEVAAEFVRWVFQTLPQRPIPVLREDRATAASFLLAGLVTLGDWLGSSQTWFEYTAPDLTWGAYWAKAQAQAQKAVAAAGLQPALSAARLGYTDLGIDKPPTPLQAWAQDVALPEGPLLVVLEDLTGSGKTEAALMLAHRLIASGRAQGLYFALPTQATANALFDRLARVIRAFFAPDTTPSLALTHGDRAMHPGFRAALNRGAALGFEASQKRQEKPEGDTVADISAEAQCAAWVGEDRRLSFLADIGAGTLDQALLAILPARHAAVRRWGLLGKVLILDEIHAYDAYMGEEIIALIEAHAAEGGHTLLLSATLPQNRRRALEEAFHRGTSTPRPASRGFGAAGQALAAKFAHPPKPPPPPPEGFPRAGVVSADHQTADFPPPWPARIRRLPVKRVDSIDQALAQVAAAARAGQAVLLLRNTVDEALSSHAALRALGLEPWLFHARFALGDRQNIERRVMETFGRESTPEQRRGQILVATQVVEQSLDLDFDALFTDLAPIDLLIQRAGRLWRHLRALRHGAPVLHVIAPERSDPAAWVRHLPPGTAAVYQDLGVLWRTAETLEAEGALDLPERARTLIDAVYDATRAAPLPDAVARAAEEAQGKAYAHQSLARTQVLPRHEGYRRVSAWEDDRRVMTRWGEPTVSVVLARLEDGHPVPWCPAPAEAPQDMGWRLSRVTLRAHQIAADPDPLPALAALRASWPAWERDMPIVLLHPDGNDVWSASARDDRGRPVRLRYSRERGASFGEE

SEQ ID NO: 14309 - protein, 790 aa, Caldilinea aerophila; identical to SEQ ID NO: 12070

SEQ ID NO: 14310 - protein, 726 aa, Arcobacter sp. L; identical to SEQ ID NO: 12063

SEQ ID NO: 14311 - protein, 812 aa, Bifidobacterium breve; identical to SEQ ID NO: 11831

SEQ ID NO: 14312 - protein, 817 aa, Thermus thermophilus; identical to SEQ ID NO: 11837

SEQ ID NO: 14313 - protein, 727 aa, Thermus thermophilus; identical to SEQ ID NO: 11838

SEQ ID NO: 14314 - protein, 501 aa, Sulfolobus islandicus; identical to SEQ ID NO: 11800

SEQ ID NO: 14315 - protein, 501 aa, Sulfolobus islandicus; identical to SEQ ID NO: 11801

SEQ ID NO: 14316 - protein, 745 aa, Thermus sp. CCB_US3_UF1; identical to SEQ ID NO: 11885

SEQ ID NO: 14317 - protein, 745 aa, Desulfovibrio vulgaris; identical to SEQ ID NO: 11775

SEQ ID NO: 14318 - protein, 906 aa, Haloquadratum walsbyi; identical to SEQ ID NO: 12126

SEQ ID NO: 14319 - protein, 552 aa, Fervidicoccus fontis; identical to SEQ ID NO: 11901

SEQ ID NO: 14320 - protein, 844 aa, Lactobacillus helveticus; identical to SEQ ID NO: 11799

SEQ ID NO: 14321 - protein, 910 aa, Ralstonia solanacearum; identical to SEQ ID NO: 11842

SEQ ID NO: 14322 - protein, 817 aa, Thermus thermophilus; identical to SEQ ID NO: 11900

SEQ ID NO: 14323 - protein, 844 aa, Deinococcus gobiensis; identical to SEQ ID NO: 11898

SEQ ID NO: 14324 - protein, 984 aa, Deinococcus gobiensis; identical to SEQ ID NO: 11899

SEQ ID NO: 14325 - protein, 823 aa, Borrelia crocidurae; identical to SEQ ID NO: 11902

SEQ ID NO: 14326 - protein, 821 aa, Aggregatibacter actinomycetemcomitans; identical to SEQ ID NO: 11904

SEQ ID NO: 14327 - protein, 749 aa, Aggregatibacter actinomycetemcomitans; identical to SEQ ID NO: 11905

SEQ ID NO: 14328 - protein, 991 aa, Methylophaga nitratireducenticrescens; identical to SEQ ID NO: 11903

SEQ ID NO: 14329 - protein, 684 aa, Mesotoga prima; identical to SEQ ID NO: 11906

SEQ ID NO: 14330 - protein, 781 aa, Mesotoga; identical to SEQ ID NO: 11907

SEQ ID NO: 14331 - protein, 524 aa, Pyrococcus sp. ST04; identical to SEQ ID NO: 11909

SEQ ID NO: 14332 - protein, 803 aa, Tistrella mobilis; identical to SEQ ID NO: 11910

SEQ ID NO: 14333 - protein, 787 aa, Thermoanaerobacterium aotearoense; identical to SEQ ID NO: 11911

SEQ ID NO: 14334 - protein, 781 aa, Thermoanaerobacterium aotearoense; identical to SEQ ID NO: 11912

SEQ ID NO: 14335 - protein, 622 aa, Desulfurococcus amylolyticus; identical to SEQ ID NO: 11913

SEQ ID NO: 14336 - protein, 609 aa, Desulfurococcus amylolyticus; identical to SEQ ID NO: 11914

SEQ ID NO: 14337 - protein, 861 aa, Sulfurospirillum barnesii; identical to SEQ ID NO: 11915

SEQ ID NO: 14338 - protein, 877 aa, Thiocystis violascens; identical to SEQ ID NO: 11916

SEQ ID NO: 14339 - protein, 632 aa, Aequorivita sublithincola; identical to SEQ ID NO: 11917

SEQ ID NO: 14340 - protein, 725 aa, Thermococcus cleftensis; identical to SEQ ID NO: 11918

SEQ ID NO: 14341 - protein, 705 aa, Thermococcus cleftensis; identical to SEQ ID NO: 11919

SEQ ID NO: 14342 - protein, 763 aa, Acetomicrobium mobile; identical to SEQ ID NO: 11920

SEQ ID NO: 14343 - protein, 810 aa, Desulfosporosinus acidiphilus; identical to SEQ ID NO: 11921

SEQ ID NO: 14344 - protein, 776 aa, Taylorella equigenitalis; identical to SEQ ID NO: 11923

SEQ ID NO: 14345 - protein, 875 aa, Melioribacter roseus; identical to SEQ ID NO: 11924

SEQ ID NO: 14346 - protein, 719 aa, Desulfobacula toluolica; identical to SEQ ID NO: 12155

SEQ ID NO: 14347 - protein, 800 aa, Desulfobacula toluolica; identical to SEQ ID NO: 12156

SEQ ID NO: 14348 - protein, 655 aa, Gottschalkia acidurici; identical to SEQ ID NO: 11928

SEQ ID NO: 14349 - protein, 374 aa, Bacillus thuringiensis; identical to SEQ ID NO: 11929

SEQ ID NO: 14350 - protein, 696 aa, Candidatus Nitrososphaera gargensis; identical to SEQ ID NO: 11930

SEQ ID NO: 14351 - protein, 1055 aa, Bifidobacterium asteroides; identical to SEQ ID NO: 11931

SEQ ID NO: 14352 - protein, 755 aa, Thermacetogenium phaeum; identical to SEQ ID NO: 11933

SEQ ID NO: 14353 - protein, 969 aa, Gluconobacter oxydans; identical to SEQ ID NO: 11935

SEQ ID NO: 14354 - protein, 744 aa, Saccharothrix espanaensis; identical to SEQ ID NO: 12138

SEQ ID NO: 14355 - protein, 812 aa, Synechococcus sp. PCC 6312; identical to SEQ ID NO: 11936

SEQ ID NO: 14356 - protein, 893 aa, Chroococcidiopsis thermalis; identical to SEQ ID NO: 11938

SEQ ID NO: 14357 - protein, 728 aa, Chamaesiphon minutus; identical to SEQ ID NO: 11939

SEQ ID NO: 14358 - protein, 740 aa, Pseudanabaena sp. PCC 7367; identical to SEQ ID NO: 11937

SEQ ID NO: 14359 - protein, 796 aa, Gloeocapsa sp. PCC 7428; identical to SEQ ID NO: 11941

SEQ ID NO: 14360 - protein, 760 aa, Stanieria cyanosphaera; identical to SEQ ID NO: 11942

SEQ ID NO: 14361 - protein, 910 aa, Cyanobacterium aponinum; identical to SEQ ID NO: 11944

SEQ ID NO: 14362 - protein, 769 aa, Cyanobacterium stanieri; identical to SEQ ID NO: 11943

SEQ ID NO: 14363 - protein, 875 aa, Natronobacterium gregoryi; identical to SEQ ID NO: 11946

SEQ ID NO: 14364 - protein, 750 aa, Singulisphaera acidiphila; identical to SEQ ID NO: 11947

SEQ ID NO: 14365 - protein, 702 aa, Thermobacillus composti; identical to SEQ ID NO: 11948

SEQ ID NO: 14366 - protein, 796 aa, Thermobacillus composti; identical to SEQ ID NO: 11949

SEQ ID NO: 14367 - protein, 762 aa, Thermobacillus composti; identical to SEQ ID NO: 11950

SEQ ID NO: 14368 - protein, 733 aa, Aciduliprofundum sp. MAR08-339; identical to SEQ ID NO: 11954

SEQ ID NO: 14369 - protein, 714 aa, Methanoregula formicica; identical to SEQ ID NO: 11951

SEQ ID NO: 14370 - protein, 812 aa, Methanoregula formicica; identical to SEQ ID NO: 11952

SEQ ID NO: 14371 - protein, 728 aa, Methanoregula formicica; identical to SEQ ID NO: 11953

SEQ ID NO: 14372 - protein, 744 aa, Mycobacterium canettii; identical to SEQ ID NO: 12146

SEQ ID NO: 14373 - protein, 804 aa, Mycobacterium canettii; identical to SEQ ID NO: 12147

SEQ ID NO: 14374 - protein, 787 aa, Thermoanaerobacterium thermosaccharolyticum; identical to SEQ ID NO: 11955

SEQ ID NO: 14375 - protein, 780 aa, Halobacteroides halobius; identical to SEQ ID NO: 11957

SEQ ID NO: 14376 - protein, 716 aa, Chamaesiphon minutus; identical to SEQ ID NO: 11940

SEQ ID NO: 14377 - protein, 744 aa, Myxococcus stipitatus; identical to SEQ ID NO: 11958

SEQ ID NO: 14378 - protein, 770 aa, Myxococcus stipitatus; identical to SEQ ID NO: 11959

SEQ ID NO: 14379 - protein, 781 aa, Thermoclostridium stercorarium; identical to SEQ ID NO: 11960

SEQ ID NO: 14380 - protein, 737 aa, Thermoclostridium stercorarium; identical to SEQ ID NO: 11961

SEQ ID NO: 14381 - protein, 405 aa, Enterococcus faecium; identical to SEQ ID NO: 11962

SEQ ID NO: 14382 - protein, 738 aa, Clostridium saccharoperbutylacetonicum; identical to SEQ ID NO: 11963

SEQ ID NO: 14383 - protein, 892 aa, Dehalococcoides mccartyi; identical to SEQ ID NO: 11966

SEQ ID NO: 14384 - protein, 763 aa, Hydrogenobaculum; identical to SEQ ID NO: 11829

SEQ ID NO: 14385 - protein, 735 aa, Hydrogenobaculum; identical to SEQ ID NO: 11830

SEQ ID NO: 14386 - protein, 803 aa, Candidatus Cloacimonas acidaminovorans; identical to SEQ ID NO: 12091

SEQ ID NO: 14387 - protein, 787 aa, Bibersteinia trehalosi; identical to SEQ ID NO: 11970

SEQ ID NO: 14388 - protein, 812 aa, Bifidobacterium; identical to SEQ ID NO: 11572

SEQ ID NO: 14389 - protein, 821 aa, Bifidobacterium thermophilum; identical to SEQ ID NO: 11971

SEQ ID NO: 14390 - protein, 881 aa, Edwardsiella piscicida; identical to SEQ ID NO: 11972

SEQ ID NO: 14391 - protein, 756 aa, Thalassolituus oleivorans; identical to SEQ ID NO: 12228

SEQ ID NO: 14392 - protein, 904 aa, Faecalibacterium prausnitzii; identical to SEQ ID NO: 12108

SEQ ID NO: 14393 - protein, 764 aa, Fretibacterium fastidiosum; identical to SEQ ID NO: 12109

SEQ ID NO: 14394 - protein, 719 aa, Faecalibacterium prausnitzii; identical to SEQ ID NO: 12107

SEQ ID NO: 14395 - protein, 884 aa, Eubacterium  siraeum; identical to SEQ ID NO: 12110

SEQ ID NO: 14396 - protein, 501 aa, Sulfolobus islandicus; identical to SEQ ID NO: 11981

SEQ ID NO: 14397 - protein, 761 aa, Archaeoglobus sulfaticallidus; identical to SEQ ID NO: 11986

SEQ ID NO: 14398 - protein, 498 aa, Bacillus sp. 1NLA3E; identical to SEQ ID NO: 11985

SEQ ID NO: 14399 - protein, 367 aa, Streptococcus cristatus; identical to SEQ ID NO: 11987

SEQ ID NO: 14400 - protein, 2930 aa, Saprospira grandis; identical to SEQ ID NO: 11897

SEQ ID NO: 14401 - protein, 927 aa, Thermus scotoductus; identical to SEQ ID NO: 11797

SEQ ID NO: 14402 - protein, 738 aa, Desulfobulbus propionicus; identical to SEQ ID NO: 11796

SEQ ID NO: 14403 - protein, 821 aa, Ammonifex degensii; identical to SEQ ID NO: 11709

SEQ ID NO: 14404 - protein, 801 aa, Desulfofarcimen acetoxidans; identical to SEQ ID NO: 11705

SEQ ID NO: 14405 - protein, 762 aa, Desulfofarcimen acetoxidans; identical to SEQ ID NO: 11706

SEQ ID NO: 14406 - protein, 836 aa, Desulfofarcimen acetoxidans; identical to SEQ ID NO: 11707

SEQ ID NO: 14407 - protein, 732 aa, Eggerthella lenta; identical to SEQ ID NO: 11704

SEQ ID NO: 14408 - protein, 856 aa, Halomicrobium mukohataei; identical to SEQ ID NO: 11702

SEQ ID NO: 14409 - protein, 871 aa, Candidatus Accumulibacter phosphatis; identical to SEQ ID NO: 11699

SEQ ID NO: 14410 - protein, 711 aa, Candidatus Accumulibacter phosphatis; identical to SEQ ID NO: 11700

SEQ ID NO: 14411 - protein, 804 aa, Leptotrichia buccalis; identical to SEQ ID NO: 11701

SEQ ID NO: 14412 - protein, 832 aa, Saccharomonospora viridis; identical to SEQ ID NO: 11695

SEQ ID NO: 14413 - protein, 549 aa, Methanocaldococcus fervens; identical to SEQ ID NO: 11697

SEQ ID NO: 14414 - protein, 787 aa, Methanocaldococcus fervens; identical to SEQ ID NO: 11698

SEQ ID NO: 14415 - protein, 818 aa, Teredinibacter turnerae; identical to SEQ ID NO: 11684

SEQ ID NO: 14416 - protein, 743 aa, Geobacter sp. M21; identical to SEQ ID NO: 11694

SEQ ID NO: 14417 - protein, 698 aa, Paenibacillus sp. JDR-2; identical to SEQ ID NO: 11692

SEQ ID NO: 14418 - protein, 733 aa, Thermococcus sibiricus; identical to SEQ ID NO: 11690

SEQ ID NO: 14419 - protein, 667 aa, Thermococcus gammatolerans; identical to SEQ ID NO: 11688

SEQ ID NO: 14420 - protein, 768 aa, Desulfovibrio magneticus; identical to SEQ ID NO: 12047

SEQ ID NO: 14421 - protein, 726 aa, Geobacillus sp. WCH70; identical to SEQ ID NO: 11687

SEQ ID NO: 14422 - protein, 472 aa, Exiguobacterium; identical to SEQ ID NO: 11683

SEQ ID NO: 14423 - protein, 771 aa, Acidobacterium capsulatum; identical to SEQ ID NO: 11674

SEQ ID NO: 14424 - protein, 775 aa, Caldicellulosiruptor bescii; identical to SEQ ID NO: 11670

SEQ ID NO: 14425 - protein, 728 aa, Ruminiclostridium cellulolyticum; identical to SEQ ID NO: 11666

SEQ ID NO: 14426 - protein, 783 aa, Methylobacterium nodulans; identical to SEQ ID NO: 11664

SEQ ID NO: 14427 - protein, 805 aa, Desulfitobacterium hafniense; identical to SEQ ID NO: 11660

SEQ ID NO: 14428 - protein, 851 aa, Desulfatibacillum aliphaticivorans; identical to SEQ ID NO: 11657

SEQ ID NO: 14429 - protein, 716 aa, Butyricicoccus pullicaecorum; identical to SEQ ID NO: 12998

SEQ ID NO: 14430 - protein, 743 aa, Enterococcus saccharolyticus; identical to SEQ ID NO: 13010

SEQ ID NO: 14431 - protein, 738 aa, Thermobifida fusca; identical to SEQ ID NO: 13000

SEQ ID NO: 14432 - protein, 759 aa, Clostridium sartagoforme; identical to SEQ ID NO: 12999

SEQ ID NO: 14433 - protein, 866 aa, Dorea sp. 5-2; identical to SEQ ID NO: 13009

SEQ ID NO: 14434 - protein, 445 aa, Lactobacillus sakei; identical to SEQ ID NO: 13001

SEQ ID NO: 14435 - protein, 721 aa, Lachnospiraceae bacterium A4; identical to SEQ ID NO: 13002

SEQ ID NO: 14436 - protein, 852 aa, Lachnospiraceae bacterium MD335; identical to SEQ ID NO: 13004

SEQ ID NO: 14437 - protein, 707 aa, Paenibacillus barengoltzii; identical to SEQ ID NO: 13005

SEQ ID NO: 14438 - protein, 719 aa, Anaerotruncus sp. G3(2012); identical to SEQ ID NO: 13007

SEQ ID NO: 14439 - protein, 826 aa, Firmicutes bacterium M10-2; identical to SEQ ID NO: 13006

SEQ ID NO: 14440 - protein, 845 aa, Fusobacterium nucleatum; identical to SEQ ID NO: 11990

SEQ ID NO: 14441 - protein, 948 aa, Methanobrevibacter sp. AbM4; identical to SEQ ID NO: 11991

SEQ ID NO: 14442 - protein, 845 aa, Fusobacterium nucleatum; identical to SEQ ID NO: 12376

SEQ ID NO: 14443 - protein, 897 aa, Actinotignum schaalii; identical to SEQ ID NO: 13016

SEQ ID NO: 14444 - protein, 747 aa, Delftia acidovorans; identical to SEQ ID NO: 13017

SEQ ID NO: 14445 - protein, 800 aa, Actinomyces sp. HPA0247; identical to SEQ ID NO: 13018

SEQ ID NO: 14446 - protein, 823 aa, Atopobium sp. oral taxon 199; identical to SEQ ID NO: 13019

SEQ ID NO: 14447 - protein, 704 aa, Pseudomonas; identical to SEQ ID NO: 11993

SEQ ID NO: 14448 - protein, 475 aa, Exiguobacterium sp. S17; identical to SEQ ID NO: 13021

SEQ ID NO: 14449 - protein, 534 aa, Exiguobacterium sp. S17; identical to SEQ ID NO: 13020

SEQ ID NO: 14450 - protein, 397 aa, Treponema vincentii
MTDFLNIPLYKPFVETLAAGGIIHPTPIQEKVIPLALEGKSIFFESETGTGKTLAFLLPLFTRLMQDEKKTIAPRILILSPTVELASQIKEAAAQLQGSGPQYFRTLLCVGGSSLKRQIEGLKEKPAVIIGTPARISDLIGLKKLKLQEITAVVIDEADRQLARESRDALQTVLATLPQDVQALACSATFNGKNIELLNGFLRRSSAAELPECLSIAHTGVLQNSIEHWALFSERRNKADTLRALIHALDNTSVHSAKKMLIFTAPAQEVETLAQKLQHKKIDAVPLYGKLEGSERKQIIARFRSGKTRILITSDLSARGLDIADIDYIVQMQLSKDADVFIHRAGRTGRAGKKGVNIVIGDEYELRILQALEKKLGITVYPKILTGGKIQSPSETA

SEQ ID NO: 14451 - protein, 376 aa, Treponema socranskii
MDTQNAFSLLSPEIRTKLQALSIVQPTPVQQKTIPLIIEGKNLLFQSETGTGKTFAYLLPLADNIDKAEKSGVKILIVAPTLELSSQIRDAALSISSKKCALLTGSVPIRRQTELLKGDPAIAVGNPARLLELVHLKKLKLNGLCAAVFDEVDRLVKKEIKDDLASLVSLFPKNVQLVGCSATVTKAVRAFFTECESISMPEEDVLRKRISHWAIYAESRDKIDTLKKLFAALDMQKALVFTSRGDQVENITSKLKYKNIDCEALYAKQDKQRRKRAIDRFKSGSCRILITSDVASRGLDFQGVSHVIQMDLNDDDDFFIHRAGRTGRAGKTGINIVVGDEYEMRHYSALEKRLKIIVYPKMLYRGEIVAPDAVSE

SEQ ID NO: 14452 - protein, 745 aa, Leptospira kirschneri; identical to SEQ ID NO: 13025

SEQ ID NO: 14453 - protein, 437 aa, Bacteroides sp. CAG:927; identical to SEQ ID NO: 12232

SEQ ID NO: 14454 - protein, 750 aa, Pseudomonas syringae
MNSQASSSDSSAFERLHPDVQQWVWSQGWTSLRDAQEWAIPALIDADRDVIIAASTAAGKTEAAFLPILTHLLNNTDAPGAVLYISPLKALINDQWDRLTRLCERLEIPVVGWHGDVSASRKHRFLKSPRGILLITPESLEALFVNRGSALAGLFQPLRYIVIDELHAFIGSERGKQLQSLMHRVETVVGKKLPRVGLSATLGEMALAREFLRPGQGRRMDEIISQASGQDLQVQVRGYTMLPMKKLTANLQMVVTKDDGNDDQDEEQEEDVSGTRHAIAAHMYKVLRGSNNLIFPNSRDKVEWYADRLRHLCENDGLPNEFLPHHGSLSRDLREDTERALKAGSPPASAVCTTTLELGIDIGNIKAVAQIGPPPSVASLRQRLGRSGRRAGEPATLRAYCQEDTLTPDSDLSDQLRQNLVQTIAMIRLLIEKWFEPPRANGLHASTLVQQCLSTIAQQGGAHASQLWNELIASGTFAAVDKTDFMALLKALGEKKLIVQDSSGLLLPGEIGEKLVNHYEFYSAFSSDEEFRLLRDGKPLGSIPVSRPLTLGQRIIFAGKRWQVMDVDLEKKVIAVIRARGGEPPIFDGLGAKIHDRVREEMRAVLTEVTPCPFLDANAQVLLAEARQTFHRLGLADQRLTGSTSSSYLLTWAGDYTNDALCLLLNQAGVMCTASGLVLEISASQESVRAALARIAELDATDVEPLLKDVKNLIREKWDWALPKSLLIKSFASSQLDIPNAIALAKTLTI

SEQ ID NO: 14455 - protein, 735 aa, Campylobacter ureolyticus
MLYSHPKKEYKNHIKNLVDSFDDKEFAKCAFYHDFAKQSDNFQKYITLKKENFATNKEFEKERNRLKTTHSLESAYIYFFMQDNKNIDFIINLCAILKHHSNLENFESMLNYLTCIENNLNSDEKISNITSSLKAADSKAFLEIIQKDKIYEFADFFDDILDEVKNFFKIENFFKFKDRYSKLILADKFEAIFDKPYKSLDFISSKICENIIQNIHAQISNKPPNDYKNSSRKTIFKNYEANKDKDKFIIKAPTGIGKTYIALELALKIATQKPKKRIITAIPFTSIIDQTFLEYEKVIPKNLGLLKYHYLSKYTDDEKEQFSKKIFLADIWHEPLIITTFNQLLNIFFSNSNKDNLKLQTLKNSVIIVDEIQNISRVLLQDLAFVFNEFGKIYNIDFIIMSATMPHLNLENFTIISESDFYKSKQNRYKISFFDEIKNIKDLVCVLNSQTKSTICVVNTIAKAQAIYKELKKDENLYLLTTHQMSKHRIELLKEISKKLKEQKPVKLIATQLIEAGVDLDFSVGFREFAPFTSIVQMAGRVNRNGIKSKISECFVFDFLEFENVDKKLPYHGIDLQEEFVKNSLKNGIYENEIFEILEEYFKRVKDETTHTKINEKMRKLEFTTIYGDFTANFMPKQPWKVSVFIEERKDEFKEFIEKRDNILNSYDDKFEALAKIKDLEKTLLNQTININHKLIENLQLKEIFGRYILNFGFKNYTKEFGFTTDLTIEEEAFS

SEQ ID NO: 14456 - protein, 984 aa, Propionibacterium sp. oral taxon 192
MLTRKLAKVWAKSGYDPERPRWLPLWLHLLDAAAVAQHLARVWVAPTIGNLIEEQLKDSPSGLEPADEFVILASWLAAVHDIGKCTPAFSMQVKDLDDEMREAGLRHESIDPLERRKAPHGLAGHKILSSWLREIHGWDFEPAEALASIVGGHHGIPPTSQDLCQRLAGREHLFGDEAWRTAQHELLDLVTARTDAAPLLGIWANRSWPQHFLVELSGLVIVADWVSSCDDYFPLLARDDDGAKFFGSKAHEQRAQQGIARLEIPSPWRPRDDGATPDHLLMSRFILPMGATATAVQQKTVEAARSMELPGMLIIEESTGGGKTEAALIAAEILAARMGRSGLLFALPTQATTDAMFTRELDWLERIEHAYAGAGSPSAFAVSLQHGRARLNQKAWQLRRRGHEIHDRLLGGLGGDDPDEAGLRPHDIGRDEDVVLPSDEPAADQEHRADLAILSWFGGRKKSMLSDFVVTTIDHLLFAAMRAPHLMLRHLGLSRKVIIVDEVHSYSTYMNVYLDRALTWLGAYGVPVILLSATLSETRCATMVDAYRRGLHLSVGRKISKTPKPKPISTPFPCLITADADTTKVVATATSGRNSRVRIQRLAEEKDLSNLLRETLADGGCALVVRNTVRRAQETYEELRAVFGEDVSLNHARFTLADRLAKDADLLHRFGPPRNHPERPHRAVVIATQVVEQSLDVDFDLLVTDLAPIDLLLQRMGRLHRHTRPRPPRTIMPICWIDGLPFATNPDPRIESGAKMVYGAHDMLLTAVALNQVLAEEGTMSTPDDVHNLIERVYGPDPQVPGPWQQAVEQARTDAALQEERKREAAKGFLLTEPVVSGESSLVNWLQTVASDNEETGRAQVRDGEDSLEVILLDERRSGGQRDLYTLPSGSELPAMIIPTDRPPQRRIIRAMLMSAVRLPPRFTNPRTIDGVITQLEKYVIPAWQDDRDLRGQLFLPLINGHAELNGITLEYSPLTGLKEIDQK

SEQ ID NO: 14457 - protein, 757 aa, Neisseria sicca
MEDVESTKLRKIPHSTAGAKYAVERLNPFFGHLLAYLIAGHHAGLADWYDNGSLKHRLQQAGNELEASLSSLAESGLPKDFFPLSDDDLMRDFFAFWEDGAKLEELHIWLRFLFSCLVDADFLDTEAFMNGYADADTAQTAGLRPKFPGLDELHRRYEQYMAQLHEKSDKDSFLNQERHAILQQCFSAAETDRTLFSLTVPTGGGKTLASLGFALKHALKFGKKRIIYAIPFTSIIEQNANVFRKALGDDVVLEHHSNLEVKEDKETAKTRLATENWDAPLIVTTNVQLFESLFAAKTSRCRKIHNIADSVVILDEAQQLPRDFQKPITDMMRVLACDYGVTFVLCTATQPELGQNIDAFGRTILEGLPDVREIVTDKIALSEKLRRVCVKMPPPNDEMQSWQEIADEIAVRLCVLAVVNTRKHAQKLFAALPSDGIKLHLSANMCVTHRSEVIALVRRYLALYRAGSLHKPLWLVSTQLIEAGVDLDFPCVYRAMAGLDSIAQAAGRCNREGKLPQLGEVVVFRAEEGAPSGSLKQGQDITEEILKAGLLGDPLSPSAFAEYFRRFNGKGDVDKHGITTLLTAESSNENPLAIKFRTAAEHFRLIDNQGVALIVPFISLVHWEKDGSPQIVKANELDDFFRRYLDSVEISAWQDVLDKQRFPQPVDNSFGQTDQRPLPEPFESWFKFLESDPLKHKWVYRKLQRYTITVYEHELKKLPAHAVFSKAGLLVLDKGYYKAVLGADFDDTAWLPENSVL

SEQ ID NO: 14458 - protein, 703 aa, Actinoalloteichus spitiensis
MTNQLWAHSRNDKGERHTLRDHLISTGELAARFAEPFGAAPLARALGLFHDAGKASCSWQEALLAVEGQNRRTGVPHKEFGAVALRGPAHVAALAVLGHHVPENWRRRQSTAEVGIRLVFSALVDADRLDTGAHRAGTEPTVRPAPDMEQLWKRYDQERVNVLAKRAASGKRADPVVDAAREQVYQYAVRAAERPGGLFRLAAPTGSAKTMAAGAFALRHAALHGKSRVIVAVPFTTITEQNAGQYRELLDADRVLEHHSSVDLDTAPRWYRPAAENWDADFIVTTTVQLFDSLFGRKPERSRKLHRLANSVIVLDEVQALPLSLLTPILDVLRVLAEEFGTTVVLSSATQPAFQSLPVWKDFPVTDIVPDPTRLFDDLRRVRYEWWCDPRPTLAEVAEAALDERQCLVVVNTTGNARTVYRHANPDDETSPHVLHLSARMCGAHRQQVLHEANRRLNANEPVLLVSTQLIEAGVDIDFPVVYRVLAGADAVQQAAGRANREGVLGREGGRVVIVVPEDGGYPGAEYRALAEQTSVHFWAGQDPDRLDALDRYYRGVYSALNLTENRRANAVQRGRAAFDYQSVAEGPLLDAGGAGTARDRALAFRMIDEDTVPVVVDFHGKDKDHKGEGPRLVERLRSSTNPTPQDFRAVQPYVVPLPRALLNRPDIQAICRPVVGDLHEWAGDYHEAYGIDTTDIVQEEVW

SEQ ID NO: 14459 - protein, 501 aa, Sulfolobus islandicus
MLSLADFYNDFITRHGFEERKGIEETLLNLENGHSVILKAPTGYGKTTLTMILANAVSSDIDLGSRVIHVLPYRAIVQDLYLKLKNYADRGVIYTKSIGAQDMDYQDSPFFMKKINVTTLDTFILNLFKLSTVDFKLIFKNYGSHYEFPRALIYSSIVIFDEFHLLGEDGKSLGAGLAALEVLKDAGVPIVVTSATIDKGLERVLMNKLGKNVKVVNANDFKIDRNIYVNVLENDEISITEVKVKEGKRVLLVYNTRMGAIEAYKKLKGRGLSPILIHSKFSKKDRIDKVNKINEAKLVVSTQVIEAGIDTSFDVLITEASPSHNLIQRAGRVARYGKGGRGKLEGEVYIFPFSGKVYVEREVKETVERVRKLKTIDENLLIERDYTEVIDSILAKDLSVIDNSVFVDSKKVKSIYEEICSITRNASIILGFPPNSNDVNDAIPLTEEEAIKIIESKGSSAFVGNGNVKLYNKKCLQLEMLKNDILGVRIQDYNSEIGGVY

SEQ ID NO: 14460 - protein, 501 aa, Sulfolobus islandicus
MLSLADFYNDFITRHGFEERKGIEETLLNLENGHSVILKAPTGYGKTTLTMILANAVSSDIDLGSRVIHVLPYRAIVQDLYLKLKNYADRGVIYTKSIGAQDMDYQDSPFFMKKVNVTTLDTFILNLFKLPTVDFKLIFKNYGSHYEFPRALIYSSIVIFDEFHLLGEDGKSLGAGLAALEVLKDAGVPIVVTSATIDNGLERVLMNKLGKNVKVVNANDFKIDRNIYVNVLENDEISITEVKVKEGKRVLLVYNTRMGAIEAYKKLKGRGLSPILIHSKFSKKDRIDKVNKINEAKLVVSTQVIEAGIDTSFDVLITEASPSHNLIQRAGRVARYGKGGRGKLEGEVYIFPFSGKVYVEREVKETVERVRKLKTIDENLLIERDYTEVIDSILAKDLSVIDNSVFVDSKKVKSIYEEICSITRNASIILGFPPNSNDVNDAIPLTEEEAIKIIESKGSSAFVGNGNVKLYNKKCLQLEMLKNDILGVRIQDYNSEIGGVY

SEQ ID NO: 14461 - protein, 501 aa, Sulfolobus islandicus
MLSLADFYNDFITRHGFEERKGIEETLLNLENGHSVILKAPTGYGKTTLTMILANAVSSDIDLGSRVIHVLPYRAIVQDLYLKLKNYADRGVIYTKSIGAQDMDYQDSPFFMKKVNVTTLDTFILNLFKLSTVDFKLIFKNYGSHYEFPRALIYSSIVIFDEFHLLGEDGKSLGAGLAALEVLKDAGVPIVVTSATIDKGLERVLMNKLGKNVKVVNANDFKIDRNIYVNVLENDEISITEVKVKEGKRVLLVYNTRMGAIEAYKKLKGRGLSPILIHSKFSKKDRIDKVNKINEAKLVVSTQVIEAGIDTSFDVLITEASPSHNLIQRAGRVARYGKGGRGKLEGEVYIFPFSGKVYVEREVKETVERVRKLKTIDENLLIERDYTEVIDSILAKDLSVIDNSVFVDSKKVKSIYEEICSITRNASIILGFPPNSNDVNDAIPLTEEEAIKIIESKGSSAFVGNGNVKLYNKKCLQLEMLKNDILGVRIQDYNSEIGGVY

SEQ ID NO: 14462 - protein, 561 aa, Sulfolobus islandicus
MKELIAEMIKSWNEKGEIDNERLELQYKLAKEIFDKVDEGRLFILNLPTGIGKTEIFLAPFFYQFKVNDFFAGRMYIVEPTHALLTQMRDRVCNYVIGLQLDIPIGEDHGDVENPTFLYTAPITLTTIDSFAYGFLAKRVNKWWKYGYETGRYTLPVGLMGNSYIVFDEAHLIQDSVFLSPRVMGKIICNLVNSGAIVVFSSATLPKALLERLTRECKKVENLTVDLNVKRDVKITFNGDKQLTENEIDCEGNTLVILNTVERARSLYKKLRDKCKNVYILHSLMAIEDRRKVYDSVKIKMNNEDDLVLIGTQTLEVGLDFSFEKLYAEISPIDSLIQRFGRIGRRKEKKNEKSKEVNAIIFDVENNLPYLDSIIKATKDVLHSSTAYDNLVNSIDTVYDANKVKEIEEKGDLFYVEFLEYIENLHLFSYPPEDEVLVRPSNYIIIFILDDSLIESESDKELVLRKDGLDDKSLKYSISLVDNHSLKRLTTLLNGGNIYSYPYEKGGKIHVKKVTTLDRIINNALSIYVRKDDLYDEAGLKVELDKPKSESEGKKRRSKKK

SEQ ID NO: 14463 - protein, 485 aa, Sulfolobus islandicus
MSSLVDYYNDFIYKNKLEERKGIEQTLRELENGKNVILKAPTGYGKTTLTKILANAVERGNEIGSRVIHVLPLRAIVQDLYIKLIRDSKDGKIYTRSIGAQDMDYFSSPFFMKKVTVTTLDTFVMNLFKLPPVESRNIFNNYGSHYELPRAMIYSSIVIFDEAHLIGEEGRPLTAFLASLRVLSEVGVPIVIMSATIDEGLEKTIRNYINAEIVEANDYSIERNITVSKIEDPIEDARKQVREGKRVLLTFNTRRDAIDSYMRLRDLNPVLIHSKFNRFDRIELMWEVLDRNTKLVISTQVIEAGIDTTFDVLITEAAPAHNLIQRAGRVARYGGKGEVHVFPFRGKVYDEKEVSDTYNRISDRIDYSLLPRREYKVDNTLLHDLTVIDSIYADANRARSLYEQVCNIVRDTSIILGFPLHSDSTMFAIPLSEDEAKKLIEKGYPLVPEGKRLNTLNCLQLQMVKNSILGVRIKGYSREIGGILE

SEQ ID NO: 14464 - protein, 561 aa, Sulfolobus islandicus
MKELIAEMIKSWNEKGEIDNERLELQYKLAKEIFDKVDEGRLFILNLPTGIGKTEIFLAPFFYQFKVNDFFAGRMYIVEPTHALLTQMRDRVCNYVIGLQLDIPIGEDHGDVENPTFLYTAPITLTTIDSFAYGFLAKRVNKWWKYGYETGRYTLPVGLMGNSYIVFDEAHLIQDSVFLSPRVMGKIICNLVNSGAIVVFSSATLPKALLERLTRECKKVENLTVDLNVKSDVKITFNGDKQLTENEIDCEGNTLVILNTVERARSLYKKLRDKCKNVYILHSLMAIEDRRKVYDSVKIKMNNEDDLVLIGTQTLEVGLDFSFEKLYAEISPIDSLIQRVGRIGRRKEKKNEKSKEVNAIIFDVENNLPYLDSIIKATKDVLHSSTAYDNLVNSIDTVYDANKVKEIEEKGDLFYVEFLEYIENLHLFSYPLEDEVLVRPSNYIIIFILDDSLIESESDKELVLRKDGLDDKSLKYSISLVDNHSLKRLTTLLNGGNIYSYPYEKGGKIHVKKVTTLDRIINNALSIYVRKDDLYDEAGLKVELDKPKSESEGKKRRSKKK

SEQ ID NO: 14465 - protein, 717 aa, Gluconobacter oxydans
MDLTDLAQFWAKTDTQAAAECPMHPVVAHSLDVAAVAMSLPETMLPQIDNDPIDRRLLGFLASLHDIGKLGATFQFLRPDLWPTALGATPAALPPGPRHDAAGLQILGQLSTHPVLKILFPDWSLSEKLRVLAGVAGHHGKPISRAYQRPANLTSLDENTLNAARIFLDVMASLFQPPSFPEDFSEDAMDALAWRLAECLPVADWIGSNRTWFPYATPHTLTDPADYFWNKALPQAQKAIFQAGLGPVRTRPFQSAKDLLPHLETQALSPLQRWAETTSLPDGPALIVIEEMTGSGKTEAALILSHRLIARGHANGVFLALPTMATANAMFDRVAAAYGKMFHPADRPSLALAHGKARLSERFTQTILSEKSLSSFAGIRKQPGESACMEWLASENRRALLAQVGVGTIDQALLAVLPVRYTTIRRQGLTGKILCIDEAHTFDAYMNEEMKELLTLHASRGGSVILLSATLSHALRTALVNAFRKGLNLPATTLQDTHYPLTTLVSGTDAPVETPCEPRPGLGRTVRLNRLSDVGEAETRVIELAETGSAIAWIRNTVDEAIASAESLRAKGLKVQLFHARFAMVDRLEIEQDILRKFGKHSSPDQRAGVLVSSQILEQSLDLDFDSVITDLAPADLLIQRAGRLWRHHREDRPVDYPQLDILSPSPVSDPDANWIRRVLPGTAAVYRDPSLLWRTARALFARNVLRTPEDVRSIIE

SEQ ID NO: 14466 - protein, 765 aa, Leptospira kirschneri
MEKLLAKSRTQDGREISLQEHSFDTENAAISIFRKESRFLNNWLRFFKIRKEDEEKFLLNLRVTCLFHDIGKANDDFQKAAREKGFFHQGIRHEHLSAFVLHLPEIRKWLSQNKDLDIPIITSAVLCHHLKATDKNDHQYKWLTDPLRDFVILNLFYEEVKIILKKVNQFLKSDIDIPQLNYKTFSPEDENWKKTFQSGAKESGILGFRLDENRKQLHLAIKAALIVSDSASSGLVRENHLIEKWISKAIHSDEIKENEILKEIIQKRMDDKKILELHQFQKQVATKGDRVLLMAGCGMGKTLAAWNWANEVSKKQKISKVIFLYPTRGTATEGFKDYASWAPEADATLMHGTSDYELDSMFQNPDDEKSKRDFRISEADERLFAIAFWSKKFFSATADQFLSFLQNNYKGICLLPVLSECALIVDEVHSFDKAMFSSLLSFLKYFDLPILCMTATLTPKNKQSLLELDLEQYPKEEDRKELENLINLENHPRYNKTVLENAEQAKEIAIKSFREGKRVLWVLNTVDRCQKTYEELTEELQTEVHCYHSRFKLSDRKTVHENTVNAFQGSNLNSIAVTTQVCEMSLDLDADVLISEFAPVSSMVQRFGRANRHLKKGDEFRAELYLYEVVGSLKPYSSDEINAAKNFLNNLPEKDISQNLLATKLEECSAQEYKTLPSASFIDGGYFALPSDYRDIEEFTAQAILDEDFPEVSQLLQSKKPIDPYILPVPDKRELNLRNEEHSLLPKYLKIVSRKYYNNKRGFAL

SEQ ID NO: 14467 - protein, 768 aa, Leptospira kirschneri
YLRKFEFLSEILYNIFNHFPKLGMTKDKQSIFIAHVLRKDDGSFVEHLIDDHLYSVAEFAKKFCEKFGAETFGYLIGLWHDLGKFKLEFQERIRIRSGHIGEEAHLEGKTAKSVKHSVSGAIHCLNKFKQSDIIKKLICLPILCHHSGLKNFGIDVDIQLNDEKEISALSETITYIPQQILDGIELKQLGKSFKDHSLLIRMLFSTLIDADRLDTERFMDLVKFKERYSKTIILQDLNIKLDKHLNDIQKQADATKVNSIRKRILEEVQSKTNLKPGFYTLTVPTGGGKTLTSLSFALKHCIENKMDRVIYGVPYLSIIEQTADVFKKILGEDSVLEHHSGIDISKEKENSINRLLTENWDHPLIVTTNVQFFESLFSSKTTKVRKLHNIINSVIILDEAQMIPPQFLQPIVKTLKELVEYYNVTIILCTATQPTLSSIKSTDLNFDGIDTAIELAPEPEKLFQELKRVIIHKPEEKKLSFMEVATRILNYDQVLTIVNRKSDASGIFNQLTGNKYYLTTNLCAEHRRDILKKVKNHLNNGESVYLVSTQLIEAGVDIDFPIVFRAVAGLDSIAQAAGRCNREGKLLDENGQEKLGEVFLFKPEQNPPAGHLLQTEQASRDCIKNFEELIHPDTLKQYFNTLFWLKQDKGLDKEEIEKDKRSFQFETINKKFKLIDEDSRPVIVPYKEGKDLIVQLQNSVIQNNFLDYKLIRKSQRYTVNLKTNLYNKLLSEGIISEIEGIIGILTFDSYYHNDLGILESPNEQDLII

SEQ ID NO: 14468 - protein, 758 aa, Leptospira kirschneri
MEKLLAKSLSKHPSDKEQELYLVPHLKAAEKAGSVIYDSIGERILKSVGLSSEIWGNRLKILLPLSCLLHDLGKANNWFQELVRGNKIFQPIRHEFLSVIMILRSKNKLQNYIKTKISEIISLENLTPFINSIYSGILAHHLKIDIDLKRACPGLGINGGTPTEIIVYADSPDFDLLFGVNKPSNTFYFTFLPSHSDQKYKSIHEWIDEFYTINNEWEEFLKDNNDWHIFSTILKPLVISADVLASALVPKGIEYKDWVIESLQNYVELNDINLIIKERLKDKLPRTFQKQIANSKERITLVEAGCGSGKTIGAYLWAANNISDSKIFFCYPTTGTATEGYLGYVSDSGYEAKLIHSRSEVDLKGIQTTGEEDGNELTDRIDALHSYHPKLIICTVDTVLSLMRNGRKAILSFPSIAMGIFVFDEIHSYNDEMFLVLIRFMQFFKNTKFLLMSASLQPERKEILKREFSSLQDIESPTDLMGLPRYKFNPIRQSKSLLEDIKRHAGNSKILVVVNTVKRAQTIYRDISSSGLNVKIYHSRYKYKDRVIRHREFIDAFQDKSPPVIGIATQVAEMSLDIDSDVLFTELASISSIIQRLGRLNRRTTPENKLPSRNVCFFKPEKTLPYSSDELELAEQWIKNLLNINNEISQNDLQEYFFRLSPKNENLYPPIYYDFNKPTFFFLPATEGLRGPNNTINCILESDMPSVMQKPKDISNFTIPMTINSGFDFQTANFYKYVVVIPDENIHYDKIEGAAWRN

SEQ ID NO: 14469 - protein, 510 aa, Leptospira kirschneri
MPKGIEYKDWVIESLQNYVELNDINLIIKERLKDKLPRTFQKQIANSKERITLVEAGCGSGKTIGAYLWAANNISDSKIFFCYPTTGTATEGYLGYVSDSGYEAKLIHSRSEVDLKGIQTTGEEDGNELTDRIDALHSYHPKLIICTVDTVLSLMRNGRKAILSFPSIAMGIFVFDEIHSYNDEMFLVLIRFMQFFKNTKFLLMSASLQPERKEILKREFSSLQDIESPTDLMGLPRYKFNPIRQSKSLLEDIKRHAGNSKILVVVNTVKRAQTIYRDISSSGLNVKIYHSRYKYKDRVVRHREFIDAFQDKSPPVIGIATQVAEMSLDIDSDVLFTELASISSIIQRLGRLNRRTTPENKLPSRNVCFFKPEKTLPYSSDELELAEQWIKNLLNINNEISQNDLQEYFFKLSPKNENLYPPIYYDFNKPTFFFLPATEGLRGPNNTINCILESDMPSVMQKPKNISNFTIPMTINSGFDFQTANFYKYVVVIPDENIHYDKIEGAAWRN

SEQ ID NO: 14470 - protein, 932 aa, Leptospira santarosai
MEAEEKSYYKYWGKADQEGNYHLLVYHCLDVAAVGEVYLSQNETLCVHLSQKLGIDSPTFKNLFVFFLVLHDLGKFSDCFQSLIPNIKRILGNSNSPIGPYSVRHDSLGYIFWGEWILKDKRFGNYDGLLTEQNWLGWNGLRSSKEKSYFTEFLDVLIRCVTGHHGRPPSKNGYSGQTAVSPDSHFTEADRSAALAFCKEVNRIFSPNFEGDFKSLFDSTLPISFWLAGLSVLCDWIGSNSEIFKYRRTPIDLEEYYTTISLINAQKAVLKSGLSSAKIAFNENHFRIFEYLREPTPLQKFCSEVVLPDSPSLFILEDVTGSGKTEAALILTHRLMQKNAYSGFYVGLPTMATANGMYRRMSGVYRNLYTKESLPSLILAHGARNLSDSFQSSVISDNAILADRNYQSDKDPEESATAICNIWLSDNRKKSLLADAGVGTIDQALLSVLSAKFQSLRMFGLSRKVLILDEVHSYDPYMVELICCLLKAQAKIGASVILLSATLPKILRKRFSDSFALGLDTELQDIKSGEYPLVSLVSNRFEVEETPIPTRKEVGRKLNVEFLFDQETVFQKILEISNQGRCVCWIRNTVSEASQAFFFLHSKLGDRVILFHSRFAMGDRLNIESQILENFGVRSDQKSRKGKVVVATQVVEQSLDLDFDCIFTDLAPIDLILQRAGRLHRHSRDIFGNVKQGLDERGEPVLWIFSPEPIDDPTSNWFSQFSRGGGMVYSDHGKLWLTAKLLHERKGWKMPEDARNLIESVYGVDVKVPHSFRENRSKVENDRKKQESAAVLSTIRLELGYDSTSNETSWDDSKFSTRYGIGNSTKVVLAKFVSDRLVPWISGTSRDWQNSELPVPNYLVEKEFIFENSNVSEVISDCKKNLPDKGKHCVLLPLFYANDFWRGKAFNKKNEVVSFTYDERFGFRKEQLRGIV

SEQ ID NO: 14471 - protein, 932 aa, Leptospira santarosai
MEAEEKSYYKYWGKADQEGNYHLLVYHCLDVAAVGEIYLSQNETLCVHLSQKLGIDPPTFKNLFVFFLVLHDLGKFSDCFQSLIPNIKRILGNSNSPIGPYSVRHDSLGYIFWGEWILKDKRFGNYDGLLTEQNWLGWNGLRSSKEKSYFTEFLDVLIRCVTGHHGRPPSKNGYSGQTAVSPDSHFTEADRSAASAFCKEVNRIFSPNFEGNFKSLFDSTLPISFWLAGLSVLCDWIGSNSEIFKYRRTPIDLEEYYTTISLINAQKAVLKSGLSSAKIAFNENHFRIFEYLREPTPLQKFCSEVVLPDSPSLFILEDVTGSGKTEAALILTHRLMQKNAYSGFYVGLPTMATANGMYRRMSGVYRNLYTKESLPSLILAHGARNLSDSFQSSVISDNAILADRNYQSDKDPEESATVICNIWLSDNRKKSLLADAGVGTIDQALLSVLSAKFQSLRMFGLSRKVLILDEVHSYDPYMVELICCLLKAQAKIGASVILLSATLPKILRKRFSDSFALGLDTELQDIKSGEYPLVSLVSNRFEVEETPIPTRKEVGRKLNVEFLFDQETVFQKILEMSNQGRCVCWIRNTVSEASQAFFFLHSKLGDRVILFHSRFAMGDRLNIESQILENFGVRSDQKSRKGKVVVATQVVEQSLDLDFDCIFTDLAPIDLILQRAGRLHRHSRDIFGNVKQGLDERGEPLLWIFSPEPIDDPTSNWFSQFSRGGGMVYSDHGKLWLTAKLLHERKGWKMPEDARNLIESVYGVDVKVPHSFRENRSKVENDRKKQESAAVLSTIRLELGYDSTSNETSWDDSKFSTRYGIGNSTKVVLAKFVSDRLVPWISGTSRDWQNSELPVPNYLVEKEFIFENSNVSEVISDCKKNLPDKGKHCVLLPLFYANDFWRGKAFNKKNEVVSFTYDERFGFRKEQLRGIV

SEQ ID NO: 14472 - protein, 931 aa, Leptospira weilii
MKSEEKSYYKYWGKANKEGNYHLLVYHCFDVAAVGEVYLSQNETLCVHFSQKLGIDPLTFKNLFVFFLILHDLGKFSDCFQSLIPDIKSAFGNSNSPIGPYSIRHDSLGYIFWGKWILKDKRFGNYNGLLTEQNWLGWNGLQSSKDKSYFTEFTDVLIRCVTGHHGRPPSKNGYSGQTAVSPDSHFTEADRLAALDFSKEANRILSPNLYFKGNFKTLYDSTLQISFWLAGLSVLCDWIGSNAEIFKYRTTPIDLEEYYTTISLNNASKAVKKSGILPSKIALNGNHFGIFEYLQEPTPLQKFCSEVVLPDSPSLFILEDVTGSGKTEAALILTHRLMQKNTYSGFYVGLPTMATANGMYRRMSSVYRNLYTKESLPSLVLAHGARNLSDSFQSSVISDNAILSDRNYSFQSEKNQEESASAICNIWLSDNQKKSLLADAGIGTIDQALLSVLSAKFQSLRMFGLSRKVLILDEVHSYDPYMVELICCLLKAQAKIGASVILLSATLPKILRKTFSESFALGLDTELQDIKSEEYPLVSLISDRPVVEETPISTRKEVSRKLNVKFFFNQEQVLQKILEISNQGRCVCWIRNTVSDASQAFSFLHSKLGDRVTLFHSRFAMGDRLNIESQILENFGIQSDQISRKGKVVVATQVVEQSLDLDFDCIITDLAPIDLILQRAGRLYRHSRDISGNIKQGLDERGVPILWIFSPEPIDDPKSDWFSRFSRGGSMVYSDHGKLWLTARLLQERKGWRMPEDARNLIESVYGTNVMVPQSFQENQSKVENDKKKRESAAALSTIRLELGYDSTLNETSWDDSKFSTRYGIDNSTKVVLAKFVSDRLVPWISDTNRDWQNSELPVPNYLVEKEFIFENSNLSEVISHCKKNLPDKGKHCVLLPLFYANNSWRGKALNKKNEVVSLTYDERFGFRKEK

SEQ ID NO: 14473 - protein, 948 aa, Gardnerella vaginalis; identical to SEQ ID NO: 13028

SEQ ID NO: 14474 - protein, 732 aa, Xanthomonas
MSQSNAFSLLSPGIQRYLWAEQWEALRDVQEMAIPLILPADQDVIVAASTASGKTEAAFLPALTYLEQQTPAGLIVYISPLKALINDQFGRLERLCEDLDIPVWPWHGDISSTSKQRFFKKPHGVVLITPESLEAMLCNRGTSVAGIFKHLAYFVIDELHAFIGSERGKQLQSLLHRIDTVVGRKVPRIGLSATLGDMQAAARFLRPAGTAAIVDAPSDASELLLIIKGFEEPVPQKGEADDKKEKQELAPLAVAEHLFKILRGSNNLVFPNSRREVERYTHLLNELCEKSGVSREFWPHHGSLSKEIRYDTEAALKQKNQPATAVCTNTLELGIDIGAVKSVAQIGTPPTVASLRQRMGRSGRRKGEAAILRGYVIEDAIDSQADLRTRLRLDTFQTLAVVMLLTEKWYEPPVVKGAHLSTFIQQLLSAIAQYGGLTAPQAFQLLCAPNAPFNQVSRDAFVELLRHLGQHNILIQDGSGLLLHGSVGDRIVNHYSFYAAFTVDEEFRIVAAGKPLGTLPVSQMLTTGQRILFGGRTWLVEQIDEGQKTIYVSATKSGAPPLFSGGGGRVHTKVRQTMQAIYQGTLTPTFVDACAQRFIDEGRTSYQQHSLDDQLFLDRGSDILLLTWLGDAANDAIACLLNARNFKAQGSRLGVEITRGPSALENIETALKAIAAAPAPSIEVLLAGAKNLASQKWDSLLSPHLLQVSYASSNLDLDEAMDWLRKTFFSSN

SEQ ID NO: 14475 - protein, 891 aa, Halomonas stevensii
MTYYHYWGKAHAKGKSVECHLLPYHSLDVAAVGWLLLSPDRPLTRRLAAQLSLEPEPLRNLLVFWLGLHDIGKFSRAFQGLFQPTSNVKLVPRVAQYVYTERHDRLGDVIWGTKYLDWLEDGTLKWTTSLTRAERKALRAAFSVLSPPFFGHHGQPVSAGNIGIERFFCRDEHADDVEATRQFIADWANVVPPEWPIEQLFSEEWVYALQTLSWSIAGWATLSDWLGSNQDHFPYLQEQLPLADYWQIALHNAEKALEETGFNKVSEPLPYASMTDWFGKQSFTPTPLQHAAETVALTDVPQLFILEDVTGSGKTEAACILTQRLLAAGHGDGLYFALPTMATSNAMYSRLGNLHRRFYTAESTPSFVLAHGARELNDDFIAAVSAPQPTDLDYTASELSATSRCNQWLADSRKKALLAEVGVGTIDQALMAILPFRHQSLRLYGLARKVLVIDEVHAYDNYMQTLLSQLLSYHARQGGSAILLTATLPRAMRSALMAAWQTGLGLSPTKPQKEDFPLLTHVSEGQPLELPLGSRKEVSRSVEVAWLTEEEQAIEAVLAAVEAGECIAWVRNTVDDAIRAFEAIAALHPDPERCLLFHSRFAMVDRQRIESQVIERLGKDSTPEIRQGQVLISTQVFQESLDCDVDVMISDIAPIDLLIQRAGRLQRHQRGERCQPRLLVLAPPWADDPDEHWLKRTLPGTQAVYRDTSLSWLTQGVLRHLEAIRMPEEARDLIEGVYGSVPDDIPDALQGARYEQKGMQRTAGSMANFNALNLEEGYIKSDQWQEEQEIGTRLMDEPTINVLLLLLTDDNELSLWAGERRHADMLSQVKLRQSQASKLASLPCRYESQWLTLQERHKALKYVQPWLPSDDPNCDYDTQWGVRLGSKEPAP

SEQ ID NO: 14476 - protein, 747 aa, Methylocystis parvus
MDYFAHSLPDRPKSEWQQLAEHLRSTADRASRNAEKFGAGRAAKLAGLLHDLGKYTAEFQKRLEGGDAVDHATAGAREAMALAAQPRDKLIAEIVAHAIAGHHAGLPDSVGAASLEERVGKKLHALDPVWREEIAPVADGLIKQSFKAGASRQTLAFQLAFFGRMIFSCLVDADFRDTEAFYDRAEGRSSPREWRALPDIVDALRGRFDEHMAKLGARAEATPVNALRAEVLAHTRKQADLPRGLFTLSVPTGGGKTLASLAFALDHAKRHGMERIVYAIPFTSIIDQTAAIFQSVLQDREDIVLEHHSSIDEERNQDRSSREKLKLAMEDWAAPVIVTTNVQLFESLHADRPSRCRRLHNLANSVIILDEAQTIPLHVLRPCLAALNELALNYGASIVLCTATQPAVRKVDFEDGLDLPPERELAPDPQRLHRQLQRVRVEKLGVLDDDALVGQLGESSQGLVIVNSRAHALALYRKARDAGLDGAVHLSTRQCAAHRRDILAHVRETLKSEKPCRVIATSLVEAGVDLDFPRVWRAEAGLDQIAQAAGRCNREGQRKIDESIVGIFQSPDFPPPREIRQFAEDMKRVRRDDLLSPEAIREYFAEVYWRKGEKQLDKFEVMDAWLLPLDKPNFNYRSIGRSFRMIESGMTPVIIPWDASAQEAVKNLAFETIPSGRLARLLQPYIVQTPPSARRLLLENGHVAFVHPKLRGDQFAVLERSSDFYKPDVGLLWEDADYLGQEQWLVV

SEQ ID NO: 14477 - protein, 570 aa, Lysinibacillus boronitolerans
MFEKLLAKSATKTSAAQTIIEHTNHLIKKWEIFRKIYPNALSKKDWTILLQAVTYHDLGKANTKFQNKVRTIEERIEDLFPEIDEIPHNYLSCAFMPIKNLITHYGKEDATLLILAVYYHHERAEQNMYESGDEIKKDLQKYVSLLNNDFNIREEPKFDYRKFTDRKFLENREHLYRFVRIKGLLNKLDYAASGGYEVEIPPEDLPQKMKKYFDNKNRTRNELQDYLYTLQQENHIVIASTGIGKTEAALWWLGNDKGIFTLPLKVSINAIYDRLINEIGCSKKNTGLLHSGMHAEYVKRADEQDLDLITITHAKNLSMPLTVTTIDQIIDFVGLYPGFEMKLATLAYSKIIIDEIQMYSARLAAFIVLGLKYVTDIGGKFLIMTATLPPLFIEALKRLEVPFEKREDPFLKFNANNQPIKRHFMQIVEKDLTIEEILKHPMEQKVLIIVNTVTKAQQLYKEFEETGVKASLLHSRFISKHRQEKEDAILALGNKDCLNTGIWITTQLVEASVDIDFDILFTELSEASGLFQRMGRIYRTRDYVENIPNIYVFTGGPLPSGIANNKKICC

SEQ ID NO: 14478 - protein, 764 aa, Xanthomonas vasicola
MELFAHSSKRQDRSDWQRLADHLFAVGERAARNAAPFGGQLLAGLAGQLHDLGKYTQKFQARLDGDPARVDHATWGARIACERYGTAGTLLAYGIAGHHAGLADGRPGHPAQSRPSLHERLSEDYRERELPPLLSDWERELSLPAKLALPDGFIGHPRQERRPFQLTVLTRLIFSCLVDADFTDTGDFYRRLEGRQSRAEETGTRPILPELRQCLDAHLATLPTKGGINPLRAQILSEVRAKAGMRPGLFSLTVPTGGGKTLASLGFALDHAIAHGLRRVIYVIPFTSIVEQTVQVFRHALGVQERDDIVLEHHSAFFDDPTKAPQSIDKRKLAMENWDAPIVVTTAVQFFESLFADRPSRCRKLHNIAGSVVVLDEAQTLPHALLRPCVALLDELARNYRVSPVLCTATQPTLRLDQGFAGGLDHVRELVDDPPALYARLRRVQVRHVGTLDDAALTDHLRQREQVLCIVNNRRHARHLFDAIADRPGARHLTTLMHARHRSAVLADLREDLKAGRPCRLVATSLIEAGVDVDFPTVLRVEAGLDSIAQAAGRCNREGLRPVEVSQVQVFTPANPDWAPPKDLDLFAEVFRGIERTHRDDLLAMDSVTAYFAELYRRLGDGRLDREEVLGLLRDADIKGLPLDTLARKFKMIQTTMRPLIVPYAPYAEGCDKEVPEVADILRQLEHAEHLGVAGAARRLQPWLVQVPEQAYRALWQANAIAPVAQARYGEQFVRLVNPRLYDPRCGLRSDDSPQFLAAEALVQ

SEQ ID NO: 14479 - protein, 764 aa, Xanthomonas vasicola
MELFAHSSKRQDRSDWQRLADHLFAVGERAARNAAPFGGQLLAGLAGQLHDLGKYTQKFQARLDGDPARVDHATWGARIACERYGTAGTLLAYGIAGHHAGLADGRPGHPAQSRPSLHERLSEDYRERELPPLLSDWERELSLPAKLALPDGFIGHPRQERRPFQLTVLTRMIFSCLVDADFTDTGDFYRRLEGRQSRAEETGTRPILPELRQCLDAHLATLPTKGGINPLRAQILSEVRAKAGMRPGLFSLTVPTGGGKTLASLGFALDHAIAHGLRRVIYVIPFTSIVEQTVQVFRHALGVQERDDIVLEHHSAFFDDPTKAPQSIDKRKLAMENWDAPIVVTTAVQFFESLFADRPSRCRKLHNIAGSVVVLDEAQTLPHALLRPCVALLDELARNYRVSPVLCTATQPTLRLDQGFAGGLDHVRELVDDPPALYARLRRVQVRHVGTLDDAALTDHLRQREQVLCIVNNRRHARHLFDAIADRPGARHLTTLMHARHRSAVLAELREDLKAGRPCRLVATSLIEAGVDVDFPTVLRVEAGLDSIAQAAGRCNREGLRPVEVSQVQVFTPANPDWAPPKELDLFAEVFRGIERTHRDDLLAMDSVTAYFAELYRRLGDGRLDCEDVLGLLRDADIKGLPLDTLARKFKMIQTTMRPLIVPYAPYAEGCDKEVPEVADILRQLEHAEHLGVAGAARRLQPWLVQVPEQAYRALWQANAIAPVAQARYGEQFVRLVNPRLYDPRCGLRWDDSPQFLAAEALVY

SEQ ID NO: 14480 - protein, 751 aa, Pseudomonas fluorescens
MSSPASSSDSSSFERLHPEVQQWIWSQGWTSLRDAQEWAVPALVGADRDVIIAASTAAGKTEAAFLPILTNLLNNSDPAGAVLYISPLKALINDQWDRLSRLCERLELPVVAWHGDVAASKKQRFLKSPEGILLITPESLEALFVNRGSGLPGAFQNLRYIVVDELHAFIGSERGKQLQSLMQRVEIVVGRTLPRVGLSATLGEMSLARKFLRPACPDGITVIESKSSGQELQVQVRGYIEQPMQQLVVEHPGNASTDEGAEKEDTSGTKVAIAGHLYKVLRGHNNLIFPNRRQEVEWFADRLRSLCENDGVPNEFWPHHGSLSKELRQDAERALKAGDPPASAVCTTTLELGIDIGSIRTVAQIGCPPSVASLRQRLGRSGRRAGEPAMLRTYCRERPLTDKSDLSDQLREGLVQTVAMIRLLISGWFEPPRSGGLHASTLVQQCLSSIAQLGGASAAQLWGNLIASGSFASVTKPDFLGLLKGMGEKELIVQDSSGLLLPGELGERLINHYEFYTAFTSDEEFRLLRDGKPLGSLPVSKPLTKGQRIIFGGRRWQVQDVDLEAKVIVVTPARGGEPPQFDGLGAQVDDRVRLEMRNVLMETTSCPFLDKHAQALLDEARNNFRALGLGDAAIIGSASVSHVATWRGDYTNDALALLLRHVGIQCENTGLFLEVAFGAEDTLRALRVVGQMDISNVEPILENVENMIREKWDWALPRPLLMKSFASSHLDLQAAVTTARLLTLESQVGNE

SEQ ID NO: 14481 - protein, 732 aa, Xanthomonas phaseoli
MSQSNAFSLLSPGIQRYLWAEQWEALRDVQEMAIPLILPADQDVIVAASTASGKTEAAFLPALTYLEQQTPAGLIVYISPLKALINDQFGRLERLCEDLDIPVWPWHGDISSTSKQRFFKKPHGVVLITPESLEAMLCNRGTSVAGIFKHLAYFVIDELHAFIGSERGKQLQSLLHRIDTVVGRKVPRIGLSATLGDMQAAARFLRPAGTAAIVDAPSDASELLLIIKGFEEPVPKKGEADDKKEKQELAPLAVAEHLFKTLRGSNNLVFPNSRREVERYTHLLNELCEKGGVSREFWPHHGSLSKEIRYDTEAALKQKGQPATAVCTNTLELGIDIGAVKSVAQIGTPPTVASLRQRMGRSGRRKGEAAILRGYVIEDAIDSQADLRTRLRLDTFQTLAVVILLTEKWYEPPVVKGAHLSTFIQQLLSVIAQYGGLTAAQAFQLLCAPDAPFNQVSRDAFVELLRHLGQQDILIQDGSGLLLHGPVGDRIVNHYSFYAAFTVDEEFRIVAAGKPLGTLPVSQMLTTGQRILFGGRTWLVEHIDEAQKTIYVSATKSGAPPLFSGGGGRVHTKVRQTMRAIYQGTLTPTFVDACAQRFIDEGRTSYQHHGLDDQLFLDRGSDILLLTWLGDAANDAIACLLNARNFKAQGSRLGVEITRGPNALENIQTALRAIAATPTPSIEVLLAGAKNLASQKWDSLLSPHLLQVSYASSNLDLDEAMGWLRSSFPSRS

SEQ ID NO: 14482 - protein, 745 aa, Leptospira noguchii; identical to SEQ ID NO: 13050

SEQ ID NO: 14483 - protein, 749 aa, Spirulina subsalsa
MKTQLEPNLLLAKSFQSGQWKGSYSLVGHTADVVNAVTTLIDVLGERLLQQFCLNYSFSFLKATAQKAAYLHDWGKANHHFQQVVRHQRNPLHEPQIIRHEVASVLLAWEFREWLEQGEGDFLTALVAGGGHHLKLGGKKGKATDELGEVRQSGEDCLRLYTVIKSQGKPQYHPLFRPLLKYGVKALGLPDKPKLSQKPSEFWFVTTIKQKRQEVQSFLEEEWQPNLVFLAVIKALVIAGDAVGSAIPNTNLSIQKWITEEVERTLDEAKLDQVMAGRLEGKTLRPFQIQLAESSTRVTLARAGCGTGKTLGAYNWAKAKALGRKLIFCYPTTGTSTEGFLDYVHHQVDSILLHSRADVDLAMATTGEEEEAGETVNNEVALKLESFQAWGREAIICTVDTVLGLLQCNRRPIYCFPAIAQAAFVFDEVHCYDERLFGALLRFLEVVKAPILLMSASFLPWQLEALQEAVGEPLAIISGPPELETQPRYRFHYSEQMDWSRVTQELAAGGKVLWVCNQVNRAISVHQEARERGLNALLYHSRFRYQDRVEHHRAVVDAFKPEYQEPVLAITTQVAEMSLDLSATLLVSQVANPAGLIQRLGRLNRRYCGHPLDALFYPDGKVGYPYSKEELNQGLELIQSFPGEVCQRDLAQWLENVAVEGQPERDSVLLDKTWQTYSTSLRKAGFNATVLLEQDLPILKTLGSKQLPRYTVPIPIKPKEIKEWKKYKFYPIAPTQEWDYSSELGATKH

SEQ ID NO: 14484 - protein, 743 aa, Spirulina subsalsa
MTTPSHPVAHTPSPNRPQQWHDLKAHLVKVAKRTADFATLLGAPTVGHYLGLWHDLGKYNPDFQAYLQGCHRGDKPKSVPHAIHGAKLAAQQFAPLAPLIYGHHGGLPALSSLNVKLQGCNPERTATDYQEVLKRAEAAGIDLTAPPTLAQEMAAHQRDPLRAELFLRLLFSCLIDGDHLDTEGHFNPEQTAQREIPLTLPQLQAQLAREQAALLEKVPDTPVNQVRREVYEYCCAQASQKPGVFRLCVPTGGGKTRSGLAFALNHACGQGQRRVIFAVPYTSIIEQTVQVYRKIFAPLGEMAVLEHHSAISPEGLKETWRDDDARWGYAQARLVAQNWDAPLIVTTTVQLFNSLFAHRPMPCRKLHNLVNSVIVLDEVQTLPIPLLEPILDVLGQLVKYYGVTLVLCTATQPAFEGTNPYLRGFDQITDIVPPAEAQRHFQRLKRVSYIRPSGAWSWSDLMADLQARSAEQALIIVNTRKDALGVLAALQGAEFPREGVFHLSTLLCGTHRRRVLEAVKGRLKERLPCWVVSTQVVEAGVDLDFPVVYRAIAPLDRIVQAAGRCNREGKRAQGQVILFEPQEGGSPRGLYQTAYAVAKNYLSPGEMDALHTPDLFLRYFQELYQQVDFSRGQEIQGERKKLNYPEVAKFSLIEDETIPVVVNYGESGQILAQIRSQGRVGRETRRRLQAYLVNLFPWQFNQNPENRQEVVPGLWEWTGGYDELVGIQWQGEPIQRDPFDLII

SEQ ID NO: 14485 - protein, 806 aa, Mastigocladopsis repens
MFKVLLAKSLSVEENKNDIARGAAKYTGHISLVVQAADVLVGNLGKPILQQLGIKHIDLDYFATTVRLGAYLHDWGKANQHFQEMVYLKTLDPKSPDPKLRDYRKRILALSKEHSDKQMLRHEIISGILALQVPTFREWLEQCQNANLMIAVWAAMGHHLKIGINQNNQAAEFIAEIPSGIGDELKFYTHHSDFQAVLKMGHKALGLPESLPDLPPEIWSKSQLQKALINLRNEFIQFESQLDWEQQKFIAAVKATVIAADLAGSALPLAEEDFKEWIEQVLSLQLSKEDIQKLVNQRLKGQKLRPFQELIAKSRRRVTLVKAGCGTGKTIGAYAWGEKWAVGRKLFFSYPTTGTASQGYIDYADGTEIEAALMHSRADLDRELLFSGESDDSEGIDARLMAFQAWRKKLIVCTVDSVLGLIQNNRKPLYSWAAIAQSAFVFDEVHAYDTRLFGALLKFIKAFRGAPILLMSASFTPEQLQAIRQVLAEQGEELDEPIEGPKELEELKRYDIKYVPEVTDFDEKEIWQPVIEALRNKQKVLWVTNSVPSCIKIYRTAKIKLAEQLPQLSLEPLIYHSRYRYKDRLKKHKAVIEAFGKNEPVLAITTQVCEMSLDLSADFLISAMAPAASLIQRLGRLNRRMTKPEEGAKQAIIYPWNNDGRPYDLAELATGKQLIQEFSGKTGISQRDLAQVAARLHSEKVEQVKSSWLEDNWCNRPDFLREGGYTITVLLGEDETAIWDIAEQRRQELLKRGINESRMKLFKQEAQAWSVPIRIEKDYYQWERRGFYPITLKGRIRYSEEVGAEQ

SEQ ID NO: 14486 - protein, 768 aa, cyanobacterium PCC 7702
MQAADVLVDSLGESILQQLGIKHIGLDHFAQTVRLGAYLHDWGKANQHFQEMVYLKTLENSPDSNHQEIKKQIIELYKQHSNRQMLRHEIISGILALQVPTFRKWLEQCRNANLMVAVWAAMGHHLKIGINQNNQPAEFIAEIPDGTGDKLKIYTHHPDFQAVLKMGNQELGLPETLPNLPEETWLKSKLERALKELLQEFIQFESQLDLEQQKLIAAVKATVIAADLAGSTLPLAEEDFREWIKQVLSLQLCQEDIQKLVNQRLGGKKLRPFQELIAQSHRRVTLVKAGCGTGKTIGAYAWAQKWAVGRKLFFCYPTTGTASQGYIDYADGTEIEATLMHSRADLDRELLFSGESDDSEGIDARLMAFQAWRKKLIICTVDSVLGLIQNNRRPLYSWPAIAQSAFVFDEIHAYDTRLFGALLKFIKVFRSAPILLMSASFTPEQLQAIRQVLAEDGEELDEPIKGPKELEELKRYEIKYVPQLNEREIWQPIIETLKNKQKVLWVTNSVKTCIEIYYAAKNKLAESLPELDLKPLIYHSRFRYKDRLKKHKAVVEAFGKDEPVLAITTQVCEMSLDLSADLLISAMAPAASLIQRLGRLNRRMATQEQGTKLAIIYPWDNEQPYEQKELSTGEQLVRKFSSKTDISQRDLAEFAARLNYGKIEQIRSSWLEDNWCSRPDFLRKGGYTITVLLGEDMELINDIVKQKTQELSRQGKNESWMKLFKQEAQAWSVPIRIKSDYWKWQRKGFYFVTPIGTINYSEEVGAQQ

SEQ ID NO: 14487 - protein, 740 aa, Methylococcus capsulatus
MNQETGNQMPIAHVRKGENGEWIIHDLGEHLHGVAKLADAFARHFRSGDWAHLAGLWHDLGKYRQAFQGYIRTQSGYDPEAHIEGGKGRVDHSTAGAIHAIERLGPHGRILAYLIAGHHAGLPDWSGTPSSLFQRMEQPQAKEWLNEIRAQNPPADLLERERPRSRPPGGALHLWLRLLFSTLVDADFLDTEAFMDPARANQRGATCALPDLLAAFNTYMEGKTAAAPDTPVNRLRAQVLAQCRTKAQEAPGLFSLTVPTGGGKTLSSLAFALEHAVHHGQRRIVYAIPYTSIIEQTADIFREIFGEAVIEHHSNLDPDRETAKSRLMSENWDAPLVVTTNVQLFESLFAARTSQCRKLHNLVDSVIVLDEAQLLPPEFLDPILEVLRDLTAHYGVTMVLSTATQPAFKPRQGFGWKFDGLENVREIMADPELLYRDLKRVAVKLPDDLHAPEDWPTLAERIRGHEQVLVIVNRRDDARELAEFLPEAVHLSANLCGEHRSRLIADIRERLRLKAPLRVVSTQLIEAGVDVDFPVVFRAMAGLDSIAQAAGRCNREGRLADGLGRVFVFVPPKPSPPGLLRKGEDAARELLFDQAEDLLTPELFERYFGLYYAKLNDLDKAGILDLLRKDERALQIQFRTAAERFRLIDDQAQQTIIVRYCDAEKWLSMLKNQGPERWLMRKLQRYSVNIPKSLFQKLLATDEVAQVHPGIYAQNVDGLYDSRFGFIGGQAGPNPLDLII

SEQ ID NO: 14488 - protein, 604 aa, Chryseobacterium taeanense
MVDLKPCDGKRKNFQLAFFTRMMFSCLVDADFLDTERFYLKTESRPDHRSAGEPAPSLQALREQLNHFLAGLPTGGDVNPIRSGILQHVRAQAELAPGLFSLTVPTGGGKTLASLAFALDHVIRHGLSRVIFVIPFTSIVEQNAAVFRRALGPLGDAAVLEHHSAFVQTEPPRDDPEKYQAQKKLQLAMENWDAPIIVTTAVQFFESLFAARPSQCRKLHRIAGSVVVLDEAQTMPLKLLRPCVAAIDELARNYRASVVLCTATQPALVAPDFEGGLNEVRELAPDPDRLFTQLERVRVRHLGVLDDEALAGHMRSREQVLCIVNNRRHARAVYQAMADLPGARHLTTLMCARHRSEVLAEVRQMLKEGKPCRLVSTSLIEAGVDVDFPTVLRAEAGLDSIAQAAGRCNREGRRARDTSEVLVFLPGNPDWAPPPELKQYAEKAREVLRQFEAQPLAPEAIQRYFSLLYWQKGSQALDVPDLLGQLTASRFDSLPMETLAAKFRLIDSVQIPVIVPYDDKARDALRALEHAQGSVGLARSLQPYLVQLPRQGFDALRKAGAVVPVVESKWGDQFMVLAHEGLYDPRHGIHWDEPALIQTEHLCW

SEQ ID NO: 14489 - protein, 827 aa, Paenibacillus
MEYIAHIRESNQEIQTVGEHLYETRQLAEVYGDKIGIRHITGLAGMLHDLGKYTEKFQNYIRLAVQNPDNPPKRGSVDHSSAGGKLLYTLFHIQPQGTFDKQDVFIKYVLTEVVANAIISHHSYLQDFLNPQLESRFLYRVRDLDIEGFEDAVVLFYKQVIDKSAFFDYVNQAMAELDQYMKREGEVDFELKLMYLSKFVFSALIDADRTNTRCFEEKKSAGDKTKVEPMHHQKLFHEYYKKLMMHIKSLQAGSDANTPINLLRKEMSEQCEQFAKRPSGIHTLSIPTGGGKTLASFRYALKHAATFEKKHIIYVVPFTTIIEQNVREIRKIILDDANILEHHSNVVVDDHEEEESSEFEDVVVSTRQKLKLAKDNWDSPIIFTTMVQFLNVFYAGGSRNIRRLHNLSESVIIFDEVQKVPTHCISLFNQAVNFLKTYAYSSIVLCTATQPELDFVHNKLAIEPDAEMIHDLDHVIESFKRVDIVDKATDMKFSTEKLGDFVEQKLADEQSVLVILNTKTVVRNLYQRLKEGNGTVPIYHLSTSMCPAHRNSILEEVKNHLKHKKPVICISTQLIEAGVDISFKCVIRSLAGLDSIAQATGRCNRHGEYKKKQVYVIDHEEEDLKRLKEIKIGKEITRKMFIDLKDDKTRFGGNILSAQAMEIYFQKYYSELKTDLNYFIPKLRKNMTELLYANRIENTYYQSYCKENETILPLLLANSYKTAADHFQVIEDHTTAVIVPYGDEEKEGKEIIADLNGQKSIEDLTDLLRRAQQFTINIFNYEKDRLDQNKGLVSFLDGKIYALTDGAYDDCYGLNLENDSLHHEFIL

SEQ ID NO: 14490 - protein, 851 aa, Halomonas jeotgali
MLAPEKELTQQLAARLGLEPDTLRNLLVFWLGIHDLGKFSRAFQGLFQPLRAALVPTANSPAYTERHDRLGAILWEANWIEWLQDGTLQWPQGKLSREQRRQLGKTLTILATPFFGHHGKPVESGQCRVESFFIHDNIGNDTEAARQFIADWGDVVSPVWAIEKLASPEWCGALQALSWTVAGWATLSDWLGSSREYFPYCQERMPLAEYWPLALSRAEAVLEGTGFISPLRPLPYSGMDSWFGGANITPTPLQKAAEELALSDGSQLCILEDVTGAGKTEAAGILTQRLLAAGHGDSLYFALPTMATSNAMYSRMGNLHRHFFTADSEPSLVLSHGARDLNDEFMGSVDDAQPEDHEYAANDMTASSRCNRWLADSRKKALLADVGVGTIDQALMALLPFRHQSLRLYGLARKVLVVDEVHAYDHYMQGLLGQLLTHHARQGGSAILLTATLPLRMRDELLHAWQAGLDAEPQGSKQRDFPLLTHAGTQGVTETPLATRPEVARSVNIGWLTDEEQCVEAVLEAVERGECVAWVRNTVDDAIRAFEAVAHRHPDAARCLLFHSRFAMCDRQRIEADVIQRLGKHSTPDTRRGQVLISTQVFQESLDCDVDLMISDIAPIDLLIQRAGRLQRHARGTRGKPLLQILAPEWSEAPDAKWLQRMLPGTQAVYRDTSLMWLTQRVLRETGALRMPDDARHLLESVYGAVIDLVPDGLQDARFEQKGMQKMAASMANFNALRLEDGYVSGQQWQEEQEIGTRLIDEPTVNVALLTHTADGCLQLWACGERHAAMLSQAKLRQSQAEKLAVLPAHYQPQWEALQEQHKVLHYTRPWLVEADDSCTYSVQWGLRLGS

SEQ ID NO: 14491 - protein, 1126 aa, Vibrio parahaemolyticus
MMVTFVSQCEKNALKKTRRVLDAFANRIGDNTWQTLITEDGLQTVQKMLRQTASRSTAVSCHWIRSRSRSQFLWVVGNKKKFNLEGYVAVNSTEKDLLNSEYESDWKYLPVIKALTSMAALLHDWGKASLLFQEKLHPDIQTKHKGDPLRHEWISCLLFNQFVTSVTPDGEDKQWLSAIINDGIHSPAINPTSLMAKEKPLAELPTVASLISWLVVSHHRLPLPKDAKLCDNQRDKNNTSLADLLKRVTPAWGYENQFDDYQKLLPKCFSFPLGLLSDSSIWNQQIQKRAKDLFHHLPLIEQAVSDGSWRVILHHARLCLMLGDHHYSSQPNDPHWNSSTELYANTDRNTKALKQKLDEHLVNVARAANDMVKLLPHFESEPLSATELSALAAKPNTPQQFRWQDKAVRKVLQWRDTTEDKSNGYFVVNMASTGCGKTMANAKIMQALSEDKQSLRFILALGLRTLTLQTGDEYKQRLKLTEDDLAVLIGSKAIFELHQSGQQIDKEEKEYQQAESGSESLESLLDEYDELRWSGALPEDGLSTVLTNSKERQLLYAPVLACTIDHIMAATETKRGGRYILPCLRLMSSDLVIDEIDDFTGDDLIAIGRLVHLAAMLGRKVMISSATIPPDLALGLYNAYRQGWALFAASRDQVSSVNCVYVDEFNTQAELIGSADSDWQQYQAFQQQFIAKRVAKLKQQDAKRKADIFACDKHDRLPTEQQYYQHIQQAIIEKHQHHSTFDLVSQTHVSFGVVRVANIQPCVRLTQYLLACDGWPEDTEIRCMAYHSQQVLLLRHEQEKHLDIVLKRKEKDDEVPVAFNEPLIRQHIDNCRTKNLIFILVATPVEEVGRDHDFDWAAIEPSSFRSIIQMAGRVRRHRDGEVAEPNISLLQYNYKGFKGGVERVFNHPGYETERSTQLDTHDLKLLVDEKLLLQSVNAIERIQKRPNLTPRTNLADLEHFATAKTLGVEHINKPPVSSTSRQDRFARHRRPNPSDGFWNDHLHGHITGYWWMTALPQYFKRFRKSEPSVQLYLVKKHRTTEFCIRDEQGGLNTIEQTLNIERQSLTNEQQQRLWLYRDYDALVSQYSFSADDEFKTSVKFGEISFTDRGEQDQYSYNDQLGLVKVK

SEQ ID NO: 14492 - protein, 739 aa, Dyella ginsengisoli
MSASLAFLQLDPRIQRYLWAEGWGALRDVQEQAIPLILPGNQDVIVAASTASGKTEAAFLPALTHLLGREGEGLIVYISPLKALINDQFGRLDRLCETLDVPVWPWHGDITSTSKRKFVQKPTGVLLITPESLEATLCNRGTSIAGLFKHITFFVIDELHAFIGTERGKQLQALMHRIEVVLGRTVPRIGLSATLGDMGLASKFLRPDGFTAMVDAASTEGQLLILVKGFEEPAAPDGAGRKNNPETERAPLAIAQHMFRTLRGSNNLVFPNSRREVERYTHLLNGLCEQAQVANEFWPHHGNLSKEIRYETEAALKQREHAATAVCTSTLELGIDIGAVKSVVQIGTPPSVASLRQRLGRSGRREGEPAILRGYVIEDALDETASLEARLRLDTAQTAAVISLLLENWFEPPAVNGAHYSTLVQQLLSSIAQYGGLQAAQAFRLLCAPPGPFERVSKEAFAELLRTLGQAEILTQDHSGLLLHGRIGDKIVNHYSFYAAFSSDEEFRIVSSGKALGTLPVSQMMTPGQRILFGGRTWLIEAIDEEHKTIHVAPAKGGAPPLFNGGGGRVHTRVRQRIRDIYVAHDSLPFLDSTAQRFLRDGREAFATLALADRLLLDQGSQAILLTWLGDAANEAIACVLMSRGVQASTGRLGVEIQRAGRSLEEIENFLRDIASAPAATVDDLLAKAGNLVRQKWDGLLSPHLLRQSYASSNLDLDEALTWLRATFESQSYQVSGGA

SEQ ID NO: 14493 - protein, 444 aa, Amphibacillus jilinensis
MNDQAQRLAGRLLLREELQLSEAEVAHYLATNKLTACSPFLKNFLSLQCRRCGNKRRHLFGKIPCSTCNKTHAYCRKCISMGRVMACTTLYLWTGPTPVWPQVPQPMVWSGHLTRDQQKASNWIYHAIETGQTRLLIHAVCGAGKTEMLFEGIALALKSQKRICLATPRADVVRELLPRFEQAFSGVKIVGLYGGSGGHQQTGQLTIATTHQLLRYQQAFDVMIIDEVDAFPFHADASLPYATKRAQKHHATTIYLTATPREKRLKRLPTIFVPVRYHGYPLPVPQLKIVPLFDQSHGLTSLWKWHKGRTDPSRQLLIFTATIKRANLLFPVIKRQHPTQKVMAVHANDTERIDKVRQFRDKQLDILITTTILERGVTFPAVDVVVLQADHHVFDQAALVQIAGRAGRDPNDPNGDVIFICNGKTKAIAHAVKAIERMNKKAGF

SEQ ID NO: 14494 - protein, 835 aa, Nocardiopsis halophila
MAASDDDLLLTPWAKSSKEGVHPLICHLIDTMEVSRLLYGLFLGPKVREELERVFSPLAGSAEQWVSLLCGLHDLGKYSPAFQSLVLEVAQKRFPESEHRLLEVCAPARKLANLDTKHGLTTGVHLDGMLHELGVHTSDRIVLSQVLAGHHGYIPSAGEIRSLSRPRGGRHKKDIGDGQWRQGRSAMVRRVAALGGLDFGDARWPEVRVPSQMGLVGLAGLTTISDWVASDTRFFPYEEEPESLEAYRIRAAERAQEALRSVGWRAWTPGERTGFTQIFGDGSPPFPLQRRVEEAVESCEEPGVLVIEAPTGEGKTKAGLQAAARLVHRLGLGGLYYSTPTKELSRQAYDDVQDLLKGTGSDLEVNLVYSGAAKEQKQARKDEAAGSSATITPSGVGAEDDAGTEEGSQDPWEWFTRKKGLAFPIGVGTVDQAVKAVIRGGHNFLGMAALSNKVVVIDEVHAYDSYTGRIIKQLLWFCGRLGAPVVLMSATLPADQRAELIEHWHAGAESRPVDPEAASVTSPGTWNVQWSPDPAGAFEVDPSSFARDRGPVQVEHLGDAPSEIAARVADLVGEAGTALVVLNTKDRAKRVRDELRARLADVANPPAVVHFDGEHQGAERREIKRHIDAHIGKTSPESRHAVVVGTQVLEHGMDLDADVLVSDLCPIDLLFQRAGRLHRHDRRGRPSHLARPTLYVADVDPAERAARPPSKRTSLVFTAHVTTVYRPWILGRTRMLLQQVLRAGEWDPMSEIGKQIHRLYVSSESLVEEGWERAWHVAQQRHEQALEREEADGREVLVPMLGEAAMIDRLTMRRAPAGRTRRSSGPDRFTESRGR

SEQ ID NO: 14495 - protein, 731 aa, Nocardiopsis halophila
MEIWGHSANDAGERHTLADHLRGTEERARRYGARFHAGELAGYLGRVHDVGKGSCAWQSGLLRAEASGGRVGIPHKHAGTHLAFKAGLGPLANVVFGHHGGLQCRPELKTALREARTDHKASVDEAIDRVSQVVPEILEGPGLPSWVQTAITSAPLVTDVLVRMVFSAVVDADRLDTAEHMDAIARPDHPVAAGDLVERYEQSRLARLEGRAPSPVDADRARLYEQAVAAAEGPQGIYRMPAPTGSGKTYAAGAFGLHHARRHGLGRVIVAVPFTTITEQNAKEYRDLLEAPGQEPVVLEHHSGIDLDADGAPGNRWAKLASENWDAAFVVTTTVRLFESLFCHKPEAMRRLHRLAGSVLVLDEVQALPDRLLVPILSMLRTLTEHFGVTVLLASATQPAFFDLSPFQDVPARDVIEDPAPLYRRLARVTYSWWTDPAPTREELAERAAASPSVLVVCNTTSQAQELHEGISRHRQDDGPVLHLSTRMVARHRQDVLAKITELNKAGAPAAVVSTQLVEAGVDLDFPEVFRAFAPAESMQQAAGRCNRSGRLEQGRVVVFDLTGDDGKVSSGGEFIYGAALEATREHFGPGKAWPDSPDVMDAYYKDRFKYTNVENDGQKIQDARRDGDFPEADRLFTMIKEVSIPVVAVPERYAEDAERVREMLGLLRQGVPPGHLLRELRPFTATLPRGLAERKAAGLLAPVVGDLYEWLGDYDDERGIVIADTKEYVF

SEQ ID NO: 14496 - protein, 787 aa, Bacillus coagulans
MPVLIPFDECIARPDEGEKKYYLKDHLLHVKKFAENWIVDAGETIKTLTGLAAVCHDIAKSHADWQRYIADPKVKKGPTHAPQGAFLFSFFGYHWLKSVGKWETNRVAWLWLVRDIADHHGRLKKLQDDHWLQRYDWEKMDMTGIARFLKDLYSEFSNLEITIDNLDSWLDTADEWIEEAMDDLDIGFRQKEEFDLMMQLQTWRSLTTSLIAGDRFDVKDTGTRLLDEITIEKCDAALGCYCTAKAGSPLAQARSQAQQNILKQLVEQPESYFYTLEMPTGYGKTITALKLAIWLGKQRHYRKIVYVAPYLSILEQTSRVIEEAMDIGALEHHSLAILDQYNKSGTQGEQRVPNDELAMESWAHSVICTSFQQWSKAIFPVRAQDVLRRAFLKDSIVIIDEPQIFNPDGWNLFLTGLEAIAKQQRLCILFLSATMPPFEYGLKKAPVRLVVSGNQVDRYQVQLKEKMDEEEMAAFLNTREDIKQAAILNTIEDAYRVYEQIKDEGDVRLLHGLMVPVHKKMEIAKIQDNLEKEKEKSLKVISTQIIEAGVDVSFHHVVRALPILPSIVQAAGRVNRHFEADNGILTIAPFFRNGEKNTRNSIYARPLQRITDKLLSEKNIWMESEMEPLVRKYYDEMFRENTYETAKQAIREAYEGDWPQLSKYEPFGQDYLKLPLFVPWEVPEEDEKWLPEQFLWLCKKFGVADAASIYERYSNVNFMNDLSFEERKQFMILFHHFVLNVPVKTALKFINREEYLQSNRVPLLYSEGAYDQKLGLVGHFDELDNFI

SEQ ID NO: 14497 - protein, 716 aa, Bacillus coagulans
MDEHMKGTYFQARRFSHTFDRYGITAIAAIAHDLGKKSGAFVQYLKADKKIRGSVQHAIGGAIALHDIMQRGVQDERMIMAAAIVAGHHTGMPDLNTVFDEKIPDAPQYLKTIPDLSQTEMQIIKDILKRFPGLPLGGKSDSKSPFAYKEMLMRMCFSALVDADFLDTERYFDYGKSIKRQGKAFSIHQLDEQLQNYMLELRMKGKDKEINRYRNEVYTACREAAKQPLFFRALVVPTGLGKTLASIAFALEQAKRFNKKRVIVALPFVNIIDQTAQKYQEVFGKASVLEQHSQLSYTDDKDEAMERARLAAENWDSFPIIVTTTVELFESLFSNRTSKVRKLHRLANSVIILDEFQKLPIHVLAPIFQALHILMEHFNVTVVLCSATPLSFKNAELVGNMGTPVEICKNHDQLFASMKRVEYTPIEKPLTVSELVARMREHPAALCILNTRKDAFQVYREAISQKVNGQHIYHLSNRMCPHHRKKVIEQIKEDLKNEKSILVIATSLVEAGVDFDFPAVFRAMAPLDSIVQAAGRSNREGKLEKGAVFIFELIGGGMPGGMYRKGTEQTRILLNHHGTVALHEPWIFEKYFRSLYTLGGDDLLDSYGITSLKPFSFEKASRLFQMIDQNTVSILCKNYQDEDGQIERLIRMYKEAPYLTKEWYREAQLFAVNEYVDSSFFRENQNQLEKISEGWYIWHGNYDMKTGIMDMDEGGD

SEQ ID NO: 14498 - protein, 889 aa, Nocardiopsis baichengensis
MVWLAMVHDIGKATPAFACQVEGLAEAMRSQGLKMGSAAQMGKDRSLAPHGMAGQLLLVDWLQENGWAKRTAQQFGAVVGGHHGVPPTDADLQDALGHPELLYGPTGTDAWRRVQCELFDAAAVACGIRPHLDAWSSVKLPQPSQVLLSALVIVSDWIASNASLFPYFQQAGTAADGRVSRALQRLGLRGRWHPRLPQGSAQDVFAARFSWDEGIRVRPVQEAALAATRSMDEPGMLVIEAPMGEGKTEAALVAAEHMAAVSGAGGCFVALPTMATSNAMFSRLTDWADSLEGIDGSASGFLAHSKAALNDDYAGLPFAGVGSADGIERDAPEGRRPGLAAHWWLRGRKKGMLADFAVGTIDQLLFAGLKSRHLALRHLAVAGKVVVIDEAHAYDTYMNTYLDTVLAWLGAYRVPVVVLSATLPARRRRELAEAYCQARRGSLEFDAVEKAQGYPLLTSAVTGKAPQVEAVEASGRRTEVGIERLDDDLDVLAHRLEAELAGGGCALVVRNTVKRVHATAKVLRDRFAGTDVEVSVAHARFVDLDRADKDRELLAAFGPPAKVADLGGHRPQHPRIVVASQVAEQSLDIDFDLLVTDLAPVDLMLQRMGRLHRHLRGQGQSQRPEGLRTARCLITGADWGQQPPEPDAGSQFVYRRYPLLRAAAVLDSHLPAEEGGNAAGGTVVLPDDIDRLVQDAYGPDPIGPPGWQEELEQAREAHEIEEADKADQARAFLLNVPAKTGRSLIGWVNAGVGDTDDSPRGRAQVRDAGESLEVLLLQRRADGVLTTLPGLQQGKGGIELPTDFAPSEEAGRIAAASAVRLPFPLVAPWVIDRVIGELEQNLFPAWQDKDAHWVAGELLLILDEDCRARLAGFDAYYSHEDGLEVTDGH

SEQ ID NO: 14499 - protein, 731 aa, Nocardiopsis baichengensis
MGIWGHSANDAGERHTLADHLRGTEERARRYGARFHAGELAGYLGRVHDVGKGSCAWQNGLLRAEASGGRVGIPHKHAGTHLAFKAGLGPLANVVFGHHGGLQCRPELKRALQEARTEHKASVDEAIDRVSQVVPEILEGPGLPSWVQDAFTSAPLVTDVLVRMVFSAVVDADRLDTAEHMDAIARPDHPVAAGDLVERYEQSRLARLEGRAPSPVDADRARLYEQAVAAAEGPQGIYRMPAPTGSGKTYAAGAFGLHHARRHGLGRVIVAVPFTTITEQNAKEYRDLLEAPGQEPVVLEHHSGIDLDADKAPGNRWAKLASENWDAPFVVTTTVRLFESLFSHKPEAMRRLHRLAGSVLVLDEVQALPDRLLVPILSMLRTLTEHFGVTVLLASATQPAFFDLSPFQDVPARDVIEDPAPLYRRLARVTYSWWTDPAPTREELAERAAASPSVLVVCNTTTQAQELHEGISKHRQDDGPVLHLSTRMVARHRQDVLAKITELNKAGAPAAVVSTQLVEAGVDLDFPEVFRAFAPAESLQQAAGRCNRSGRLEQGRVVVFDLTGDDGKVSSGGEFIYGAALEATREHFGPGKAWPDSPDVMDAYYKDRFKYTNVENDGQKIQDARRDGDFPEADRLFTMIKEVSIPVVAVPERYAEDAERVREMLSLLRQGVPPGHLLRELRPFTATLPRGLAERKAAGLLAPVVGDLYEWLGDYDDERGIVIADTKEYVF

SEQ ID NO: 14500 - protein, 744 aa, Nocardiopsis halotolerans
MTSTSPRSGCEPAPDGKRSGFELLDRSVQHWVWRRRWPSLRPVQERAVAPILAGDTDVIVTAATAGGKTEAAFLPICSALVAAGRRGTEDDGGVRALYVSPLKALINDQYQRLRDLCADLDIPVTPWHGDVAVNVKERLRSSPDGILLITPESLEALLVLNGSGAGRMFGALSHIVIDELHAFLGTNRGAQLRSLMARVEAAAGHRVARVGLSATLADLGGAAEYLRPGGGDRVVIVADEREGRQVRLQVRGYVGDLTEDRGAGAVSADVADHLYRTLRRGHNMVFANSRAGAEGYAALLAERAERDRIANPFLPHHGSLSAELRSRAEEHLKQRSTPATVVCTSTLELGIDVGWVDRVVQVGVPPDVAGLRQRLGRSGRGDDPARLLVYVTEQSRPRDPLGRLRTALVETVAIVDLLLRRWYEPPRLDSPDLSTLVQQILALVTQEHGTTAARLYRVLCSSGVFPGVDRDAFTALLRGMGGHGLLVQERGGLLLLGPEGERLVNHYSFYAAFTTVEEFEVVASGNRIGTIPVRPSLMAGTPLTFGGATWRVMEVDRTEARVLVEPASVGGPPPGFMGTESPVSDGVRARMREVYTSADSPAYLDEAARILLEESRSAFRDLGLHRSSAHAYEDGLCVFTWRGDVVIDTVCQLLRRYGVAASRAGCALLVSDATPERLAETAGRLLRDPRPEAVELAAEAQDRAVDRYDAYLPEALLNRAHAARALDVPGAFEVLAELADRTGV

SEQ ID NO: 14501 - protein, 972 aa, Nocardiopsis ganjiahuensis
MGTMTPHPPSQPWRDPLSEAARSVWAKHDFDSDGWLPLYRHMADSAFVAAKLWDEWLPGQVRSLIASALPEGEADARLLALWSAATHDIGKATPAFACQVEHLADDMRAHGLDMPLQKQMADRRLAPHGLAGQLLLRDWLVEQHGWRLRDTHQFTVVAGGHHGIPPTNSAITDLDDHPALLRTRGSAPAWQQVQTELLDTAAHATGAAARLAHWRTVKLPQTAQVLLTALVITADWIASNPDYFPYFPGERSTDPERSEQAWRLLGLPHQWSPQQPRGTAAELFAERFDLPDGALPRPVQEQAVEAARNMSGPGLMIIEAPMGEGKTEAALTAAEILAAETCAGGCFVALPTMATSNAMFARFTHWLDRLPGMPREAASIFLAHSKAHLNKEFSRYLGGGPRLATDTDRDSEGTPGAAALVAHRWLRGRKKGMLSSFSVGTVDQLLFTGLKSKHLTLRHLALAGKVVVIDEAHAYDTYMNTYLDRALAWLGRYGVPVIVLSATLPARRRRELAQAYTGASPRTGDEQGYAEVGRADAYPLITTAEPGTVPRLYTPAASGRATDVLVEPLDDDPGTLTDRLERELADGGCALVIRNTVARVHETAAHLRDHFGDASVTVAHSRFLDLDRAARDEQLLREYGPPAKVAESGGTRPARHIVVASQVVEQSLDVDFDLLVTDLAPLDLVLQRMGRLHRHPRGEGQGQRPPRLRTARCLITGVDWTETPPRPVRGSRTVYGEYPLLRALAVLRPHLEAQTDSARTLRLPEHISPLVQAAYRDAGDHAGTAPAGWTQALDRARITQEAEQADKATRARTFLLDPAARDGRAIIGWVDAGIGEADDSQSGKAQVRDTGESLEVLVARRCADGTATTVPWLSGQRGGLPLPTESVPAPEAARALAASGLRLPYQFTLTGQMIERTIAELESDLVDAWQTKEAHWIAGELVLFLDEDDRAELAGHRLHYTESDGLEVTRAE

SEQ ID NO: 14502 - protein, 897 aa, Nocardiopsis lucentensis
MFLACTHDIGKATPAFACQVEALADRMRRHGLDVPLEKQIRQDRKLAPHGLAGQLLMQEWLVEQHGWAKRATLAFTIVAGGHHGVPPEASDIETLRGHRHMLRTRGSGPTWKAVQCELLDHAAVATGAREHLTGWSGVKLPQTTQVLLTALVIVADWIASNSDLFPLFPGVRERDPERVEEAWRLLDLPAPWRPQDPDLSVDALFKARFDLPDGAKVRPVQEAAVTAARDLGGAGLLMVEAPMGEGKTEAALAAAEILGAHTGAGGCFFALPTMATGNAMFPRLTSWLDRLPAPDEHTRHSVNLAHSKAALNERFTRLMWSGGQSANIDPDGDDDHWDHRADQVRTSAELVAHHWLRGRKKGMLASFVAGTIDQLLFVGLKTRHLALRHLAVAGKVVVIDEAHAYDTYMSRYLDRALSWLGAYGVPVVVLSATLPASRRRALAAAYAGARPDAAEFAPLEQEESYPLITAVKRGTSPTLYRPAASGRSTQVRLERLDDDLDILARRLGTELADGGNALVIRNTVARVHATAKRLRDRFGRDNVTVAHARFLDLDRLANDEDLLRHFGNPDKVADLKGKRPSGPHVVVASQVAEQSLDIDFDLLVTDLAPIDLMLQRMGRLHRHERGAEQCDRPPRLRTARCLVTGADWTTAVPTPISGTKIYGTYLLLRTAAALETRFAAADTGEVTASTVSLPDDISPLVQAVYRDAPLGPDTWRTTIDQEREAFEVAIAEQSRKAEGFLLGDVGRDGRPLVGWVAAGAGDADDTRAGRQQVRDTPDTIEVLVVQRRADGTLVTVPWLSNDRGGRELPTEAVPPDELACTVAACGLRLPFEFTFEQTAMKAIEELESDVFPAWQVKESHWLAGELLLVLDEKCRRELAGFELHYSEEDGLKVSRVE

SEQ ID NO: 14503 - protein, 798 aa, Nocardiopsis salina
MVSQLLGGHHGIFHQHADTVHAQPLRSLGYEEDAWEEQRGLHLATLTELFGAPVAPGRIDGAVAALVCGVVIQADWLASQLSFVGRQIAAGIPSTGADLPWFLDRARDRAPGLLQQAGLGRPAPRPASFARAFPQIEHPNGLQRSLVKHLPELCNGPGMLLIAAPTGEGKTEAALYAAEVMGEAAGRSGLYVALPTMATADQMYTRVNEYLNRRVTAPSSMTLLHGMAWMNPDYASPASTSSGELSASHTEGATESRRAVEVSEWLQGRKRGLFADFGAGTIDQALMAALRSRHNMVRLLGLSGKTVIIDEVHAADPYMLALLTRLLNWLGRLQVPVILLSATLHHRTAHVLTEAYLKGAGRKRRSGDPIPHVRYPGWVYAGAEPPHPVTLNPEPLETTPRIPLTVQCREVPLVAEGPSGLDPAVREELADLVENGGCAAVIRTTVAEAQHTYSDLAEWSVRHAQEVGVEPPEIHLLHARFPADQRERITRRVIRRFGAEGAREGDRPRSAILVATAIIEQSIDIDLDLMISDLAPVHLLLQRAGRCWRHEHRGIVERPRWADVPRLVVLAPAQVDAEKALPSVWRYIHHPSLLLRTHNLLRRREGQPVRVPEDVQELVDGMIDDADLNPELPDQDLDRQATDMAHRQLGDNAAIPRPGSVTRSLHALTDHDLDEAQVATRFGADSARVVCCYTDSDGECWLDSALSERLPSEGELPKGHFSEDQVRAVLSRSLPVPGAWLDGHEEQTAPPEAWQANAQLRHVGLLVHRIDREGAVQGVQLGKRQMRLDRCVGLLVEG

SEQ ID NO: 14504 - protein, 953 aa, Nocardiopsis gilva
MTAETTDPPPDHTVFWGKTGKGSRTYSPSDWHPLAAHMVDTLHVADQLWEHYLSPALKRSFLPGAADEELGRAAFRWVAALHDLGKAAPGFQYLSDPHFQQVTRSLPCSAGPRHMRHELMSAQLVRTFLGELRWPDESIDWVADIVGGHHGVFPKPAFRTAMKSNDSLGDAAWRARQRELFLFATRASGIDLDELADHVPGIGAQMAFSGAVILADWLASNDDMFGYRNGWPPGYQATSEKTAEGFRTFMELGEVWHPAPPANAEELYATRFGIATPRGTQLLADEVARGAEHPGLMVVEAPTGEGKTEAALVAAEILAARFGFNGLFFALPTQATTNHIFDRVLDGWIHSQSPKPTIGLAHGKAQRHARYEKLLEGIGEDENEALTASQWMRGAKRALLSPVVIGTIDQLLFAGVSAKHVMLRHTGLANKVVVIDEVHAYDAYMSEILHRVLHWLGWHRVPVVLLSATLPSTQRDALLRAYTGADEVEVTGAGYPQITWAPALDVEERERFGEPSDPFEAESHQPLPLKAQATTSSRGGELAVEFRPEPADTPEAVTALVDELVGDASPTSGRGTVLVLRNTVARAQATFAALEGRFPREVSLAHARFTTADRRRLDADLTQRFGPPRRDDGSGAVTENPHRPARHIVVATQVAEQSLDVDFDVLISDLAPIDLLLQRAGRCHRHARPQPRPVGLDTPRLVVTGYTDPDGDGRELPTEGALPVLPTGDARPYLHHLLFRTLAHLAEHREHNGRLTVPADVPSAIEAVYGDRPLGPDAWQEAMGAAAEAAERHIRELAGKAGAVLIARPDLDEFGLGEVQHLGGDHNVDEDEEKVAQMLPVRHGATSIEVILLRRVDKNTAETVSLPQAGTARRRVPLNRMPSDAEKEAILDQAIRLPLWQVDTEKLSSPSGWKRAPWSSRLRVLLLDSSTGEAQKGNRRATYSTETGWTDIT

SEQ ID NO: 14505 - protein, 945 aa, Nocardiopsis chromatogenes
MWAKHDWDSGGWLPLWRHMGDSAGTAAYLWDEWLPAQVRARIGEALPGGEADGRRLAVWLAMVHDIGKATPAFACQVEGLAEAMRSHGLKMPSAAQMGKERSLAPHGLAGQLLLVAWLQESGWPKRAAQQVGAVVGGHHGVPPSDADLQDALAHPELLYGPTGTDTWQRVQRELLDAAASACQIREHLDAWSPVKLPQPSQVLLSALVIVSDWIASNAALFPYFQQAGSAADGRVSRALQRLGLRGRWRPRRPQGSAQEVFAARFSWDESTRVRPVQEAALAAARAMDEPGMLVIEAPMGEGKTEAALVAAEDLAAVSGAGGCFVALPTMATSNAMFSRLADWAGSLQGLDGSASVFLAHSKAALNDDYADLPFAGVESADDVERDAAESRGGGLAAHWWLRGRKKGMLSDFAAGTIDQLLFAGLKSRHLALRHLAVAGKVVVVDEAHAYDTYMNTYLDTVLSWLGAYRVPVVVLSATLPARRRRELVEAYCQARRGSAEFDAVEKAQGYPLLTSAVPGKAPRVEAVEASGRRTEVRIERLDDDPDVLARRLESELAGGGCALVVRNTVKRVHAAARVLRDRFAGTDVEVTVAHARFADLDRADKDRELLAAFGPSAKVAELGGRRPEHPRIVVASQVAEQSLDIDFDLLVTDLAPVDLMLQRMGRLHRHLRGEGQHERPERLRTARCLITGTAWAKQPPEPDSGSQFVYRPYPLLRAAAALDPLLQADDGRGSAGGSVVLPDDIDRLVQGAYGPDPIGPPEWQEALEQARESHEVEQAAKTEEARAFVLGAPARAGRSLIGWVQAGVGDADDTPRGRAQVRDAGESLEVLLLRRRADGVLTTLPGLGEGRGGIELPTDFAPSEEAGRIAAASAVRLPFPLVAPWVIDRVIGELEQNLFPAWQDKDAHWVSGELLLILDEDCRTRLAGFDVHYSHEDGLEVTDAH

SEQ ID NO: 14506 - protein, 459 aa, Staphylococcus
MLQEKLKQWFGFDSFKPGQEEIITSVLNQQHTLGILPTGSGKSLCYQLPTYILEKPTLVISPLISLMDDQVMQMKLNGEHAVSCIHSGMDENEKRQNFKKINQSKFIYLSPEFILQPQNFKLIANIDFGLIVLDEAHCLSEWGYDFRPHYALIGKITSHFKSSTILALTATAPPHLENDLKEILHVNLHTVKTSMNRLNISLRHMNFASDEEKINWLLPQLTSTGPTIIYVSSKKMCLTLANLIYDSGFLTGIYHGDLSYQERHTVQQQFLNNDIPVIVATSAFGMGINKKDIRTVIHFHLSSSPSNYLQEIGRAGRDGRQSQAISLYQPDDAYILETILFADRITPEDINQFELGQFIPPEKETILSILYNQYTIAKLHYIFDQSYKRKKLGYSRMLGYKQLDQCRRKYLLEFFNEQPEIPNQCCDNDTELSEIKVINRKKVKRKLNYKEKLQNLLEL

SEQ ID NO: 14507 - protein, 818 aa, Paenibacillus sp. PAMC 26794
MTYIAHICQKDGRIQTVQDHLVEVKQGAEQAGEKIGVKYLAGIAGLLHDMGKNTDLFRNYIQEAVANPDAPPRKGSVDHSTAGGKLLHSLYHGSGTTLESKYTTEWIANCIISHHQGLRDYISPDKTSPYMERVISRQIDQYEQAKEEFFKHNLPGQLDHMFKQATQELQGYIQIIKEHKLPPIAGALLIKYMFSCLIDADRTNTRRFEENETLAEEIDYKSFFLQSYELLSQHLSKLEHSSIVDTPINRLRREMSRQCEQFAYRPSGVYTLSIPTGGGKTLASMRYALRHAIEHNKQRIIYIVPYTTIIEQNAAEIRNILKNDDMILEHHSNVVDDKDDERHEGDEGETLDLRKKNLKLARDHWDRPIIFTTMVQFLNTFYAKGTRNVRRLHQLSNAVIVFDEVQSVPVHCISLFNAALNFLHVIGRSSLLLCTATQPALDFVKHKLHFSKQPEIIQNLDEVGRSFKRVDLQDLTRESPSGWGAEEVSSFVQEQMREVDSVLVILNTKTAVRKLFEQLNEVEWLRESGVQVVHLSTNMCAAHRKEVLSGEYGVIPRLAKGERIICVSTQLIEAGVNISFDCVVRSLAGLDSIAQAAGRCNRHGKDKVRNVYIIRSSDEVLTNLPEIQIGAEKTERVLQEFEDDPGSLGDDLLSSKAMSRYFEYYFNDIGDKMHYPIPKLEQNLFDLMDRNRYYVDAYKKKHDCRPEVVNHYAIATAEKYFEAISTNATLVIVPYGEEGKELILDLNGAIEPGEMSQLLRKAQQYTVNIYDHELRALEKNGDVRPLLHGHVLALREPAYSDDFGVESKGEGAWEPMMI

SEQ ID NO: 14508 - protein, 786 aa, Oscillatoria sp. PCC 10802
MLGLNEHLLAKSKRSGKILTLEKHLNETEEAAERIFRLDGRWGRNWCRFFKIYAEADQQRFLLNLRVAALFHDLGKANEDFLKAVSQKGFYQQSIRHEHLSALILQLPEIWQWLGRNSDLDLDAITAAVLSHHLKASDSGSWEWCQPKGRLCVPLYLQHAEVKAILARIAKVAGLPEPPALPQEPWTRESVWQQALSRGRQAAKDCNRNIRKERNPKKKSLFLAVKAGVIVADAVASALFRENLLLEEWVESAVHTPPVTPAEVEEEILTPFAKAAAKKEGKPFKLRDFQGEVARIGWRGLLLTACGSGKTRGAWEWLKEQCREREIGKLIFLYPTRATALQGFLGYTAWGGEKAAHLTGTAQYELEWILENPVESTKGKDFRLSESEARLFALGCWDRRYFSGTVDQFMSFLAHNYKAMCLLPVLADAAIVLDEVHSYDRQMFESLIAFLRNFDIPVLCMTATLPVGRKQQLLDTGLVEFTSQSAGQKSSYLEEQENHPRYRLEVVKEPDALSRAIAAYQNGQRVLWVVNQVARCQNRAEELEYLLGVEVLSYHSQFKLGDRNDTHAAIVAAFTADKKEGEQKEIVPAIAVTTQVCEMSLDLDADLLVTEIADICGLVQRFGRANRQRSRGNDFRAQLLVYPPENSRPYTKEEIESASRFLADLGRGDLSQRLLAEKLEHHAQKEPSVEGWTRFLSEGYYATPADFRDIDDYRKTCVLDGDLPQVLERIQDRRPFDDLTLGVRERYVLDLGTERPHWLPKWLGVAPSRQYCQKRGFWEKREVQNV

SEQ ID NO: 14509 - protein, 803 aa, Scytonema hofmannii
MFKRLLAKSYQKDENDTRKKGAATYTGHISFVMQAADVLVDKLGMAILQQLGIQHIGLDSLAATVKLGAYLHDWGKANQHFQEMVYFKTIDPKSIDPNIQNYRKKIGDSLKARLNRQMLRHEVISGILALQVPCFREWLEKCPNANLTIAVWAAMGHHLKIGSSKDGTPSGCIAEIPSGTGDELKIYTSHSDFLTVLKMGSQSLGLPKQLPEFPTKIWTDKQLLTALTNLRNEFIDFEPDWEQQKFIAAVKATVIAADLAGSALPELEEDFQEWIKEVLSLQLSKQELNKLVQQRLNGKKLRQFQELIAKSKHRVTLVKAGCGTGKTVAAYAWGEKWAVGRKLFFSYPTTGTASQGYIDYADGTEIEAALMHSRADLDRELLFSGDEDDRESIDSKLMAFQAGRKKLIVCTVDSVLGLIQNNRKPLYSWSALAQSAFVFDEVHAFDLRLFGALLKFIKAFRGVPILLMSASFSPQQLSAIQQVLAEQGEDLGEPIEGPKELEELPRYDITYIPEISNFEELTEVWESVIEALRNQQKVLWVTNSVKTCIEIYRIAQVKLAEQLPEFSITPLIYHSRFRYKDRVKKHQAVIEAFKQDEPVLAITTQVCEMSLDLSADLLISAIAPAAALIQRLGRLNRRMSKVEEGAKLAIIYSWDNPKPYNEVEISTGKQLIQEFSGKTGISQRDLAEFSASLNSKEIPEVKSNWLEDNWCTYPNSLREAGYTMTVLLGEDEPEIWKIAEQKEQELLKKHQNVSRIKLFKQEAQKWTVPIRIESDYYTWKRRGFYPVTPIGRIPYSEEVGAEQ

SEQ ID NO: 14510 - protein, 758 aa, Scytonema hofmannii
MLKQLLAKRPKTDGTKLSLKQHLIDTDDAALAIFKGRMLQNWCRFFRVRDPQKFLIHLRIAALFHDMGKANAEFYAAVQGSREKQTLRHEWFSAFILHLPKVRNWLATSGLDLEVITAAVLCHHLQAHPKEWGKPRTLVKQVELYLTHPEVTDILEKIAQLAGVENLPELPQQWVAGNVFWNQVYQDANDVGDDFFIDIQDDDEQHNERRSLLLAVKAGVIAADSVASAMFREKDYTMQQWLDKHLHQRAITSEEIETKILQPRYRQIEKKSGNTFELRPFQEKAKDLGDRVLLLSACGSGKTIFGYKWHQSVLSRHQVGHLIFLYPTRGTATEGFKDYVSSAPESDASLLTGTASYELQEIAQNPTESTQGKDYTTDERLFALGFWGKRFFSATVDQFLSFLTHSYSGLCLLPVLADSVVVIDEVHSFSKDMFDNLISFLQHFDIPVLCMTATLPKSRRQQLEKVGLKVFASDADEELTKVEQQPRYLIEKTDFQTAFQRAIEAYQQDKCILWVVNTVDRCRETAADLEQELGVNVLTYHSRFRLMDRQEQHKATVAAFAFNRGQRQPVIAVTTQVCEMSLDLDADVLISELAPISSLVQRFGRSNRSSERQKTFRSQILVYEPPNIRPYKDDELKAAQRFMTEVIGEVSQWKLAVELERYSPGERFADGGSSFVHGGYWAFSQPFRDTDDYSMNALLDSDLNAVKELIKKRKFYDQYVLPVPKKFALPEDRRPEWIPNYMAIADRQFYCPKRGFGE

SEQ ID NO: 14511 - protein, 747 aa, Clostridium tyrobutyricum
MVDTVLAKKRKDGSTQNLNEHTFAVIEESLKLMDNDQLADICNKIKWKKSKIQDLVFFCAYFHDIGKATFQFKETIEHEAKSYHSFYSANLLANIKSFNLYGINLLMLCVMTHHSVFNQSSKFKSAGNSKELKFEFLDCAKEFFYGYKNSYEEYMHRKCSYNFEYEEMPLKKIGIKIRHMYKCVEGIEEDTEEIDYKKIRLVYSYVLGILNLADWIASAKFNKTMPKIEFDNLMDRNELCKRLAKSIGILEFKPKNFQDKLSNFEGSILVEIPTGEGKTEGSFLWGIKNLKGKSGKLIYTLPTQTTSNKLYKRAAEVFSYDNTGLVHGASKIFLENQYEEEYGEIDNKFESNILFSKTFNKNFTVSTIDSLFKYFLNIGRYNIAMLNFLKSAIIIDEIHSYDFKMMGFIKRFLEICQYYKISVCIMSASIPYKTKKLIGIDKMPVITDSKLFAQKANYIHKVEDSLDNDLNHIIDKYNKGKNILIVRNNVRDSIKTFLSLKEKIENIVLYNSQFKKMDRMKKESEIYNKLENKEQFILVATQVVEISLDIDFDVMYTDNAPIDSLIQRFGRVNRKKNPNKLGEIFIFKNTNEKPYYYKVLELTYETIEEGLFTLSRYNEWLNIVYDKLYSDKKIEDEIQSKFRDGYNMIDKVIGKLHGIEQSQDIYDMRDIEFPKEDFILQKEYDEDNFKYDYTVSLPVYLADPRLGHLINPKFEKTYYRILNFSYNYDVGVKIPLDDKLDLFAGDD

SEQ ID NO: 14512 - protein, 778 aa, Bacillus oryziterrae
MENSFKQLTGHNPYPFQLQAIQEILDNEKYIITASTGSGKTWMSIFPFIYAKENNIAFADRMFYVLPQRTLVTSVADVIKPILAERSLKVTIQMGGQNEDPYFEGDVIVTTIDQLLAAYLGVSYGTSRNGSNIAPGAILGSYIVLDEFHLLEVDKSLATYIDMINYLSPFVRTCMMTATATEKLLEALANKINGRYQMISGQEIVDLQMDLNAVRLREVFWNEAPISVEEITKKHQDRTLVVVNTVKKAQKLYKELNEHLRSIGENNKIVCLHARFLKNHRNKLESEILETLKRNSNKEMIVIANQVVEVGLDISATVLITELCPANSLIQRMGRCERYGESIGKVFVHELEGSSLPYDSNLVNRTKDYLMENAPIIMTAIEESQMVEMVHSNNEEELLNKISFSEVRKIVAKTQIEGHRSHIKELIRDVDNIQVIIHPKPWELDLYKKPEYFSIPYRTIINALRKIENLDGLVFNPEFPEDIQNKYSKEVKWKPLKDIKSIHNYSFISLSPQIASYCKNIGFKLDQAGEFTSKETVDEIDKRKRFSYKNETYLEHAMDVRVKIRSRDEEYTVFSNQVQKALNNYSISLNELAEFVGALHDAGKLLIDNVLAYQNWQQEIIGDITNEYLAHTDFDANNHYHVQKEKEAKFKRVPHAAEGACAVLPILMKVVGDLNVSKKLESELFLAMFTAIKRHHGAYVNQVKEYSMVSDASKIILKTLEGFSLNVVSLNEKFGLAKATQYSKYGVNPSEYEFGWPLYWYFSRRLRLADQLSQQEKI

SEQ ID NO: 14513 - protein, 694 aa, Aeromonas hydrophila
MGADTDVIIAAATAAGKTEAAFLPIFTVLLNSPEPATVLYISPLKALINDQWGRLNELCDSLELPVTGWHGDIAYSKKQKFLKRPNGVLLITPESLEALFVNRGPSIPGMMANIKYIVIDELHAFIGFERGKQIQSLMHRVELAIGRQVPRVGLSATLGDMSLAAKFLRPSLPDSVQLIESKDGGQELKVLIKGYIEGKTEPDEERDEDDPTSPYVAIGNDLYRTLRGSNNLVFPNSRSNVEKYTDRLRRLCEQDRVPNQFWAHHGSLSKTYREETEQALKSGDVPATAICTSTLELGIDIGSVKSICQIGRPPAVSSLRQRLGRSGRRKGESAILRGYIIERELSPKTSISDSLREDLIQTIAMVRLLISGWFEPPLTGGLHASTLVQQILSVISERGGIMARDLWHSLLSPGAPFEGFTPDDFIGLLKQMGSLKLIQQDSSGLLLHGEIGEKFVNNHEFFASFVSDEEYRLICASTQVGLLPISRPLITGQKIIFAGRRWQVLEVNEEKKFILVTPSKGGTPPVFDNCLASVHERVRGEMRNVLAGGFDVPFLDAKAKELLAEARENFKRYDLDSTILIEVGSNTVLLFPWSSDIAHDAFVLLMQKNDIDAVNEGVYILINCTKEKMLNVMASINDSHILPTDLLDGVQNLNREKWDWALPDRLLRKSFSSLRLDLEGALGICKKVILMYGK

SEQ ID NO: 14514 - protein, 902 aa, Clostridium botulinum
MKNIKGYLVDINEIIKDIDKMYGHTSTDNSKDPEYLLKHLDLVIDKYIMFDKHNGVMEKVEILVEDILINSNINGNINIIKEFIIKAFLNALYLHDIGKASIGYQVGVLKNSNFKELYNVDMSNNHSPYSTRIYLDLMCDEVQILIKSKVIDINSNDVFLILYMVGMFSYCIQKHHSRLENVTNFLTETLKATLCKELDNGKIEFITSDKYEELIMYVNPTNKAYAILSLQQMISNGLDKVLDNIKEYLYLLNRLLFSSLVTADSLATSEYMNNTKIEFSNFNIDEAIKEYRKSKLYNSIQHYYDTGEIDSEINAIRCDILKEVDTELGLNINKNILYLESPTGSGKTNISTYVGLRTMELTKNKNNAIQRFLYTAPFNSITTQTTKFLEDIFKSSNIDTTLVNSATSIKVNGNNNEELIYELSLLDYQMLNYPITLTSHVKLFSILFSTSRLDNHSLINLFNSIIIIDEVQAYNPTIWPKMIKLMDIYAKYMNIKFVIMSATLPRLGELINKENTVSSYGNLIKDSSIYFKNKCFKNRISNYNYYMIEDSFLKYKISLSKEEYREKCFRTIVNKIRNIYKKENAKILVEFITKDSCRQFYKYIKNENTLNEIKDNTLSIEELTSEDNDYIRQKIINKAKHNENIILVCTQCIEAGVDLDMDYGWKNISYIDSEEQFAGRICRNYREGRYGEVNFFLLDNADDIYSHGKINFKSDFNILNLKYRKVLENKNFEIVFKDMINSINKKIRSSNEDVSINKFNFLLQKLDYKGIEKALMLIEEKQEYTLFFPFNIDLELENNIINMKGKNIWNKFKDSFKGNNYAKKKIDIKNSMCDLSYFCYKYSFKGSIEQFEDMLISKDICYECITGIYCLMLTEDEISTIINSEYKFNKEIFDRFQGNLII

SEQ ID NO: 14515 - protein, 988 aa, Methylomicrobium buryatense
MMVTFICECEKKALNRTRRVLDAFANRIGSRTWQTVITEEGLQAVKKLLRKSATKNTAVACHWIRSRSRSELQWVVGNQYKFNDQGIVPVNYTNQLNVLKMDELDVNIEEYFANTKKQPLAQHLFAVGYVAYKLCLQLTNNETMAKTAFITGCWHDMGKVDDVFADWLIKELKKKGILNQEVPESGQHVDSKAKNYPRHNEISLLLFYLLNKQTFANSQSKKYTEHAIYWHHDKWFRGVEKNGDYISFSLDMVYNKMIEKVGVDKFNTLLQLVRTLTQQINIIAENYSEDDNLLINHANSNIDEDKLAEIEDAHLPKYKKYTTKLNVEAYQDNILENAKCNIVRTVVVTADRLVSSLSADQLTAHLEEQTLDAVAETALLNDRGLTVAISHCLEQFNIKYPDSDRNKQQTQAALELSDDEVMIGVLKGPAGCGKTKIALEWAVNTYARKIIWVCPRVQVCQGMLTDLTSKEYLPETKIEICTGEFKTLYQYGKSITTPDNQEFSGDIVITTIDQILNTITTHRKVTGLVQYMNAHVVFDEYHEYINMPGFNLLFAELVACKRLQERKNNCLLVSATPNPYFVKELLGLNQDDMVGIESFNRSQYKIEFVPPFDEGDEANNPLYQTQPDNTFIISNTAITAQRGFIRNQAKEKALLFHSKYKKLDKEVLFKKVFETFKYRGTKDYAVLRAGPIVQASLNISCDRMMTEITHAENWLQRLGRLDRFGENSDPNVYITAVPESLANGKQSGACARFLNQSNCLQSTKAWHSFLVDKITEKPIMSIAEIYQIYQDFYDDPVVQKAVEQDMLAALKKSVDLINAKIMDPVAFPNKNKTKVDKPKIKKNSLRGENRFVQMAVWNIGNGKEEFPNEYAYDEADTQGHLTLEVKTICGNDDSEKDLLAFMTKKHHNINDNAEKYGVTDRTKYKDKIYLSSSKVSETPIYLSYIPADLKQLETRPHPYAIYYAVGKFQPIGALSRDQITTFNELALE

SEQ ID NO: 14516 - protein, 818 aa, Methylomicrobium buryatense
MKIKDTLYVAHVRSNDKKIQTLEEHLIDVAEIAKKLAAKINLPEAGELIGLLHDFGKYSTEFQNYLQSATGLIDPDIDNEAVDAKALKGKIDHSSAGAQWIWQELSRYGNNGEGRLCGQIMAVCIASHHSGLIDCLKPDGSNGFNVRMQKDDVRTHLAECKENADSQILERAKKLMDKPLLKAMLEQIRVMMMSGSKQSTTIREFYLGFWTRFLFSCLIDADRIDSADFETPGNACYRNKNDLQLTVAIERLELFLAGFSNKPTESNTPIDGIRREISEVCKNRAHEPQGIYTLTVPTGGGKTYASLRYALHHAQKHKLERIIYVIPYTSIIEQNAAAIRSALERESDAYPWVLEQHSNLEPERQTWHSKLAAENWDAPIVLTTMVQFLETLFGGGTRGVRRLHQLANSVVIFDEIQTLPIQCTHLFCNALNFLADHAGMTSVLCTATQPVLDLLRAPDKGQLWLPQNSELMPDVGSLFDQLKRVVISDKTKPEGWSEDEIAELALTELDTKGNCLVIVNTKAWAQALYLKCAETVDIECLFHLSTGQCAAHRKALFKLMRRRLADGLPVLCTSTQLIEAGVDIDFASVVRFLAGLDSIAQAAGRCNRNGRLPIATVHIVNPVRETIAQLIDIKVGQEKTRRVLSEIEDEDLLSPEAMRRYFQYYFHDRADAMSYPLSAKQVGRDDTLLNLLSENKYNIGHNALLHLKQSFMTAGNVFKAIDAPTHSVIVPYREGKQLLVELGGIAKQFEARRFRECLQRAQQYSVNVFPNVWKRLVEQQAVYEIQPGEGIYGLDQRYYSEAFGLSTEPVGKAEAIIL

SEQ ID NO: 14517 - protein, 859 aa, Methylomicrobium buryatense
MIQFNPKESGWAKTNQDGSPGLPIFEHCCHVGWVALELVKQSRKIPDADLTPIAIAIIAAIHDIGKWSPGFLVKCPLWLIRENLVLFAADHAWEAQQEKRHEAHSQDSIQLLLQKRGVKQSVAQAWAMIAGAHHGKMHVPEKYGNCDVTPFIDEWHFQRQQIIFELEAELGSEIPTYEVNKRDAIVPWLMGLTTIADWIGSDETYFPVNKGLDTGNGKIAAKLAVESIGLANPRIRKGLKFKDIFGFIPNELQEKALLAIKEPGIYVIEAPMGLGKTEAALACTYELLKTGKASGLYFALPTQLTSNRIHLRVNDFINAISETPENARLAHANAWLETDYYQPRAVQTIFKKFDGDATVSRDWFASAKRALLANFGVGTIDQALMSIVAVKHFFVRRFALSGKVIIIDEVHSYDYFTGTLVKCLCDELLKLGCTIIILSATLLPKVRNKLIGIDGNLVNVDTYPLITGKTINGDVIKPQFAVAPERPAVRKIFKNSNHLIEDAVKAAQMGARVLWVCNTVNLAQQIFGQLPSDSGFESGLLHSRYPHFIRQEREAYWMKRLGKTGAQQGGCILVSTQIVEQSVDIDADILISELAPMDMLLQRIGRLWRHMDVRSARIRPVSEPQVWIVEEEKTLAELEREGSERIKKAFGIKAKVYQVYPLLKTYQTLHDYEFIELSNKTGNSQIRQLLENTYENTDQDPDSWQALYSEVKGTEFAETRLAEGNTRLFSKMALADEEGKQTRLIDIETIPLLIVLESSVNQITLLDDYKISLPITEFKIQDARAIHQNIVRVHAWPFEQIKKESELSFYLKGKHCLAHLDNDGRLNMDGLKPEIKLSWCEIKGVIQIYNKGGLDESCD

SEQ ID NO: 14518 - protein, 766 aa, Leptospira interrogans
MKRDKQSIFIAHVLRKDNGNFVEHLLDDHLYSVAELTKKFCEKFGAGTFGYLIGLWHDLGKFKLEFQERIRIRSGHIGEEAHLEGKTAKSVKHSVSGAIHCFNKFKQSDIIKKLICLPILCHHSGLKNFGIDVDIQLNEEREILALSETTPHIPQEILDGIDLKQLDKSFKDHSLLIRMLFSALIDADRLDTERFMDPVKFKERYSKTIILQDLNIKLDKHLKNIQKQADTTKVNSIRKRILEEIQTKTNLKPGFYTLTVPTGGGKTLTSLSFALKHCIANKMDRVIYGVPYLSIIEQTTDVFKKILGEDSVLEHHSGIDISKEKENSINRLLTENWDHPLIVTTNVQLFESLFSSKTTKVRKLHNIINNVIILDEAQMIPPQFLQPIVKTLKELVEFYNVTIILCTATQPTLSSIKSIDLNFDGINTAIELAPEPEKLFQELKRAIIHKPEKRKLSFIEIATKISNYDQVLTIVNRKSDSSGIFNQLTGNKYYLTTNLCAEHRRDILKKVKSHLSNGESVYLVSTQLIEAGVDIDFPIVFRAVAGLDSIAQAVGRCNREGKLVDENGQEKLGEVFLFHLQQDPPSGHLLQTKQASEDCIKNFEELIHPDTLKQYFNTLFWLKQDKGLDKEEIEKDKRSFQFETINKNFKLIDEDSRPVIVPYKEGKGLIVQLQNSVVQNNFVDYKLIRKSQRYTVNLKTNLYNKLLSEGIISEIEGIIGIIGIIGIIGIIGIIGIIGIIGILNFDSYYHNDLGILESPNDQDLII

SEQ ID NO: 14519 - protein, 745 aa, Leptospira interrogans
MKRNKQSIFIGHILRKDDGNFVEHLLDDHLCSVAELTEKFCEKFGAGTFGYLIGLWHDLGKFKLEFQERIRIRSGHIGEEAHLEGKTAKSVKHSASGAIHCFNKFKQSDIIKKLICLPMLCHHSGLKNFGIDVDIQLNEEREILALSETTPHIPQEILDGIDLKQLGKSFKDHSLLIRMLFSALIDADRLDTERFMDPAKFKERYSKTIILQDLNIKLDKHLKNIQKQADTAKVNSIRKRILEEVQSKTNLKPGFYTLTVPTGGGKTLTSLSFALKHCITNKMDRVIYGVPYLSIIEQTTDVFKKILGEDSVLEHHSGIDISKEKENSINRLLTENWDHPLIVTTNVQLFESLFSSKTTKVRKLHNIINSVIILDEAQMIPPQFLQPIVKTLKEIVEFYNVTIILCTATQPTLSSIKSIDLNFDGINTAIELAPEPEKLFQELKRVIIHKSEERKLSFIEIATKISNYDQVLTIVNRKSDSSGIFNQLTGNKYYLTTNLCAEHRRDILKKVKSHLSNGESVYLASTQLIEAGVDIDFPIVFRAVAGLDSIAQTVGRCNREGKLVDENGQEKLGEVFLFHLQQDPPSGHLLQTKQASEDCIKNFEELIHPDTLKQYFNTLFWLKQDKGLDKEEIEKDKRSFQFETINKNFKLIDKDSRPVIVPYKEGKDLIVQLQNSVVQNNFVDYKLIRKSQRYTVNLKTNLYNKLLSEGIISEIEGIIGILNFDSYYHNDLGILESPNDQDLII

SEQ ID NO: 14520 - protein, 752 aa, Leptospira interrogans
MILLAKSYPGIEKQLKSGDPESWALLEHHSSATYQVAEVLLKILEPILRKWTRLSESEYNKFVLVVCLSAGLHDLGKANEDFQKMLQRRKYLQRFRHEIWSVLALTGSGPFSDWFRETIGDETWVRIGQMGILSHHLKATRETLYADHETAEIKVFWKDQGVIKTFQSICRLAGISSPDFSSSSISSYTCLGEDADKSIRIWTREILNARIDPRYQHSIGAVRAMIIAADRLASAYKGADALKLWATEALNRVLSEQECSNIVKQGLGEKNLRPFQKQVGDSTSRVTLVRAGCGNGKTIAAFQWAKTHSAGRKLFFCYPTMGTATEGFRDYVSDIPGLDALLSHSRASLDLGELASTGEEDEGDSLNMHSRMLQEWTAQVTFCTVDQILGLLQNYRSSLTLSPAIFLGAFVFDEIHMYDSILFGNLLTFLKEFSHTSILLMTASLPETMLSAIQETVGADLGPVISGEAQIEERLRYRILHSSREDALQKAIQEFKNGGRVLWVCNKVEHCLKLYDELSEKYDIEALVYHSRFKYEDRKERHRAVIDSFQEGYKKSLPVFAITTQVCEVSLDISATLLISELCPFAALIQRLGRVNRPGQEMEGIAQALIIPFQGKPYEKENEDDGESELERCKEILKPLLDRELSQKDLALALENAKGTEHQKIPSQWLSLGWEAKPDSIRESGYTLDVILESDAYKVLKNERPWEKSKLYTIPMPIQKQFSYGEPPLRIPVVPDSQIQYSSVRGGEWNLN

SEQ ID NO: 14521 - protein, 752 aa, Leptospira interrogans
MILLAKSYPGIEKQLKSGDPESWALLEHHSSATYQVAEVLLKILEPILRKWTRLSESEYNKFVLVVCLSAGLHDLGKANEDFQKMLQRRKYLQRFRHEIWSVLALTGSGPFSDWFRKTIGDETWVRIGQMGILSHHLKATRETLYADHETAEIKVFWKDQGVIKTFQSICRLAGISSPDFSSSSISSYTCLGEDADKSIRIWTREILNARIDPRYQHSIGAVRAMIIAADRLASAYKGADALKLWATEALNRVLSEQECSKIVKQGLGEKNLRPFQKQVGDSTSRVTLVRAGCGNGKTIAAFQWAKTHSAGRKLFFCYPTMGTATEGFRDYVSDIPGLDALLSHSRASLDLGELASTGEEDEGDSLNMHSRMLQEWTAQVTFCTVDQILGLLQNYRSSLTLSPAIFLGAFVFDEIHMYDSILFGNLLTFLKEFSHTSILLMTASLPETMLSAIQETVGADLGPVISGEAQIEERLRYRILHSSREDALQKAIQEFKNGGRVLWVCNKVEHCLKLYDELSEKYDIEALVYHSRFKYEDRKERHRAVIDSFQEGYKKSLPVFAITTQVCEVSLDISATLLISELCPFAALIQRLGRVNRPGQEMEGIAQVLIIPFQGKPYEKENEDDGESELERCKEILKPLLDRELSQKDLALALENAKGTEHQKIPSQWLSLGWEAKPDSIRESGYTLDVILESDAYKVLKNERPWEKSKLYTIPMPIQKQFSYGEPPLRIPVVPDSQIQYSSVRGGEWNLN

SEQ ID NO: 14522 - protein, 745 aa, Leptospira interrogans
MKRNKQSIFIGHILRKDDGNFVEHLLDDHLYSVAELTEKFCEKFGAGTFGYLIGLWHDLGKFKLEFQERIRIRSGHIGEEAHLEGKTAKSVKHSASGAIHCFNKFKQSDIIKKLICLPMLCHHSGLKNFGIDVDIQLNEEREILALSETTPHIPQEILDGIDLKQLGKSFKDHSLLIRMLFSALIDADRLDTERFMDPAKFKERYSKTIILQDLNIKLDKHLKNIQKQADTTKVNSIRKRILGEVQSKTNLKPGFYTLTVPTGGGKTLTSLSFALKHCITNKMDRVIYGVPYLSIIEQTTDVFKKILGEDSVLEHHSGIDISKEKENSINRLLTENWDHTLIVTTNVQLFESLFSSKTTKVRKLHNIINSVIILDEAQMIPPQFLQPIVKTLKELVEFYNVTIILCTATQPTLSSIKSIDLNFDGINTAIELAPEPEKLFQELKRVIIHKPEERKLSFIEIATKISNYDQVLTIVNRKSDSSGIFNQLTGNKYYLTTNLCAEHRRDILKKVKSHLSNGESVYLVSTQLIEAGVDIDFPIVFRAVAGLDSIAQAAGRCNREGKLVDENGQEKLGEVFLFHPQQDPPSGHLLQTKQASEDCIKNFEESIHPDTLKQYFNTLFWLKQDKGLDKEEIEKDKRSFQFETINKNFKLIDEDSRPVIVPYKEGKDLIVQLQNSVVQNNFVDYKLIRKSQRYTVNLKTNLYNKLLSEGIISEIKGIIGILNFDSYYHNDLGILESPNDQDLII

SEQ ID NO: 14523 - protein, 745 aa, Leptospira interrogans
MKRNKQSIFIGHILRKDDGNFVEHLLDDHLCSVAELTEKFCEKFGAGTFGYLIGLWHDLGKFKLEFQERIRIRSGHIGEEAHLEGKTAKSVKHSASGAIHCFNKFKQSDIIKKLICLPMLCHHSGLKNFGIDVDIQLNEEREILALSETTPHIPQEILDGIDLKQLGKSFKDHSLLIRMLFSALIDADRLDTERFMDPAKFKERYSKTIILQDLNIKLDKHLKNIQKQADTAKVNSIRKRILEEVQSKTNLKPGFYTLTVPTGGGKTLTSLSFALKHCITNKMDRVIYGVPYLSIIEQTTDVFKKILGEDSVLEHHSGIDISKEKENSINRLLTENWDHPLIVTTNVQLFESLFSSKTTKVRKLHNIINSVIILDEAQMIPPQFLQPIVKTLKEIVEFYNVTIILCTATQPTLSSIKSIDLNFDGINTAIELAPEPEKLFQELKRVIIHKSEERKLSFIEIATKISNYDQVLTIVNRKSDSSGIFNQLTGNKYYLTTNLCAEHRRDILKKVKSHLSNGESVYLVSTQLIEAGVDIDFPIVFRAVAGLDSIAQTVGRCNREGKLVDENGQEKLGEVFLFHPQQDPPSGHLLQTKQASEDCIKNFEELIHPDTLKQYFNTLFWLKQDKGLDKEEIEKDKRSFQFETINKNFKLIDKDSRPVIVPYKEGKDLIVQLQNSVVQNNFVDYKLIRKSQRYTVNLKTNLYNKLLSEGIISEIEGIIGILNFDSYYHNDLGILESPNDQDLII

SEQ ID NO: 14524 - protein, 932 aa, Leptospira santarosai
MEAEEKSYYKYWGKADQEGNYHLLVYHCLDVAAVGEVYLSQNETLCVHLSQKLGIDSPTFKNLFVFFLVLHDLGKFSDCFQSLIPNIKRILGNSNSPIGPYSVRHDSLGYIFWGEWILKDKRFGNYDGLLTEQNWLGWNGLRSSKEKSYFTEFLDVLIRCVTGHHGRPPSKNGYSGQTAVSPDSHFTEADRSAALAFCKEVNRIFSPNFEGDFKSLFDSTLPISFWLAGLSVLCDWIGSNSEIFKYHRTPIDLEEYYTTISLINAQKTVLKSGLSSAKIAFNENHFRIFEYLREPTPLQKFCSEVVLPDSPSLFILEDVTGSGKTEAALILTHRLMQKNAYSGFYVGLPTMATANGMYRRMSGVYRNLYTKESLPSLILAHGARNLSDSFQSSVISDNAILADRNYQSDKDPEESATAICNIWLSDNQKKSLLADAGVGTIDQALLSVLSAKFQSLRMFGLSRKVLILDEVHSYDPYMVELICCLLKAQAKIGASVILLSATLPKILRKRFSDSFALGLDTELQDIKSGEYPLVSLVSNRFEVEETPISTRKEVGRKLNVEFLFDQETVFQKILEMSNQGRCVCWIRNTVSEASQAFFFLHSKLGDRVILFHSRFAMGDRLNIESQILENFGVRSDQKSRKGKVVVATQVVEQSLDLDFDCIFTDLAPIDLILQRAGRLHRHSRDIFGNVKQGLDERGEPLLWIFSPEPIDDPTSNWFSQFSRGGGMVYSDHGKLWLTAKLLHERKGWKMPEDARNLIESVYGVDVKVPHSFLENRSKVENDRKKQESAAVLSTIRLELGYDSTSNETSWDDSKFSTRYGIGNSTKVVLAKFVSDRLVPWISGTSRDWQNSELPVPNYLVEKEFIFENSNISEVISDCKKNLPDKGKHCVLLPLFYANDFWRGKAFNKKNEVVSFTYDERFGFRKEQLRGIV

SEQ ID NO: 14525 - protein, 474 aa, Deinococcus wulumuqiensis
MDTADHLQNLFGQLPYPYQVRTAEALFSGKNVILRAPTGAGKTEAALGPFLLARQQRHGDFPLRCIIASPMRTLAKDLFERAQKAGEPLGLKVKLHTGEDPADPLLEADIIITTYDQLLSNSLHVPYSQSWRSRNIGAGGVVASYVVLDEFHLFDPQRAFRTTLEMARALEGVTPFLFMTATLSEDLTQKLAGAVGAEFITPTADELATMKSQQKTRQIRRVDALLSAEAVAMAHQRRSIAIANTVDRVQALYADLKGLKRDDTELVMLHSRYFPTHRNEHEIRLKALLGRESSANVILVASQAVEVGIDISSEQLHTELCPANALLQRAGRNARYAGEHGVVSVYALPEKDGKPDVMPYKGQDEVIQATWDALTDLPETVNPEAEAWLVDRVHTTGDEANWDAYERSRTSKLRSKMNQAFEGDRSARTDLIRDIQNVSLLLVRPNTDLSTWDEVNRLERLSVTSWRPDKLYER

SEQ ID NO: 14526 - protein, 487 aa, Deinococcus wulumuqiensis
MKNDLRRVIVAIPYTSIIDQNAKVYRDVLGDDAVLEHHSAVETKSRKAGPDQQAEDAERKQGSALRMQLASENWDMLLICTTFVQLFESLFARKTSKLRKLHRIARSVIVLDEVHTLPPELRAATLDVMRTLIDDYGVSVVLCTATQPAFETDELTAAFKNLSQTEIVPQYADHFRELTRVKYALHPEYPNPAAWNTLASEMKTEPQILTILNTRKDSLALIRELQSQNTEHLYHLSTLMCGAHRKKVLAEINARLDDKTEKRPVRLVSTQVVEAGVDLDFPVVYRALAPLDRIVQAAGRCNRNGNGEALGRVVIFQTLSGKAPKGPYQKGIEKARTLLETSQNIDHDMNGTEILRRYFSMLYGDVHPDELHIQPLRRELEFRKVAETYRLIRDDTVSIIVPYGDYLKALIQWQHFPSRKSWRALQPYVVSIYTHEARQLAKGGAIRELEEGVYLFEAVGQYDPLVGLPIDRDPADLIYIPDGGNVL

SEQ ID NO: 14527 - protein, 816 aa, Candidatus Caldatribacterium saccharofermentans
MAFFAHREGERLYRLSAHLSLVAAESYTSLARLPRCQNLLPLAATVGMAHDFGKYTSYFQDYLLSGEANPYKEHAFLSGLWAAYLVARQGAEPLEQLAAFMAVLWHHRDLDNLGRYLVSRREMEDISSLDPDKYRRLEVVEKQVEDLRRNMEKVGTSLISVARHLARRLARRGFAPPHFLTQDWRRCLEEFLDSWREVYLSLYRHWRKFERQEPSLSPYFNVVLLFSTLIDADKRHSARVREVKRLELPSDLICLYKERKFSRVGTQGINALREEIFRHAAERITCAPLSQRFFTLTAPTGSGKTLAVLNAALILRQRLKEAFGFSPRIIYALPFTSIIDQTYQVLYELMGETLPGFASAPSAYLLKHHHLAEISYRDLEDEDPRRFDEAMLLVESWQSEVVVTTFVQLLHTLIGYRNRMLKKFCRLGQAIIIMDEVQNIPAEYWPLVTEVLKKAAEELDLRLILMTATRPEWFEPQETLELAGDPEDVERYFRTLDRVRLLVEPGQYRVQEVAELFARRFDPSQSHLVVLNTIRSSVDFYHCLKELLPKGTPLYYLSTNIVPFERERRIEALRTALRRGEKPVLVSTQVVEAGVDLDFDVAWRDIGPVDAVVQVAGRCNRNFKKDRGNVYLFSLVDEQGHSLATRVYGAIHIKGAREFFSGRPEFPEAAFHSLVENFFSFVKARKDLSASDAILKAMKELRFKGDGGEKSVASFQLIRDLPNHVEVFVALDPKAEEVWETYQREVVNAPDCRSRWKAFYRIKRDFSRYILSVPAKLLVGKVDTSKSLPYIPSYLVGELYDPETGFKRVEEGVMVV

SEQ ID NO: 14528 - protein, 816 aa, Candidatus Caldatribacteirum californiense
MAFFAHRERERLYRLGAHLSLVAAESYTSLARLPRCQNLLPLAATVGLAHDFGKYTSYFQDYLLSGETNPYKEHAFLSGLWAAYLVARQGAEPLEQLAAFMAVLWHHRDLDNLDRYLVSRREMEDISSLDPDKYRRLEIVEKQVEDLRRNVEKVGTSLISVARHLARRLARRGFAPPPFLTQDWRRCLEEFLDSWREVYLSLYRHWRKFERQEPSLSPYFNVVLLFSALIDADKWHSARVREVKRPELPSDLICLYKERKFSGVGTQGINALREEIFRHAAERIACAPLSQRFFTLTAPTGSGKTLAVLNTALILRQRLKEAFGFSSRIIYALPFTSIIDQTYQVLYELMGETLPGFAAAPSAYLLKHHHLAEISYRDLEDEDPRRFDEAMLLVESWQSEVVVTTFVQLLHTLIGCRNRMLKKFCHLGRAIIIMDEVQNIPAEYWPLVTEVLKNAAEELDLRLILMTATRPEWFEPQEALELAGDPKDVERYFRTLDRVRLLVEPGQYRVQEAAELFAWRFDPSQSHLVVLNTIRSSVDFYHCLKELLPEGTPLYYLSTNIVPVERERRIEALRMALRRGEKPVLVSTQVVEAGVDLDFDVAWRDIGPVDAVVQVAGRCNRNFKKDRGNVYLFNLVDEQGHSLATRVYGAIHIKGAREFFSSRLEFPEAEFHSLVENFFSFIRARKDLSASDAILKAMKELRFKGDGGEKSVASFQLVKDLPNHVEVFVALDPKAEEVWETYQREVVNAPDRRSRWEAFYRIKRDFSRYILSVPAKLLVGKVDTSKSLPYIPSYLVGELYDPETGFKRVEEGVMVV

SEQ ID NO: 14529 - protein, 760 aa, Xanthomonas sp. SHU 199
MDFYAHSTERRDRGDWQGLAEHLNGVGERAADHAAAFGGQVMARVAGQLHDLGKYTRKFQARLRGDPAKVDHATWGARIACERYGQTGRLLAYGIAGHHTGLADGRRDELSSRPSLHERLSEDYLLRELPPLLADWEREVLLPARLELPTSLKIHPRLERRAFQMTVLARMIFSCLVDADFVDTDAFYRRIEGRGTRAEDIGERPTLEALRERLDRHLAGFPTEGGINPVRAAILREVRAKAHRRTGLFSLTVPTGGGKTLASLAFALDHAIAHGLRRVIYVIPFTSIVDQTAAVFRDALGAQGSDDVVLEHHSAFFDDPTKAPQAIEKRKLAMENWDAPIVVTTSVQFFESLFADRPSRCRKLHNIAGSVVILDEAQTLPPKLLRPCVALLDELARSYRVSPVLCTATQPALRQDQGFPGGFEDVQELVDAPERLYTRLRRVRVRHAGTLDDAALAERLRQREQVLCIVNNRRHARALFDAIVDQPGARHLTTLMHVRHRSVVLAQVRGDLKADRPCRLIATSLIEAGVDVDFPTVLRAEAGLDSVAQAAGRCNREGGRPAEASEVLVFAPVDWQPPQETKLFTEVFRDVERTHRDDLLALDAIHAYFQGLYRRLGDGSLDDKAILTLLRDALIDDLPFDTVAQKFKMIETAMRPVIVPYAPYAPDPDAEVSEVAEVLRQLEHADQVGVAGAARRLQPWLVQVPEQAYRALWQAHAIAPVAPDRYGEQFVRLCNPRLYDARFGLHWEDPQFLEAQGNVW

SEQ ID NO: 14530 - protein, 694 aa, Pseudomonas thermotolerans
MLVAELKRLLAADWPFISSVPQARLLAGLTSVSDWIGSGRFFEDPALPWRERIDEALDDAGFIPPDYRRHLSFDQVFGFAPRQAQQQLIDAVVSPGVYVLEAPMGLGKTEAALFAAYRLLEAGQACGIYFALPTQLTSNKIYERFNAFLERILAEGCRHRSRLLHGKAWLVDTDMGEEGRPGGAWFNHAKRGLLAPFAVGTIDQALMAAMNVKHGFVRAFGLAGKVVILDEVHTYDAYTGTLLNALVELLRELHCTVIILSATLNRERRQELLGAVVKEDAYPLISAAPSQQPASEWPVPAGEGREVSVRLLADPARALTEALERAHRGQQVLWIENTVAEAQERYLDLAARASELGIECGLLHSRFIADDRQRIEDRWVNLFGKGGWQERTQRGRILVGTQILEQSLDIDADFLVSRFAPTDMLLQRLGRLWRHAETPREPSARCEAWVLAPDLDQAIASPYSAFGSTAHVYSPYVLCRSLEVWQGRASLRLPQDIRQLIEQTYAQRQEEGPMAQWLHELDDGTRQRIGRKALSQLARLTLAEDGKTLPESKAQTRYSEQDTQEVVLLRAAVLKPDAKETHLTLLDGTQLQLPWGRHVLGRQAWRERSACLMRQTVPVRVQDAPEPLPIDTLKKFHFQHCFYLGDPAEDEAILRVALVDEVGVLNGLQGAPVHPKYRLEYREDLGYRVLKEHG

SEQ ID NO: 14531 - protein, 926 aa, Streptomyces sp. CNS615
MCHLLDSAAVFGALWDVLLSDRQRAELAAALELDLDDARRVLGFWAGLHDLGKISPPFQAQVPTAFAALRSTAAAYAFAPGAEKERSFRHEQATHWALTRLLSEVGYPGDFRRMRAAVSHQVAQMLGGHHGCYGTVLAAKEVTHATSYQTGLGGEGWTEQRAVHFAELRRVTGASAIPRRGLPAELSVPLTGLVVIADWLASQTEAILAVMPEPGWRGTPDEVDEHWERARKAAPALVVGSQLGRARFEAHRFEDMFPFPPNALQADLAKELPGLVNGAGLLLVTAPTGDGKTEAALYAASVLGRAAEARGMFFALPTMSTADAMYPRVAAFARDALVGDRALTLLHHMAWLAPGYSPGGPTDGETASPGELSADKATATEAGVWLRGRRRGLLAPLSVGSVDQALGAVLPLDFNALRLFGLSDKVFVVDEAHAYGPWMHRLLTRLLEWLGAFGAPVVLLSATLSGRTATSLIDAYRRGAGFFEPASVAPCYPGWVFTDASTGAVHAPRMVASGRERVLDVQLRPVSWDALADAASSVRGGGRREALREALTPVVSEGGTALVCCTTVAEAQQTFRDIRAAFPLLAAREGGLRLLHSRYPAHVRQQITAEAEAAYGKPRSADDTARPRLASVLVATQVVEQSLDLDFDLIVTDLAPLAQLLQRAGRARRHARGETGRPAWALPEEAPRLVVLEPVDEEGATSAPRTWGSVYDAGLLRRTAHLLRSRSGDGIAVPGDVQELVDAVYAEDFLEQLDDVSRRDELQRMDAERKANEAAEVHLATMTAICGPHDVGGNLHQLSRREAGVTEELLTTRLGADSGRVLCLYAQQDGSLTLDEGGMLAVPEAGRSALAAADVRNVMAHVAPVPGRWLRGGEGQPPPRGWDRIPVLRDLVLLRMQRTDGVSAVWACRHGGRTIRISDVGLETDG

SEQ ID NO: 14532 - protein, 800 aa, Marinimicrobia bacterium JGI 0000059-L03
MESELFQFRLFSHPDRLLKDHIQGVWEIARNKYDQQVTTSFPNFAPDVLRTILQVACLFHDFGKSTPWFQSYIKNLAGKYSAEERYLRRHGLISALMVFGILRNLFPHDLFLAALGFMIVRRHHGNLQSFQDFFTLTDEEFELCSKQIEKIDYQEYAQIVAPWEFDRYVQKDFISQVFIEIKSGSLKRFRPIRALKLNCDCYFAVNLLYSILLDADKTDAIFHSALDLQSPILESRHVDSFRQNLAQAKTTDINATRNHIFQSIDSSINRITNETIRIFSINTPTGSGKTIASLYASLKLREKFNLNHIIYCLPFTSIIDQNYEVFDNICKFAGIGHQEGVLLKHHHLAEIRYRKNSAEEEIEYQPEQALHLIEGWESRIIVTTFVQFIYSLITNDNASLRKFNRFSNAVIILDEVQSIPYAYWSLINKSLIKLTQLLNSYIILVTATMPLIFSEEQAEIIELIPEKQDIFKKSSRIKLDLTNLQSDNWDWASFCDYVKQTASHNSDKNIMVVVNTIRCARELYHYLNECDLHHRLIYLSSHVIPVERAKRIQIIKNKKSPKPLLVISTQLIEAGVDIDLEIVIRDFAPLDSIFQACGRCNREGLSKDPGIVKIISIKDAKGQKPAELIYDKFLLEKTMRVLAGKNLIDESDFYQLAQTYYSELSKSASQAKSQEIISAMETLAYEDTEGKPINAKMKLIDQDYDFSIFVEIDQTASQYWNEYTNLFLTEYNFAKKTTLKKIMRRLNDYIINAPRNCLRNLPEYGIYHLKNSLVAQYYHPVTGFNPDISLSEEHSTLFLG

SEQ ID NO: 14533 - protein, 737 aa, Actinopolyspora halophila
MYAHSVNINGDRHGFSEHARATAELAARFAEPFGYSELAYALGLFHDCGKARCAWQEKLLRVEGTDERVGVSHKDLGAHLLKPAAGIAAMAIDGHHGGLSDREVLKELDPEDGDLTDDPVKRFLEAVPEAKEILDLPVNSLVPPEWAGSRLLAELGMRMVFSALVDADHLDTSAHFDGLEAPRVSPDTDMSALRATFERARQQRIADSEDSPINRVREEVYRTAVSHAMGPTDIYGMPAPTGIGKTLTSAGFGLHHAAAHGKKRVIVAVPFTTVTAQNAAEYREMLGAENVLEHHSAVRMPEEGLQALKYRHAAENWDSPFIVTTTVQLFDSLFSRKPARMRKLHRLADSVIILDEVQALPLPVLTPILDALRTLSEHFGTTVLLTSATLPSFQSLDVWRDLEVPEIVDAPAELFERMRRVNYEWWLDPQPTLSEVADHAAEHEQALLVVNTTDDARRIYQHWEDSGIENIVHLSNRMCGAHLKTELDDVRTRLAAGDPVRVVSTQLIEAGVDIDSPVVYRAMAPADSLQQAAGRANREGKGAELGRVIVFDASDMSQPAGYRIGSDITRQYFGPQSDGSVIDPDNLEVLDRYYQVLYRRSNTENADRATAIQDNRSKLDFQAVAEGPLRPSPAGGQAREPSLAFRMLDDDTVPVVAIKYAPEAERHLNLLLSQPERSGQLLRELQPYVVSLPRRLLQDPGIRALCKPVLGDLHVWDHEYHPAYGIDTSNLIERTVL

SEQ ID NO: 14534 - protein, 638 aa, Methanocaldococcus villosus
MHDLKIDKDILKKQFNALDIQYINDILEENNFPIIDTTFDNILDEFYKLEDIAYNLMYEKAELRYEFYFLYLYLFSLLISSDKEDAIFRGKEIITNSKIPNGIEEYIKKIPKKNEIDYLRTKMFFEVDKKVSKIDLNHKIYSLNAPTGMGKTLAVFNFALKLANRVKNEKGIEMRIIYCLPFLSIIDQNYKVLYDVLRKIFGKDVSSDVLLKHHHLSEIYYKLDENVFEEEKFLHLIETWNSKIIITTFMQLFYTIFTNKNKNLKKFQALSNSIIILDEIQAIPYEYWYAINKLFKFLAEEYNIYFILCTATLPMIFDNNIEILDNKEEYFKKINRTKIKVHKNEMNLKEFIDLVAEDIEKNPDNDYLIVLNTIRSSKEVYSALKELVDGDFYYLSTSIYPKERLRRIESINKNKNRKIIVSTQLIEAGVDISVDIIYRDIAPLDCINQTAGRCNRHNEGKKGIVNVVKLVDENGRRFADYIYERHLITKTEELLNEFEIIDEKMFLNLNNKYFKKLSDYKDKSKDILKVIEKFEYEKVEKEFKLIENIPSIDLFVCIEDEAEKIWEEFERINKIKDAFERRREFLKIKREFYSYVISVPEYRIKGKDILFENLSKINEKYYDKETGFKIIEDKTIIL

SEQ ID NO: 14535 - protein, 568 aa, crenarchaeote SCGC AAA261-N13
MQGSIKEAFNVTYDKFLEEEEKGERPFLNYVIDELDKQRNNYNVFLIEAPTGYGKTLISATIAYWNLIYGIKSIIAYPLITIIEQHYKKFRNFLSKITNKEILGLRHMLNNQSVYLIKPVTLTTIDTLSLTFFGIPPEEIEKITKEGTSYGSLGHYFVAWASIFFSDIVLDEVHLVADSTKSINFMLTLAKVASMYDQKLFLLSATVPESLKKLISNHSKTLIIEFSEEKDKGNKGYSEFLNERRNKKYTTNIKGFQQEDKFKEIKKLIEEKSYPRKLIIFNKRDEAIGFYNYLNDDKAIILHSHFTHIDKKEKIEKIEEAEKKGEFLIISTQSIEAGVSVSSNFLLTDIAPLNSLIQRMGRFLRGTGKHEKEGEIYIWYDKDLINDGNRYYKVYNKNLTYETLKILKNTNQQINFHDPTNYKPIIDKIYENYYNIDEKLTDNFINVFLNLELAPKEAVKLFFNMEGSFVRDSVLIPITWKEKINKFEEDVIAINIHEFIELLKKGMIKKVIIGDKLKDLSEVKMDTIRIDEEKLGKNIRYILIKIFRNNIDAFYANINYDPKKGLII

SEQ ID NO: 14536 - protein, 621 aa, euryarchaeote SCGC AAA261-G15
MKIDRITLTTEKQYIKRDFQSKIEQFLLEGRSNKRVLIVDAPTGAGKTHTFKRLDNSEGVTFLVLPNNYLIEEKYEEFLSSGLIRSSYLKKLSREDITHTIEEEGFGKDNDPLAILTAINYIISNSKLIITNPSIIFLILYNHYWERYYVKGSHLSNLITKGLVNIIFDEIHIYDKDQRNRIIALNSLLYENVKFGYTSATIPSDLIKTLFQVFGEERVEYIKVTTTEPGESSNLLRGPIKLDIFNSEIFQLNDELLKELKYGNWIIILNKIVTINKFYKFLLEHNFPNSDILLVSGYHSKSRETLNLFKEGKARIMIASNIIEQGINPPKNYTNFIIEPGYYNYNLVQRIGRVGRGIEEESHVFMPIPDKVIPRNIENLKDLNVVIDSLASLLGKGDESPIDFKSLGYYIGNFISNFDEDHRNKFKEVIGKLNGSNEIIKAIDSFDEIDRIIEGKKMDKCITMTPEKIKNIYNWWNSYNLTFKNFIKSESIIELIDESLKDKNNLGFFSTYNEIWVLINKEIIRKENGKLVVGEDREDPFKEFYVTLINVPFEEYGPRLFKEIEWKEREIIINNLKGYRDILFSCPTTRSIYKKLEEYLYATGWIDRIIYKVYEGQHNGN

SEQ ID NO: 14537 - protein, 541 aa, Sulfurovum sp. SCGC AAA036-F05
VEVKENLRNSLDKNLFYIEAPTGAGKTNISVMSAIEILQKDKSINKIFYVFPFTTLITQTYDSVKNILNLDNSQIIQLHSKAKYNDKKEIKNDGVYGDEKNNFLDNQFMNYPITLLSHVKFFDILTGVSKDDNYIFHRLANSIVIIDEIQTYSPDLWSKIVYMLDSFANKFNMKFIVMSATLPKIGDIIDSEFIFLVENKHQYFQNPNFAGRVSIDTKTINLKEPKDIYKRVLKESKVYQKKKGKVKTIIEFITKKGADKFYQEAVTKNKSFFDEIFILSGTILEPRRKEIISFLKDKQDKNVLLVTTQVVEAGVDIDMDIGFKERSLLDSDEQLAGRINRNSSKEDNKLFLFEMENPKAKYVYKGDKRLDIKDDEVLESKDFDTYYNEVIKKIIFNNETTYIENLQTYIDNIKNLRFQEAHIKIIDIESISVYVPLNLMAKLYFNAYKYIIQNNEMDFTNKKIKLKKLASKLSRYTFSLAKYQGSGVEKLEPYCSEEYGYLVIESEHIAIDADFDGHIIYTYKNGLDTSVLKGENVGMFI

SEQ ID NO: 14538 - protein, 744 aa, Desulfurispora thermophila
MSYLAKSDQTYAEHLEQAYRAWRETMAAKKRLVERYCRRYGVPEPRFWQSSLLAVLLHDLGKMTDRFQAMMQAVRRGEKFDRRQYYRHELFSFVFTILAARELAQKEGWLLQVPVEALAVAGHHRPLDTDLTSFEREKQAPIPSFIMGALQEALQQAREIMAREGWELPHIDEGAAREKPYPGLARLVNNVLGQLVARDGREKVRDFYILIKGILHYADWYASGGAAVRYAVESAPEQLAVALQERCREKGIAFQGWRPFQASMGRYSGHLLAVAPTGSGKTEGALLWALHNARQMGGAKIIYLLPTMNTANQIWQRLCDIFGVANVGLTHSTASLFLQEEESDLAETWKNRWEYLLHQAFMKPVTVATVDQWLSCGFNAGRWVLKEINAANAVIVLDEVHAYDGWTMGLLVASLRHFAARGSRFLLMSATLPRGLVELFQAALGEPGLLRDEELLNASRSVYQVVDAPMESALPDIQAAVRAGRRVLVVVNTVEKCQQLTRELAPYRPVCYHSRFILRDRKRIEESFDRSNLVIATQVVEVGLDIDFDWLFTECAPPDAIVQRAGRVNRYRHPNRDSRVFIYRASPGGEKIYNPLENPDLLAKTLSVFQARAGRLNEQQLIEIVETVYDGYRVEESEPFREAQEVYQLAQKNRMGIFDSRWEEDREVTRLAKYQTVAVIPWCFYDLVLELPPAERRWYEVKVPLWYFREHRRAAGSGLMFCDLDYDPALGAILRPAQDRDNFM

SEQ ID NO: 14539 - protein, 733 aa, Porphyromonas bennonis
MSRLARELIYEHEDSCGLKDLAYNAGLLHDFGKYRPDFQRYILAVSGANPSGKVPPKTPHAIVGAIEARRLFDDPMIADTLAYCISGHHPGLYDHNEMERRLRHGEYKRWCDACEKLTSVEDLGTTDCDDVGEPYDLQMAIRMLFSALVDADRLDTEQFMTPDLSAERLRKKGNYASLCTLRERLRAKTESFRSAPDTPVNRARAYFLESCRTHGAESDPGIYTLSLPTGAGKTISSMAWALEMAIRNHHDRIIYVIPYTSIITQTAMVFREIFGKENILEHHSEVVVEQQTEGDSGDDQMSRLKFLTENWDAPIILTTNVQFFESLFASKPAKCRKVHSIANSVIVMDEVQALPEGFLSPILSAIDTLSEAFHCSILCCSATQPVYDEDLNSPDDGSDYYTPLDTRGDLVPREAKYFVPFDRVDYHLEPQTVTSQELADRLAAEHSVLCVVNSRKDAGQVYRALRDLPKVKADEVIHLSRSMCSAHLRKAIETIKERMRDGEPTKVISTQLIEAGVDLDFPCVWRAHSGLGSIIQAGGRCNREGKMERRGQVFVFSLADGSRPFGNIARGCNATNDLLSELSDKKTSPTDPEVIAEYYRRYFGRITSFDTQSIAQDLTEDPEDINFESAAERFKLIDDEGTFPVIVPYMEEGKALVRKIRNHEILTRKDYHRMQEYSVSLRQGDYSTLLSHGNIEQIPWGEDFISVLVDDECYDSVAGVVISNHWVEETQTA

SEQ ID NO: 14540 - protein, 891 aa, Corynebacterium propinquum
MSTQSGDTIWAKRHGLDSSYPLIRHLLDTAAIAEQLFYHWLRPGLQEQITQALGAEAPRIVAAIAGIHDIGKANPLFQGQLAQSGEVWQAVRDQIAREENVDFPPAARSNRWAKLAALRRHEQVSALSLSDIRLDELTTGEAWHILPALGHHGFFRLPLSNSRDRRLDSATVDDCLNFPGWKEKREEISAQFYDALGIDHGTLPEQAPVTVGLLLSGLTVLADRLASHTNWVQRSQADLQQSTIPANDYAGWFAAQKSHAPAHNKQFLGIYEGWPSQEAAQDAILGPGREPYEVQRLTRDNDAGLVAVMSATGSGKTEAALLRHARRHERLLFLLPTQATTNALMRRVQKAYSSTSNVASLAHSLASIEDFYTTPVTSFDDSTDHAEPSMQQNEGLFPSSFVRSGISRLLASVSVATVDQCLKAGLPIKWLHLVLLALANSHIVIDEVHTLDHYQMKLLGPVLEWMGATNSRVTLLTATMPRWQLREAYRAYTGTDFTDDFGFPAIASSALPASSAPPRSKSVQSFSSPASKTLLEVETSTANSTVSAHVSWAQHQRQAHPDARIGIICNQVAWAQEVARELAADGHKVILLHSAMTAEHRRINAERLTSSCGPNGDGKGLTVVGTQAIEASLDIDLDMLSTDLCPASSLLQRLGRLWRHADDHRWSRIPKAPHKMVRIVAMDFAKGGALPYYEAEMEKTMHWLSNHKEICFPDDCQPFVEAATVSMKDLERADATAAEYEQNAAHLLQRSKGKQRSYSMSQLLDPEQWLDELSRELRAEEGMLSPDADELRTRDIEEESVQVIIGSSDSQLPGAWPGTPEELLSVDGSDKTAIRQAMKGSMPIRARKFAQISEHSTSLAGAKTILSRYVFVPADGLYDAFLGFIGPQPEA

SEQ ID NO: 14541 - protein, 752 aa, Effusibacillus pohliae
MFYAKSHPGETIKEHSAQLLDGLNLLQKTYGHKITNDDTFWKLLKTAVLFHDIGKANVLFQNKIRKFRGEEPLPCCLSPRDEIPHNYVSVALIPYKQLSFTKDEWRLLVAAIGYHHERNVLPNSRDIQEYVKQTVSKETIQALFEDMELPYQPEEASERLLDWLEKDRKSKYAAALHGNPEFFKKHVLLKGLLHRLDHAASAHVDVETGAEENAGEKTRRFLSRFELRPAQHFAIQHADRNVIMVASTGIGKTESALLWIGEQKAFITLPLRVSLNAMYDRLSDRDKIGLQHVGLLHSSSFDYLSEKAEIDGEETYEVSRQLSQKVTLTTIDQVLKFPFLYKGFEKELATFAYSKLVIDEIQAYDPNIAAMLVKALEMIVKIGGKFMVMTATLPKLYLETLCSRGIIPEDQWVHASFPNDDLKRHRIHTYSSEILDVTDSIIQKGKNKKILVICNTVDQAIRVYKQLQTECERTGEQIPVWLLHARFIKKHKSMLEQRVTQFAGSGWHQTDGEVETGIWVTTQIVEASLDVDFDELYTEMCPLDSLFQRMGRCYRIRPYSEEEPNVHIFTWNPSGMGTVYDAKLVEMSQESIQPFQDHILLESEKMKLVELLYSRKSLRGTSFLQKFDDAIRLFDNQLFFETKSQEAQEMLRNIRTLEVIPWKFRNEVEEWVHRLERETDKKRRRKWRQEIEKMSVSLNEKTLNYRNVALIPLETIGLEYLSWIMDSDAKYEFDEQTLQGSGLVYKRGTDIM

SEQ ID NO: 14542 - protein, 808 aa, Methanothermococcus thermolithotrophicus
MDTSIGKLCLKEGDKYFQTLNGHTIDAIKILKQYIETNKFEVEEFCDRWDMDKSELYRNLFLMVYLHDIGKLTKDFQRNIKNNKRSNKFPHSFYAMGILDKVNVNDFVKLTILGHHSQLYGGLYNDYQIIKKTEYLIDNINKFLTNSYNVYNCLNFNEYFEFDGFNTIDIDKKAKPKKIWNALNDGLKSEYSEINLLNNRKEDIVKIKSIYCFMLSILKTADIYSSYNFERYILENNLKYDLFNDVLTNPEHYIPKLKKEYIPNFELYKYQNEIKHKAKKFQILFAPCGRGKTEASLLWAFEIMKKYNKNKIIFALPTQTTSNFMFDRLKKEFGKENVGIYHGMSFIKLKNDENNKKFDDFDNMDLDDEYEDYGAKLIKKVGDENFKGEIFHKPITITTIDHLIYSFIHGYKKSDFALGNIQNAVIIFDEVHYYEKTTLSHLYGLFDILKEMDIPHLLMSGTIPNFLNEKVNYDTIVDVEGLDYRPFRMFLNEYEIFDEKVFDSIINNYINGKTQFIILNTVSKSKKFYKILMDKLEDYGINPNVILYHSQFTHNDRNRKEKEIKEKYGNKNKKPFILVATQVIEISLDISADLMYSEVAPIDAIGQRGGRLNRKGRTPDGILNIYVPEKNVPYDKELMKNAEGILKKYDNNAISYGDIKKMCDELYKHYNLSGSNLKRFFNISTLFGYSHRDIRYSEDEGKFFKVRESKSLKIDVIPNSVYNNEENNLNVENIVKYPYYKYKNEAENGELIHFDIVYKKDKLYVICLHEYTYEFGFNDDIEMDEEFIDDDEFLGNLKNNNIVDNDIL

SEQ ID NO: 14543 - protein, 786 aa, Methanothermococcus thermolithotrophicus
MELISHPNPDYPLKKHLINTKNRALSKYNPPKLKYFNNVIIKDILKIICLSHDFGKTTTYFQKYIRNEKIEKKILKRHSEISFILANYIIKSYLVAKEVNNKYYQIFSLCVKNHHTSLSELIHDASIYDENILKKQFESLDFNFINGILGENNIPKLNCNFEELISEVEELEYLCDELKYETNDEMKTEMYYLYQYLFSLLISSDKEDAIFRQTSNNYPANSDTPLRISKTDGFSKIPTDIIDYIENKPKIKPIDHLRTEIFYKISNKVHNLDLNQKIYTLNAPTGIGKTLTIFNFALKLSNRIKTEKNIDMKIIYCLPFLSIIDQNYKVLNEVLKNPPSNILLKHHHLSDVVYRHEENGEENILDGDKSLHLIETWSSKIITTTFMQLFYSIFSNKNSDLKKFSSLSNSIIILDEIQSIPHKYWHLVNKIFKFLAGEYNIYFILTTATLPMIFDKNEYVELLDDKEHYFLNLNRIKMKIHNEPMDLTEFVDVLDEDINNNPDKDFLIVLNTIKSSKEVYDLLKEYSYENTEYYYLSANIYPKERLNRIEKINKNNKNNNRKIIVSTQLIEAGVDISVDIVYRDIAPLDSINQTAGRCNRHGEGTEKGSINIVKLINDNGHPFSRYIYNGALISKTEELLKNYDEIEEREFLNLSNCYFNKLKGYDDSSRELLETIKKFEYDKVPKNFKLIDEILQINLFVNVEDKSKEVYDEYERIKSINDPFKRKGEFLKIKKDFYQYIISVPKHAIKGKDTLIDENKNINVIDETYYDVETGFKVVEDNMLIL

SEQ ID NO: 14544 - protein, 909 aa, Microbacterium
MSTARTPFWGKTYRDDTGKAHAYDLRKHLLDTTGAAGAAWDQWLRPGLRDMLTEAFAPGDPTTARAIVMAVAGLHDIGKANPIFQSQSSSTRDLPIALRDIVRDLTADGLSMATPAGTAADEKTAARHEAVSHAVLTEFPAEATEKVGDRWSGAVVGGHHGRYHPGLAGDCSHTRDALAALTADPEWAARREEIITLVTGAVGLTADDLRFRLHAHEGAAVILLTGFTVVADWLASDALGLVATRPGEEAFPTVRAAAAYVRKAERAYRRTLPSTIGVYRAPANPRVAVMGTSTLPLYPLQDAATKTGRGLWIVAETTGSGKTESAMLRHMCEPGESVIWGLPTRATADKMWNRIQWMYRRTRNVGALMHAHRSLNGFYLAKNTDGPGLRYSPWATEVLGNVKPLLSPVAVGTVDQVLLGALRQKWTPVRLLAIANAHIILDEVHLMDEYGTKLAEELLAWWGLTDTRVTMLSASLPKALVQRYADAYAGDLVELEPAYPAHTLVSGGGEATVTEMETAREYDLDIDLRTFHYRQGERPDTTMASRTVELVLEARTENPTARIAVIMNRVGTVQNIADDLLHAGLPDVTTMHSRMSAAHRTALSADLEQVAGKGSRVEGCVVVGTQVIEASLDLDFDIIISELAPAAALIQRAGRQWRHSRVTAGEWGTHWHRRPTQKPKLTVISLLEPDEHSTGRPSEAMALPYSYGSLSRTFRALKAMQGTLAIPAGVQAFVDAAHYDPDDDAEEATTDELIAASIRRSAADEVTIRAADRQGPFHGPLTYGKLGRLTHPDELTESATRYTDYAQVPVLIVDQFSNGSWAWRGNLDDETVARHLASRAPRDVAVMLGLTVQVPLDKVGPGLPLIPLIEINKRFDRDESPFAASELRGVVPVRLAAGTHYDGRLGLRV

SEQ ID NO: 14545 - protein, 570 aa, Thaumarchaeota
MLREYYHRALHALGYKTERKFISEAIERIEASWGEKNLFVIEAPTGYGKTTITASLALMTCEEAGKLIVAYPLRTLLEDQYSKLRNVVNDLRLGKRYMHEESSPYLIKPITLTTVDTLSLTMFGLAPEDLNVVVRGWEEDRFVNTSRGHYLFSWSSVMMSDIVLDEVHLVAEESKSLTFLVAMLEHIISHDQRVVFMTATMPTRFKELILGSLRRFRDRVEWMEFRSTAVDDEYIATCLEKRPEIRIQQLSSDTKFDVIKSWLDDALERGFSRVLVVFNTVGEAVSFYRTLDGYENRLLIHSRFTESDKLAKHERLQRLKSEGKYIVVATQVVEAGLDLSSNALITDLAPMCSIIQRFGRLLRYEGEREGVAYVWYESDLGRDRQLYKVYDRGLSAATLDALREAERGNVSLHVPSGERGYKRLLDKVYQDADLRINYREIEEMLSVFTNLDDISKAVDLFFKMEGSFVRESALVPVRCPEMKEEVSVEMRVFERLLKEGLVKGHIVRNGEEEICELPDWLSIGSKIQQRSLARKVIKHIHTAGVKAFIVEGSYNSEYGLEIEEALREHV

SEQ ID NO: 14546 - protein, 798 aa, Crenarchaeota
MTLNSIYLELCNERAWKPRYFIEETLNKLENLLKENKRFVLIARLPTGYGKTTITNVLARAALKNNPYFCRVIHVLPMRSIADDVCLELQKDKMISNHVAVQHLLTPGSPYFAKKCIVTTLDTFLLNFFKIPTPELKKVFQYDTAHSEFPRAMIYLSIVIFDEFHLFAGLGDISNEGKALTSVIASMICLLKAKVPIIIMGATIPDVLIDKIREEISIVGGEVESVNYVFDKDLEFDEKLRKKKKRIHIEEKDVMEILNNIDSSKSVLIVVNTVKKAKEIYNSITNKEEVGFLHGKIPEAIRAEIIKKIKNSKPRILIATQVIEAGVNISYDILITEPCPIDRLIQRAGRVCRFDEEEGDIYISKFEKDYIYDENFVKTTLEVLNPNKGIERKESNVLTFEFANQAINEVYKIPIKELKEIDYDMKGFLQELDALPILTSKYAKELIIRYKGFTENFGIVSCFNEKYLNKLYAIPVSEKEGWELIKKHGKLIDANYRLIDFKAKLREVESLSIYLLDKGYQGIAIPEEEYIEIIGFRPKIDIKTSASASKNISSSPSHHEISKPCAFIGQSLIKHTENTLEKALKMKYSFETMSKRFEALGININAERLEKLIKAACILHDLGKAADEYQEDFYNSCECKGKVSFYLHEVASAYYAYKKLKSIEDYELDTKERQLITLAILFHIAGKNLYDLKDGVKEKKMKWTFNKYWKSFEHLLNKHRIKVDYKSSSINTEEAMNFLEEIEEIIRKRESYYLKLYNLIYSAICVGDNLDSYEFRRTDISESRKIFIEELKEVIANA

SEQ ID NO: 14547 - protein, 836 aa, Atribacteria
MSLLNNLYSHPDKLLVDHLQKVGDLCRQNLFLKKLNLDGYIDFNILKDISYLIGVSHDFGKATTYFQEYLKEKDEFKKIKMKNKAEVYHSFISALFTYYVVKKYLLTKNLLTEKYYQYLPVISFLVVKRHHGNLDDALDEVILDSKDDKVLEKQVNAIDFKIINNIYNQLFSKINFKFDYNFFRDNILNAMPIYIYNEIDRYEKNYIRDLSHQEKKLINNLDEENTLFYYFTTLLLYSLLLDADKTDAANLQKVNRIKIYKNIVDDYKLHSFKDSDKKKKEINKIRNEIYDETINSLDSLNLEKDKILSLNVPTGTGKTLTSLSFALKLKAKIEQEKKYKPRIIYSLPYLSIIDQNFAILEDVFKFPLKGKTPNSNLLLKHHHLSDINYTTSNTGKEEFENLSPKDIGKDLLLIEGWNSEVIVTTFFQFFYSLISNRNKSIRKFHNIVNSIVILDEIQAIPHHYWFLLNKIVNFLAEGFNIYFILVTATQPLLFNEKNKEIKPLIKNKEKYFKALNRVDLKYNSKPLCLNDFQEILEEDLYHNLNKDFLIVLNTINSSLEIYNFVCQLELEDTEIYYLSTNIIPQERLRRIKKSREKSKKRKIIISTQLIEAGVDLDVDIVYRDFAPLDSINQVAGRCNRNFSQSKGLIKLFILKAEEEKKEYYRYIYDNFIISKTKDVLDKLRKKQIEEKDFLSLNNLYFDKVNQGKADDEAKKILEEVKKLNFGELSKFKLIKDNYKKIDIFVETDAKGKEIYKKYKELSLIKDLFERKNEFLKIKKSFYDYVISVPYNYATDFVTENKAIGHISLEEIKQNNYYDQETGFKRKAESGGGTLIY

SEQ ID NO: 14548 - protein, 724 aa, Salinispora vitiensis
MAREFSAPFGGGEVAYWLGALHDVGKASCTWQDRLAVVASTGGRVGIDHKSFGTRIAYERGLAGFASAIFGHHGGLIDTPNLRDKYRSRLAEAPGNAASAELELPGLLPDLPERLDHLVPVPWRDLLVGEMALRLCYSALVDADSLDTSAHFQGLSGPRVRPGADFEHLYKVFEQRRGDELAGRGGTPVGSLRERVYADCLAAAERERGVFRLGAPTGAGKTIASGGFALRHAEKHGLRRVIVAVPFLTITEQNAAVYRRLLDQDGADPVVLEHHSQVDLDAPGAGRWARLAAENWDAPFVVTTFVRLFESLFARKASAMRRVHRLANSVIVLDEVQALPHAMLAPILDGLRLLVRHFGVTVLLSSATQPSFWALDEFKDVPCTDLIHDTSKLVSDLRRVRYEWQLDPKPALAGIADQAASEQAALVVVNTTADAKTVHDRWREAGAHSGAWHLSTRMCPDHRRRVLETVRARLCRRERVLLVATQLIEAGVDIDFPVVFRAMAPADSLLQAAGRANREGRMTDGGRVVVFAPADGGQPPTYKTLVGCTGRQFGPEKADPDDLMALERYYRNVYELLNLQDDQHVGQLIQQARRRWEFETVSDGPINASDKRRDRTLAFRMISDDGISVVTPQGAETPELRRELQQLIEELRQAPVPGLTKLRRLQAYTTNLHPSALHQPGVTALLRPILGGNEVRKGVLVEWVGEYDDATGITLDPRLEQFVL

SEQ ID NO: 14549 - protein, 796 aa, Salinispora pacifica
MGYPQLVRRVSERLAYRVAQIVGGHHGRFQQTSGPHGGRAQLGKGGWSKQRAALVRVVHEAVGSPERPPAIGAAASVLVTGVVILADWLASQEHFLRLQSSRVPQYTGAEAVSTHLAALSAPAAALLDDAGLGSPSFRAVGFDDLFPHRPNALQRSIIEELLPVVDSPGLLVVTAAMGDGKTEAALVAAKRLAEVCGAHGFFFALPTMATSDEMYRRVRAFAARLAAGPAPVTLLHSMSWLNAEYEARAVVDPGGAAEVVSDEPSGDVVAPEWLRGPKRGLLAPMAVGTVDQALLAVLTTKHNALRLLALSGKVFVVDEAHAYDDFTTSLLCRLLNWLGAYGCPVVLLSATLPSSQAATLVGAYEEGAGVGPTNTSVPYPGWTFVPAIQGRPTVSISPTMREALVSGRTVEFTLDVRPVRHLVGSESDPADRRAVVRQVLAPVVEQGGCAAVVCNTVNDAQQTYRVVRDWASEGVDVVLLHSRFPARCREEITTQIIGRLGKDGNRPRSMIVVATQVLEQSLDLDFDLLVTDLAPMAQLLQRAGRCHRHRRTRPPWAAQPRVVVLDPRGPDGVEHVRPAAWGDVYARYLLRATHLRLIGVDMFAVPRAVQGHVEAVYVPQEIHNDPVMSAEHNEYRAQAMAVRGMAELGVNPEPAGLADLVALSQTETPEWRASTRLGAESERVLCCYHDSDGMQWLDPKGRIPLPQRGSGRDGRFRSEEVRAILQETIPLRADILTGYEPPAALPASWGNNAWLKRIRPLWLPILPMGPGPAAWAHRSVHLDPELGLVVGTAGAE

SEQ ID NO: 14550 - protein, 812 aa, Salinispora pacifica
MDQVLDRVLAKSARLGRPAELLIEHLDATLGAAVDLRRRIGPIAVTEPVLGERFWPVSLLAALTHDAGKVPAGFQAMVTGGGPWGERHEALSLGFLPPLVPDGGLLLWVAEAVVTHHRPLTSPTGAGLRSIMTLYGGCTLTDFRERFGPVDPAVAAALERWLIHAGGHLLAADRADDTVIGPDVVARAHQVLTDVLGRWRRRRATADEGLTAILLQGAVTLADHLSSAHSTLHVTQPIGPGFSKRLRQRFSENGRRPYPHQEQSGALRGHLLLRAPTGSGKTEAGLFWAARQVTDLIAAGAGAPRVFLVLPYLASINAMADRLVGVLGDRELVGVAHSRAASYHLATAIDEAASADPDTPGPDGALPLYAARKAVARRAATELFRETVRVGTPYQLLRAALAGPAHAGILLDSANSVFVLDELHAYDPKRLGFILAGAGIWVRLGGRVAVMSATLPAVLADLVRDAIGDPVELVTAPAGLTLPRHRLRLRPHHLTDDEALREARAHLTAGRSVLMVANNVADAQTVFDTLAADAIAAHGPDGALLLHSRFRRMDRTRVERKIIDRYGAHRTHSGRRFPGLVVATQVVEVSLDVDFDLLFTSGAPLEALLQRFGRVNRAGAREPADVVVHEPSFGPRRGEGRQVDYADGVYDSEPTRAAMWILHQHADLAVDEEHATKWLDEIYASTWGQEWRHQVDTARVDFQQAFLTFKRPYDDRSHLADAFDSMFDGTEAVLLEDLPEYEAALTSATGRAEGRLLAADWLIPLPGWAVGLSRLDRSLGVEIIDGDYRPDRGLTAIRGTVGANRYQPGEVI

SEQ ID NO: 14551 - protein, 544 aa, Methyloversatilis universalis
MRDSLNAYLSCFSVDTEVNQVRARILSHVRSEAALDPGLFSLTVPTGGGKTLASLAFALDHALHHGLRRVIFVIPFTSIVEQNAAVFRRALGELGDAAVLEHHSAFVMPEPSRADAERYQAQAKLKLAMENWDAPIIVTTAVQFFESLFAARPSQCRKLHNIAGSVVILDEAQTLPLKLLRPAVAAIDELARNYRSSVVLCTATQPALKAPEFVGGLEHVRELAPEPHDLFRALERVRVRHVGELADEALAAQMRAHDQVLCIVNNRRHARAVFKDMADLPGARHLTTLMCARHRSQVLANVREDLRSERPCRLVSTSLIEAGVDVDFPLVLRAEAGLDSIAQAAGRCNREGLRDLAASEVRVFSNTNADWAPPPELKQFAQAAATVLRQHSEDPLCPAAIEAYFRELYWRKGESALDGGDLMGLLRRSRLDSLPLETLATRFRMIDSVQMPVIVPYDDTAREALRGLRFAEKSGSIARRLQPYLVQLPRQGFEALLKSGAIQPVSPERWGEQFMELTVMDLYDPQFGLSWDDPAFIKAESLCW

SEQ ID NO: 14552 - protein, 810 aa, Salinispora mooreana
MDQVLDRVLAKSARLGRPAELLIEHLDATLGAAVDLRRRIGPIAVIEPILGERFWPVSLLAALTHDAGKVPAGFQAMVTGGGPWGERHEVLSLGFLPPLVPDGGLLLWVAEAVVTHHRPLTSPTGAGLRSIMTLYGGCTLTDFRERFGPVDPAVAAALERWLIHAGGHLLAADRADDTVTGPDVVARAHQVLTDVLGRWRRRRATADEGLTAILLQGAVTLADHLSSAPSTLHVTQPIGPGFSKRLRQRFSENGRRPYPHQEQSGALRGHLLLRAPTGSGKTEAGLFWAARQVTDLIAAGAGAPRVFLVLPYLASINAMADRLVGVLGDRELVGVAHSRAASYHLATAIDEAASVDTPGPDGALPLYAARKAVARRAATELFRETVRVGTPYQLLRAALAGPAHAGILLDSANSVFVFDELHAYDPKRLGFILAGAGIWVRLGGRVAVMSATLPAVLADLVRDAIGDPVELVTAPAGLTLPRHRLRLRPHHLTDDEALREARAHLTAGRSVLMVANNVADAQTAFDALADDAIAAHGPDGAILLHSRFRRMDRTRVERKIIDRYGAHRTHSGRRFPGLVVATQVVEVSLDVDFDLLFTSGAPLEALLQRFGRVNRAGAREPADVVVHEPSFGPRRGEGRQVDYADGVYDSEPTHAAMRILHQHADLAVDEEHATKWLDEIYASTWGQEWRHQVDTARVDFQQAFLTFKRPYDDRSHLADAFDSMFDGTEAVLLEDLPEYEAALTSTTRRAEGRLLAADWLIPLPGWAVGLSRLDRSLGVEIIDGDYRPDRGLTAIRGTVGANRYQPGEVI

SEQ ID NO: 14553 - protein, 752 aa, Salinispora mooreana
MWAHSKNHFGVRHRLEDHLRGTADLARLFASPFGLGELAWWTGLVHDGGKCWQAWQDKLLLVEPTNGRVGLDHKSFGVQLARRHRLRPVEFAVAGHHGGLTNQGQVDALFGEDAAAEERLRSGPWAEVEKILRVALPEMFAQIPVMPVELDDSAEPMTREFLLRFLFSCLVDADVLDTKAHVEGSRPRVGPDLDAPALLSRFLARRAKYLRLRAPGAMDGHRQRLFAAAIAAAEREPGIFRLTAPTGTAKTIAAAGFALKHAALHGKRRVIVAVPFITITEQNAAVYRDLLDPEDPHAERVVLEHHSHVEINDSDSSGQYHSWRRLASENWDAPFIVTTTVQLFESLFGRTQSRMRKLHRIADSVLVLDEVQALPHDLLPQIADALRILTQRFGVTVVLSSATQPAVHALDPLKALESREILPDPESFFAECQRVKYDWRLKPKPSLVDMVNEAATHRQALMVVNTVRDARTAFRHAQNVASDEMAVLHLSTGMCPAHRKSALRAVQRILADGKSVLLISTSLIEAGVDLNFPVAFRAIGPPESLAQVAGRCNREGDLGQRGGLVIIFDPADGGLPPSYPTQIEVAHMYFGPDSDPENQAALDEYFRELYGTLDIEGPGSTSKAIRASRSRWDFVAVADGPLKATGSTQRRRELAFRMINEDTVPVVVRYGGDHSGAKIIDRCLQALRGPYPDMRMLRDLQPYIVNLRRSTARAADVSPHLLPVIGDLCEWYGDYDDGYGIALDNEGKDYLW

SEQ ID NO: 14554 - protein, 856 aa, Halomicrobium katesii
MGPEPISHPATDGDEATRLLDHLDDVAGRAESVVSADATTIGGDPLPEMTGVVARCHDVGKATTWFQAYVVGERDASDRTNHSLLGAYLGYYVLDRLGYDSEDCLAALVALAKHHGRLPDVEEYVDGVSRFENTSEASNERQRILIEQVGNVDDHRRQFAQSFVADATDGNGSWGEFAQSIEDESLFDTVHEHVSLFGFGSDRSAPSEEFYGLLLQLWSGLVFADKTVAAGIENDDLDGSEPDARLLSEYIADLGSDTDEDGQAAALDTLRGEARDDVLGGVERFRDSEASIATLTLPTGMGKTLTGLSAALALRDEGERVVYALPFTSVIDQVADELADVFDTDARDDLLTIHHHLAETVTKLGDPDEDPDEYARLAEMVAESWRSGMTLTTFVQLFESLVGPSNSQSMKLPALYDSVIVLDEPQALPMQWWKLVRRIATILTEEYDATVVAMTATQPRATDEETASQALFDDAFELVDDVDRYFGHFERVEYDVHDSLLAFDDTDATVDYEAAGRTILDETGRSESTLAICNTIDSATALTDAIEDREAVVDVGRCLELELEDGADVDALVERVESALGSNERALVHLSTRLRPRDRLALIEATKRLTERDVPLVAVSTQLIEAGVDISFDRVYRDIAPIDSVVQAAGRCNRSFESDLGTVTVWWLAPPAGTTTTPAQAVYDSEGVSTISLTARTLDAIGADDGTVAEQTMTRDAVEHYYGLVADRNPGDPEYVEWVDEANADALGDLSLIGQRESVDVVVCRTDGDRELADAMVAALDEFDYDAFGDYREAAKDITVSLPIYSQDSTEAETVRNLEPLGDADLRVLRRARGTSYFDATKGLAVDEPCVDDRFL

SEQ ID NO: 14555 - protein, 794 aa, zeta proteobacterium SCGC AB-602-C20
DIPEEGQHIDKAGAFSFEKHPRHNEISLLLYALLDDDSDMSIVKNRYNKSLIKHCIYWHHAKPVRKEELKKLDGVYNKLSSDMVHKTIPVVHGMIKILDDLINAYGADLKLTHCVKKPDEDKLYAVKREFLAEYKNYGANESVKNFKHDVNVNAKNNIARTAIVTADRLVSALSAEALSDHIEQGSLHDLLDKALLIERGLKSDIQACLQAFERNQSNSERNMQQTNAVEGLNDIDGSVAVLQGPAGCGKTKIALEWAASNNAKKIIWICPRVQVCQGLVNDLTSAEYLPNTKIEICIGEFKSLYQNGVETPTPENQEFSGDIVLTTIDQVINTITTHTKVTGLVQYMNAHVVFDEYHEYIPMAGFNLLFAELVSCKNLQRKNHNTLLVSATPNYYFVRELLGIDEDDIVSIDSFNQSQYKIEFQDFDEKIEDDSNPLYSTQPTNTFVISNTALTAQKSFIENQYDENAILIHSKLRQTDRKDLFNQVYLSFKQGGDRRFDVLRAGPIVQASLNITCNKMITEFTNAENWLQRMGRLDRFGENITPNIYISALSEHVRTGKCLGNARFLNGLFCLQSTKAWFEFLEQQLPENKTITIAEAYQIYQDFYQNQNSIKAIEQDLLAALKRSVQLIEAKIIDPISFPKRKKPKDSKVRVKSNSLRGNSRFVEMAIANIDNGKEAFPNEYACECESLTLSVELITGYGESEMDLLAFMAKKHHSIKKNPAYGVSKTSRYKDRMYMKKSKDPETPIYLSYTPEDLEEVNTEAHPHAIYYAQGIKQAIGSLSINHINKKGE

SEQ ID NO: 14556 - protein, 752 aa, Gallibacterium anatis
MIFYAHSVENSDEQNWQPLQQHLHNTAALAREFAAYYPQNAQALAETAALMHDQGKYSIPFQKRLRGGPKVDHTTAGAKFVLNKYPNVLGKILAFCIAGHHAGLANGAREEKLSTLQQRLASDTPEADPVWQQELTLPEQFQPPKLQILNKNEGCFALSFFTRMIYSCVVDADYLDTEAFYSKVENKSVERGNYPDLNTLQQRFIHYIQNKFQPTDDPLKTEEAKKAEANQELNQIRTHIFDYAVQQAALPSGLFTLTVPTGGGKTFTSMAFALEHAKLHHLRRIIYVIPFTSIIEQNAAEFRKAFEELGEQAVLEHHSNFDDSHFVDKSSKDKLRLASENWDMPVVVTTAVQFFESLFANRSSRCRKLHNIAGSVIILDEAQMLPLNLLRPIMAAINELAHNYRCSAVMCTATQPAIHQQNGFYNGFKNTRELAPEPEKLFEKLARTTVQYVGEKTDADLLADLTNHAQILVIVNNRRHAQSLYQSAKELEGVFHLSTLMCAAHRTQVLNEIRSRLKEESPCRVIATPLVEAGVDIDFPRVMRAEAGLDSVAQAAGRCNREGKRKAEESSVLIFKPEDQWQPPAELKMYAACMRSVVRHHQQNLLSPQAISDYFSQVYALKDEELDKEGILKDCYNSAYDFPFDTMAKNFRMIQSHLVPLIIRFDNEAKAAIEALQTADKAGGILRKLQRYTVQIPENVLAKLYSAGMVDTINDDKFGKQFYYLINDSLYDNDMGLTWENPEYLRTNQGPI

SEQ ID NO: 14557 - protein, 706 aa, Porphyromonas levii
MARYEHILAKDDGTPLIRHLEDVASAAKAIASSVGLDSQLAIKGAHLHDIGKCSPLFQDRLRGKANYPNIFFRHEIASLFFLPLISGVEERHILIQMIVAHHKSLYRDMRGLGLLDLDQNDFRYIDDHLSDFDLWSGVALGILNELGWNVHSISVDEARKSVEDVVEYCSSLPMGYSEWKGVLMAADHIASAMSNEIGSVVKNLFIPPDLSYYSVRKSELYPLSMISAEDMRRHTIVTAPTGAGKTDFLLRRCRGRVFYTLPFQASINAMYERFKGDLSNTEASIYPLHAASILKLEDKSEQILSHHVGASIKVLTPYQIASIAFGLKGYEAVAVDLRGCDVILDEIHTYTSITQSMVMKIVEILLLLGCRVHIGTATMPTILYDNLLKLLGGKDSTFEVKLSQEQLRTYNRHVIYKINSIDSARNPIRGALEKGHKVLVVCNQVKRAQAIFQEYRNSFPSISMMLLHSRFKRKDRASLETQLREVFNQNSEPCLVVSTQVVEVSLDISFDLMVTECAPIDALIQRFGRINRKRSKETIGRQKPIYVIAPPDDEKEAKPYNLDVLMRSYEVLPDGEVLKEEEIQKLLDIVYPKIQTPDIDFHTTYRDGEWQLKQLVHFPKSALMDLLEVNSACCITEEDLTSYREGTYVSRTVLEIPVPQSIRFKGLTQEEVGMYPFLLPDKAYDSVLGYLDEYATPLKYNTFEIL

SEQ ID NO: 14558 - protein, 786 aa, Porphyromonas macacae
MNNTNTQKYLAHIGKDLSQQTMLEHENGVSDLAKNFASSALGKEWGDFAGILGKWHDLGKYQKEWQKYLKRAAGIETGTPVSVRHSATGALHAQEVLPKKLGKVACYCIASHHRGLYDYKTLNDRLKTCREMQSYREIKSILHNIPSLPDDIQQELEKILNNKKGYKDLQLTIRMLFSCLVDADSLDTELFMNREKGMKRQNLRQEKSQELWAKFKIMLQKKTDSFVADTEINKARAGFLSQCRIHGKTCSKGIYSLHLPTGGGKTLSSIAWALETAERHQLERIFIVLPYTSIITQTSQILRDIFGPEYILEHHSDVNLEQNFNLLQKQKEGKKTFTAKEEEEEYDRLKLLAENWQNVPIIITTNVQFFESLFTNKPSRSRKIHSIANSVLIFDECQVFPLRHLAPMLCSIESLYRRFGTQTLLCTATQPVFNEKFTFMSRKQTFHTIEATPITDVVPYDKKFFSLFNQVEYHLDEGEYTCEELANRLTVHESVLCIVNTRKDAYNIYQTLKKKEQQENCELIHLSRKMCSLHLQEKIKTIISRIKEGKPTKVISTQLIEAGVDLDFPVVYRASTGLDSIIQAGGRCNREGKLPSKGHVYVFSLISDSSQYFSKKIDPVLSATATTINQNGFSINNPESIKNYYRYLFQKVSSFDTAEIKKDLWDNDKVKILGFNFESVQEKFKLIDEKGAFDIFVPYSISGAEIIKKIERNEWLSRSEVRYLQRLKVEIHEKDLLHLLFRGSVSAIKFWGEEKDPVFILIDDKSYSSETGVVDENHYQENPQII

SEQ ID NO: 14559 - protein, 368 aa, Streptococcus entericus
MGRVTSDQPLYTFKQQDFSTGSVLNWTGTLTPYQEEVSNQLIKAQAAKENILVHAVTGAGKTEMIYPVLEQVLAQGQAVAVVSPRIDVCKELYSRLKRDVTCSTVLLHGDSDPYTRAPLVISTVHQLYKFYQAFELIIIDEVDAFPFVDNVSLYHAVERALKPSGSKIYLTATSTEQLDRQVRAKQLKKVHLARRFHGNPLVVPKPVWLAGLLDGMTRGRLPKKLVAYLTKQAATGYPLLIFFPHIALGQEFHRLLSVYFPEETIGFVSSQTQERADQVEDFRQGRSRILVTTTILERGVTFPCVDVFVLWSNHKLYTASSLIQISGRVGRSKERPTGELLFFHDGVTAHINRAITEIKEMNKKGGLA

SEQ ID NO: 14560 - protein, 816 aa, Streptomyces vitaminophilus
MTSGRRTLAEVRAKSTPTHDPERLTEHSRTVRDAVGQIRDRIGSSGILADVPSFWSWVSRAGLLHDSGKVAEGFQQQLLPGGEPWGERHEVLSLAYVDLLASACGWTQQDRLLTAVLVATHHRPLFPDGGQGRGSKRSLVQQYNEHTLWEDAFTRRPRLDTHQVQVRPDLHRELLAWFCGALEADPPPTIAGSKLAHRARDLLAELVQEWKDPVDPHRGLVAVLAQGALTLADHTGSAHVAPQSHLPLPDDYLARLERPYPHQRLAAETDGHLVLIAPTGSGKTEAGLAWAGRQVRRMPGQPRMVWVLPYRASIDAAAQRFRNDLDPPPGGKEPDIGVLHGTVAQTLLAQAIEDECPCTDNSADEPRGPAQRVGPPAPAEVLARQAQARANVMRLFAQRVRVSTPHQLLRGAIAGPSHSSALLEQANCTFVLDELHAYDPVTFGRLCSAMGLWERMGSRVAVLSATLAPPMTQLIEESLNQPITVHRAAPDTSPERHRLVLDHTTLTDPTSLARLVGWLQAGHSVLVVANTVATAQHVYETLAPAAREACPGDAGAALLLHSRFKNRDRAAIERRLSLRHGERRSGETARRGGVVVATQTVEVSLCLDFDRGAVEAAPVEAVAQRAGRVNRRGRHPEGVVEFRVHRPRSTLPYPAPAVDAAWHALTTLTSHGTSTLSEQDIDQLLAMAYDTEWGERWAKEAREARDHHTTEFLTFDEPFRDRGEFARRLDEELDSTQVLHADDIDEFRQLSRDRQGHPLLAAGLLIPVRYGYLRQLDAMFDKSLNVFVTTAPYTSERGLCVPSATTPPPPPRETVL

SEQ ID NO: 14561 - protein, 762 aa, Marinobacter gelidimuriae
MTEQVSYIAHVKQDSKGGWSEPHLLHEHLEKVAELSARSTKKCQSEAWGFAAGLWHDLGKYRSGFQMYIRDASGFERENAHVEQGAHSPRVTHSTAGAVHAINQWPSIPGYILAYLISGHHAGLPDWSGGRGSLEHRLAEATKEYQESLAAGIPEQLLTAEQPAVPGAARSLKSIALWMRILFSSLVDADFLDTESYMSPEKVDKRNQYPQLDELHSLFFDKMSTLQKNAEQTPLNVIRKSIFEACHREAYEAPGIFSLTVPTGGGKTLASLGFALEHAKQHGKSRIVYAIPFTSIIEQNADVFRKFLGDTAVLEHHSSLDIDQRAENAGSRLAAENWDAPLIVTTNVQLFESLFASRTSRCRKLHNLVNSIIILDEAQQVPRDFHAPITQAMQQMSDHFGVTWVLCTATQPELGQQTDAFDRTLHEGLSNISEIIPDPIGLAQNLKRVEIELPQNVDQPTTWESLAWQVANEACALVIVNKRQDAKTVYELLPDDGDTYHLSANMCAEHRSVALKEIRQKLIARRNGDTTPLRVISTQLIEAGVDVDFPVVFRAMAGLDSIAQAAGRCNREGKMPQPGRVVVFQPETLPPPGFLRQAAQTTLELLKSGQLDDPFSPAAMQAFFTKLNYLGNRDAHGICELLHAKTSPDAPLEIQFREAAKKFRLIDDVGIGVVVPFCPEGHEESPVHIWLAALEKDSSQKWAHRKLQRYSVTLPERLAKQLHSAGALYERAGKFVIETSNYHPVWGMQPPGNLLSAAGSVI

SEQ ID NO: 14562 - protein, 600 aa, Methyloversatilis thermotolerans
MLFSALVDADFLDTERYMNVEKAYRREGAPSLATMRETLAGHLVRLASQVKATSVNRVRADVLRQCISKALQAPGTYSLTVPTGGGKTLSSLAFALEHAVHHGKRRVIYAIPYTSIIEQTANVFREVFAPLGDDVVIEHHSNIESDPESETARSRLACENWDAPLIVTTNVQLFESLFARKTSRCRKLHNLIDSVIVLDEAQLLPVEFLQPVIDVLRYLIQDFGVTVVLCTATQPVLDASGSADPTRGISRGIGKVTEIIDDVPALYEALERVRVKLPASLETPRNWPELADEIMQHQAVLSIVSRRADARELYGLVKARSDEGCWHLSALMCAQHRSDTIEAIKQALSCRRAAIEAGTKAAPVRVVSTQLVEAGVDLDFPTVYRAMAGLDSIAQAAGRCNREGRLHEPGEVHVFVPPTKAPPGLLRQARDTCKAVWHELPEQPFALPLIRNYFQRLYHDAQSLDLHGIGKMLRLQIDAKSLALPVQFRDAADNFRLIDNEDAATVVVRYRSPNAREDIDALIGMLERDGPARWLMRKLQRYCVTLYRHQLPALIEAGDIREVTACPGLYVQIDGWDGFYDRVMGARVDSAPGDPASWVY

SEQ ID NO: 14563 - protein, 810 aa, Leptotrichia shahii
MGNVFLAKSNGEIVVEHTKKLIQNFEKLIELYPNIEVDKRLLLLACIYHDLGKINAKFQYKVSNEKRKSLLKEKYEIDLKKNEIPHGILSTAFINSNELLKENFDKEDIKILAHSVALHHERDISEIEDEDFKEEIKKMEFELNDFETELTSLENIYFEIIKEIYGEIKKYSIFKREDDNFKIKKLSKKYYKLNDRIYSEKMYTKKEEALEIFKKYVMLKGLLNKIDYAASSYTTIEEKNDFLEIKMEKFLEDVLRKDNPKNDWNALQKFMKQHKDENMVVVAQTGYGKTEAGLLWIGNNKGFFTLPLRVAINAIYDRIVKNIVRENVEKRIGLLHSDFREYYTEKNSKENKLLKNEELSEYINRTKQFSLPLTICTIDQLFDFVFRAPGFELKVATLSYSKVVIDEIQMYSADLLAYLIYGLKYITDFGGKFAIMTATLPGIVTYLLEKEGVKFVTTEPFTNDKKRHSLKVMEENINAEFIKEKYRNNKILVVCNTVKKAKEIYENLDIPKEELNLIHSRFIKRDRTNKEKEITEFANPKRFREDIKNRREKEGYQENGVWIGTQVLEASLDLDFDILITELSDLNGLFQRMGRCFRNREKVDEEYNCFVFTKECSGIKGAKAIIDKEIHEKSESVLLKVDGIISEAQKLDLINSVYSYESLKDTKYFNKVTDNIKYLKKYIVEYEKTKSEVQKIFRNIASYDVIPKIIYEENFEEINRNVEILKEKMKGLLENDKRKLRIRKIEARGELNKFKVTIPDFEYRKLEKSKKNEIEKVKINDYEELVVVNCGYSYEKGFEVVQGEEEDNFF

SEQ ID NO: 14564 - protein, 816 aa, Meiothermus timidus
MGSALGFTQALPASPAAPARDALLGTRLLHVLPMRALTNSVAKDIAKLLERQGFGEVYRPAIHHGQQQESEIFAERVGVTTIDQYLAGFAGAPLSFSSRSGHAVAGAIVASYSVFDEVHLLGPERGLPLLYAVLQQRKRWGLLSTVMTATLPKSVREFLVEQVGLEAVELSSADVQARDGWRRVTLSLEEVEQPAERVLEEFKAHGRVIAFVNTVDAAVELYRRLQPRLGPEELFLAHSNFAPSHRKAVEERLLEVFGRGSTARAVCVLTQVGEAGINISAPVVLSELAPVDSLIQRAGRCARFDTQPEGRFVVYRPRRERNHIPYGEDLVRRTEAALHNRGDSFRLDWTAENELVDEVLDAYYAHFIRGENVSRRDAEIKKARKGERVELPQPAPKTKSITIADALGLLDQTFHSRSADVLEGTLREINNVQVVVVSEPPRNVAGTEVVGGEGGENLSEFERYLAQQNLLKPYQRDTLESIPVSYGRFARRLEEQDLWELKLVKEERYDKPLYLLQRAERVRPNHTYILPQARAGYSPTVGLSFGEVDYVEPVHGLITPVVPRLSEQAQPPKHNFQGWRAHCSRVYRAVDSMLKSKYSAWIFHIAEQMQARGALESAEQFAQTLESMIRLAALLHDIGKLSQGWQRAIGWREGEFWAKSKEGVRVGELPPHAFHALPALRYLFYQLGVVDEQGKVDRLAELIALAAARHHSLGELDGTLKWQPFELHEGVLEEIQQLLRDELGEDSEPIQALIAPGLFDHINDASTYELIEGKHTYVLDTPSPSEDYYPFYVLASRMIKVGDWEASGEREVELCR

SEQ ID NO: 14565 - protein, 885 aa, Meiothermus timidus
MWAKSDQDKEKGQWHPLIAHLLDVAACAELILEREPKRTLELYAKDLGLPPEQAKAWICALAGLHDLGKASPAFQQKWPEGMERVWAAGLTWTTPPTPPPDDLSHSVIGEEVLPDLLEARGWVRRAAENVAAAVGEHHGFRATQQDLDSVTGKEKGGEDWYKVRAELFEAVLEVLGVGEAPGVCIYGGAAFERLAGLTSFADWIGSSLDFHPLGDDLAGYYQRAKARAAQKLDSLGWFKREPLMPEPQSLEAVFAYLGKPDQPFKARPLQSTMERLLEGIHTPALFLVEAPMGEGKTEAAFYAHLRLQAANGHRGMYLALPTQATGNLMFERAKAFLDPYGKSRRLDLQLLHGASELVEAYQKIRVRPNLPDEGEGVEAQVWFSHRKRGLLSEYAVGTVDQALLSVLPTKHHFVRLWGLGNRVVVLDEVHAYDTYTSGLIESLVRWLRALGSSVVLMSATLPKAKRESLLRAFGAQCAPEAPYPRITRALAGDPTPVAERFAAREQPTLTLRSLPLELEALAERALEQARQGGCVACIVNTVQRAQELYQRLVGKADGVELSLFHARYPLEERLARERAVVAKFGKEGQRPPKAILVATQVVEQSLDLDFDVMFTDLAPIDLMLQRAGRLHRHQGRERGPHTQPVLWVAGLEEGGVPDFGSAERVYERYVLLRSWLALRGRQEIRLPGDIDPLVQEVYSEPPPQGLSEAWRAALEQAQVCMDKRESTDRDEAFYAPFGQPDETKWLEPQTFPKLPDDEPNPDDDPDLLHTRKGSPSATVVLLHKVGGQLCLDESGKEAVSVASKLELSEAKRLFARSVKLSRHELTRNDFQALKEHRKAHGLPEKPWSQTPLLAHAHPVVLEGGRAVLGELELELHPELGIVYRR

SEQ ID NO: 14566 - protein, 799 aa, Streptomyces sp. CcalMP-8W
MASQLFDLCLGPYLKNRLEAALEPLGDAREWAARLAGLHDLGKCSPTFQGLRADVAKMLLPESDHAAIDRLREGPRSSGARTDVAHGLISALYLRQLLVKWGASAETAESIGVVLGAHHGYVPGPADLRQVSYKRGAIGGETWATRVEALADELCRLRRTPEGEPSAADWARVRMDGPAELALAALTSVSDWVASDRREAAHAGAAVDLTAYAAGVAATEQPKVKSLGWEACTVPEDTSFGSLFPQSSERRDLQTRLEQLVAGERGLGVFLLSAPTGEGKTKAALQAAACMIRLHHLRGFHVAMPTRASGNQVYEVAAELLRPWDGHAMGRLKLFHGAAGEYLNRRSAAGPPPLCPECVAEDGGSGASEQFGCDSDAQAQAQLSSKADHLNPLVVSTVDQVLKAAVRSGHVFVRLAGLSGKVIVFDEVHGYDVHSGVLFETLLYRLGGLRTPVVLLSATLSTRQQHALVNSWRAGALGLSVGELPEPEATGTAAYPRILSADASVGGTASAVGVTAAPVNRDRVVQLHWVDRQDVVELALREAHRGRNVAIVHNLVGEAERDWESLRRAVGDVAGQTVVTELIHGRLDPAERLAVEGRLRARFGPRGSMTAAVGSGGSVVIGTMVLESSLDLDFDVMISAVAPIDSLIQRMGRIGRHRVGAERPEIRFVLIRVPEPRSGRKAVNFSYAVNVYDEAILLRTLAVLRERDVIRCPDEVQELLDRVYDDGEELHSPLGWEEQWERAAARSERRTPKAGREALIARIPMSRGTGWSLRTLTEFGRAGTGTRQSVHRADRDRKA

SEQ ID NO: 14567 - protein, 747 aa, Rhizobium leguminosarum
MTNLPLSAFEQLSDPVRRWIWKQKWASLRDVQDKAIPAVLAGGDVVISAKTAAGKTEAAVLPLLTRIERSAKDATGFSILYVSPLKALINDQFRRLQGICDDCGVLIHKWHGDVSADAKARARKRPSGVVLITPESLEALLVRRGNEIKFLFSSLDAVVIDELHAFIGTERGMHLQSVLNRIEVAAGRDRIDRIGLSATLGDMNLAAEALRLGAAERARIVEGLDEGNGLRLQIRGYITGQAESSEGDHEEETADAPREEFGIPDKLAADLFRFLRGKRNLMFAGSRQKVEVYADRLRLMCDDGSLPNEFFAHHGSLSKAEREDVEVRLRDDPRPTTAVATTTLELGIDIGDVDTVAQIGPGYSVASLRQRLGRSGRRAGKPAVLRMFVIEPSPDRGGHPADRLNLDLIQSIAMVECLKAGWCEPPAPAGLHLSTLIHQVLALIVQTGGIKPGVAWNLLCGRGPFKSVDKAIFADLLRCIASSENRLIEQSPEGLMMIGEEGEKITESHEFYPVFSTNREYRIVNEARTLGTYPLDSPIAPGETIIFAGRRWRILEIDDRARVITVKPTRGGKPPYFAGEGGGIHDHVVQMMRAVLESAETYVYLDQAATELLQSARQAYADLGLSNRSIVSYGDGALVFPWTGTKKLNTLTLTFMAKDFKASSFGHLIEVQSCDSSGVIAFLREIADGDVPGVRDLIRKVAKPNIARFDHHLSWDLMTMVTIRERLDFDSLPTVAQAVVLRQAAEI

SEQ ID NO: 14568 - protein, 556 aa, Frankia discariae
MWGEVQTSFVDRVAGDLGVDLASFAQVGSPRRGGQLAVSGLVIMADWIASDERHFGGQADLAAVSLEASRERARQAWERLGLRGGWRAGRPAPLGQQDLVKHRFGDSARPAQASAVRIAETMPVPGLLIVEAPMGEGKTEAAFAAAEVLARRFGADGVFVGMPTQATADPMFRRVRDWSVQVDPKAPLGLLHGRARFNAEWAALRSQVTFAGIGEEFDTNATGGSTPVEERPLVDGVAAAEWMLGAKRGLLTPITVGTVDQLLHAATRTKHVMLRHAGLAGRVVILDEVHAYDVYMAQFLFEALRWLADAGVPVVLLSATLPPDLRERLVRAYVQGALQQREVDMAGLPTVEGYPRVTAVCASQGEPTFTVATDPSWRDSLNVEVEILAETSTFAPDAVAAAVTAEVGAGGCALVVCNTVGRAQGVFAALQPVFGDDVVLLHARFVAVERAARTERVVDLLGPPGRSGGTVRPQRLVVVATQVAEQSFDVDVDVLVSDLAPIDLLLQRVGRLHRHERPERSRQPKSMSHVGCGSFFQQVIAAARQRNPRKLRPLRS

SEQ ID NO: 14569 - protein, 764 aa, Thiobacillus thioparus
MKMDESQQPIAHAARNPDGSWRAPHNLADHLAGVAALSTCHARKFGAEDWGHLAGLWHDLGKYRPAFQDYIRTKSGFDKENAHIEGTGRVDHSTAGAVHAVDELGEGAGRLLAYLIAGHHAGLPDWNGDNASLFQRLEDARKKNFLKEALDQQPSEAILRGQPPGSRPKGGAADLHLWLRMLFSSLVDADFLDTENYMDSDKANTRTTYPIIDNLLTRFTDHMGQLASKAIPSAVNKIRANVLHQCIERAVEERGNGLYSLTVPTGGGKTLSALAFALHHAKEHKKRRVIYAIPYLSIIEQTADIFRGIFGEDVVEHHSNLDPDKESPRSRLASENWDAPLIVTTNVQLFESLFAARTSRCRKLHNLVDSVIILDEAQLLPPEFLEPCLAAIRSLSKHYGVTFVLCTATQPAFQPREINGKPFPGLPDVRELMRGGPLVHDPNELYQGLDRVEIHWSNTSVSATWDELVERVTHHDQTLVIVNRKTDAREVAKRLPNALYLSTDLCGAHRAERIEEIRIRLEANRERAKEGLPVCPLHVVSTQLIEAGVDVDFPVVFRALAGLDSIAQAAGRCNREGRLMCGEDEAKGEVHIFMPPEPAPSGLLLKGEQATRALLALDTNPTLAPHLFERYFKLWFAAINSMDKEGIVGLLSPGNGLEISFRTASEKFQLIPDDGVPVIARWGEAENWLTKLKADKPDRWIMRKLQRYSVNVRRNCLDRLIAQHDVEEVLPGFYAQSNDLLYDETFGFLGCADNIAPAPGNYVF

SEQ ID NO: 14570 - protein, 779 aa, Streptomyces
MLENKEVEPLCGPVPVPEGRLVAHSPGHRGIWHWYEDHARGTGELARRFAEPWGGRELAYRLGRDHDTGKGACAWQDGLIEEATTGRKVHRPSHHDAGAFLFAQAARRHPVLTPFAGVIEGHHTGLSAWSELRIRLKRLMLDSAEVNQAISQVAEVMPEILDGTCPAAPEWLDPRDRTSVEMLIRMTYSAVVDADRLDTAAHFRPGTPPRPHVGITELWGRYETRRREAVAERQCCKAPSWLDRLREDVYREAIEAAASEPGVYRLHLPTGAGKTFAGGGFALRHAALHGLRRVIVAVPFISITEQNAAVYRRLLDPEHGSEVVLEHHSAVNFEASDRRGSRPSGTSGGVHPGQRHVRSNPWAKLAAENWDAPFIVTTTVRLIESLFGNSPSATRRLHRLANSVIVLDEVQALPDTLLTPILSGLRQLVEHYGVTLVLSSATQPELAALNPWQTGLPQRNVVANPAPLFHQLRRVRYEWRTGPEVTLGSIAAEAATHDDALVVVNGTKDASHVHKVWLGDREENPGTLHLSTRMTGGHRRETIQAAKQRLEAGLDTLLVSTSLIEAGVDLDFPRGFRARSLPESEQQAAGRINREGRHRAEDSVMTIFEPSDGLQPRVVYNRCGIAAASRRFGQGLKNPDDLDALRSYYRHRYRLQAGSSSTDLNGATGEAIEALREKLDYPEVARRMRMIDNEQSVAVVVIRSQLNQKDRQTAQNAIKQLRSGVPTPETYRTLQDHMASIPQQELQTAINTGHAVEIVGDLHEWTGPYHPQRGIEPPS

SEQ ID NO: 14571 - protein, 909 aa, Streptomyces sp. ATexAB-D23
MALHLWDVYLAGNQRVRIADGLGLAGELERARALVALCAGLHDIGKLSGFQFCSRRAGQFVGSELAAGSGRMSAVRAGHDVAGMTAAAEVLKVLGFEDDDEMSAAERVAEIIGGHHGRFHRLEDGVGPAFLGDAAWAGQRAAHATAVHDVLGAPVAPESFEAPVAVLVTGVVMLADWLVSQEGYLRRRQRTLEPSLAAHFRRSQADAVTLLRDAGLAPVELQRMGFAEAYGIVGAPNPLQQSVMDELPAAAGVGGRGGIMLVTAAPGDGKSETALEAERILSKVFGTHGYVFLLPTMATSDQMYERVARTLWNRSGEDAGLTLVHSMAWLSGAYADDDLDGETVVTCDGDEAPAGRRRREADMRPERWLRGSKRPLLAQFAVGTIDQALMAVLPVRHNALRMLALSNKTFIVDEAHAYDPYMQVLLGRLLNWLGFYGVPVVLLSATLPGSVGDRLIKEYLQGAGHKSKALKGKTFPTPYPGWLYVDGASGRCTQMSRDSQLEQALSRNMRLRVDVEPVVHGGEGGAVDRIAVIRRLLEPVATGCGGTALVVCNTVGDAQETYLQLRNEIDRRSHQEAGDVLLLHARFPGDVREERTAEVAAGLNRNGPRPARRIVVATQVVEQSLDLDADIVISDLAPLSLLLQRAGRCWRHENHWQKHGYPDGRGRPGWADEPRLVVLDPLTGGGRMPVQWGEVYSEHLLGKTSRKLAEIEEGGIAIPEDVQALVEAVHGDSKDFDWNASGNREAKAWAEHKGKETAERSVAALCAVPRVRQVAALHDLHDMEGEEGEWEVSTRLGADSVRLLCAYVQEDGRLTLDAEGMQLLPEGPQDGRTPVSLVRQVMRRTIAVRADWFRHAEPDTLSPPSSWGEHPMLGDIRVLRQPIHQGKAQAVKVGAKTMSLDQDLGLVRA

SEQ ID NO: 14572 - protein, 942 aa, Streptomyces
MVWAKHDRFSDGWLPLWQHMEDSAAVAGLLWDRWLPAAVRRVVAEPFAGDEVDARRLVVWLAGIHDVGKATPAFACQVDGLADAMRAAGLEMPYQRQMGADRRMAPHGLAGQLLLQEWLEERCGWPGRSTAQFAVVIGGHHGVPPEPAQVTDLDAHPELLRTPGASQALWRQVQEELLEACADEFGVYRRLGEWQRISLPQPVQVVVSAVVIVADWIASNPDLFPYLPQEQDRTGAERATAAWHALGLPEPWRPGAPQGSAAELITARFELPKGAVVRPVQEAAVRVAREMPEPGLLIVEAPMGEGKTEAALAAAEVLAARAGAGGVFFALPTMATSNAMFPRLLKWLDYLPAHEGEQLSVLLAHSKAALNDDFAEVKFGARVASVDVDSDGQVPPPGAEQRAAPAELVAHQWLSGRKKGMLASFVVGTVDQLLFAGLKSRHLALRHLALAGKVVVIDEAHAYDTYMNTYLDRVLGWLGAYRVPVVVLSATLPAERRRELAEAYAGVPGGSEAFTPVGQASGYPLLTAVCPGHSPLLEEPAASGRRSPVQVEELEDDLAVLAGRLEAELTGGGCVLVVRNTVKRVLETAKVLRHRFGSDAVTVAHARFLDVDRAAKDKDLLTRFGPQATLGNGRPTRHIVVASQVAEQSLDVDFDLLVTDLAPVDLLLQRMGRLHRHPRDDRPGRLQDPRCWVTGVDWTAAPPEPVRGSQMVYGRHALLRSLAVLRPHLAKAGPEVQLPQDISPLVQQAYGAHAVGPDEWAETMTQAQLAHERVRAQKARAADVFRIGAAGRAGRAILGWLRGGAGDADDTRAGRAQVRDSPESLEVVVVERLADGSLSTVSWAGGGRGGLALPTDAVPVPRAAQAAMACSLRLPPDLASPYVIDRVIAELEQFCIPAWQAKDSSWLAGELILPLGSDCQTRLAGFRLQYSPDDGLEVSREQ

SEQ ID NO: 14573 - protein, 787 aa, Streptomyces sp. PsTaAH-124
METVHDIRARIGDVGVIACEPAFWTRVSAAALLHDTGKIAEGFQRQVLPGGPPWGERHEVLSLAYVDLLARAASWSADDRLMIAVLVATHHRPLHGTDNRRPGLASNYGQHTDWEKAFTRIQTPDGATVPQVTSGVHHELVAWLAGMLGVDPPPAPSDGRTLADRARSLLKDLLDHWNGAPLLDVTGAHHGPARTGTGLLAALGQGALTLADHAGSAHVALQTHLPLPADYDTHPPRPPYPHQRYAAQADGHLVLTSPTGSGKTEAALGWAAHQIRFMPGLPRLVWTLPYRASLNAARDRFRRDLTAAPGEELPDIGLLHGTAAHTLLREATDDECPTGTSDVGSPGTQQSGRADPTRTMAKQARARVNAMRLFTQRMRVATPHQLLTAALAGPSHSSVLLEQANSLFVLDELHAYDPQTFGRVCAAMRLWETLGSRIAVLSATLAPPLLRLVQESLTAPVTLVRAAPGTAPDRHRLALDPEPLSAPASLDRIRSWLHEGHSVLVVVNTVDRARTLFEELADDARDACPGDPDAALLLHSRFRHQDRDTLEHRLLARHPERTADDSVRRGGLVVATQAVEVSLQLDFDRGAVENAPIEAVAQRAGRVNRRGRHPDGPVEFRVHRTESHLPYDQGAVDAAWLALTTLVTEGTSTFGEQDIDRLLQLAYATEWGAAWSDEARRCRDSFAQSFLTFEDPFHDRSDYEEALSEQFDGVEVLWRPDEDTYRRLIKGPQGDPLLAARLLVPLRYRQLKPFEAAFDRDLSLYITDGEYDCVLGLRRPTAPETVL

SEQ ID NO: 14574 - protein, 978 aa, Oligella ureolytica
MMVVLVSQCEKNALAKTRRVLDAFADRIGDNTWQTVITEEGLQAVKKLLRKTASKSTAVSCHWIRSRSRSDLLWIVGNRRKFNEQGIVPVNYTEMDVFMDVVTDKPKQGVLYANTHLQLLSEHLFAIGYVAEQLHRRLFPESSTQLSFVNFVAGSLHDLGKVDPKFQEWVTNPKKKAFIPEDGQHIDDAKFSFDKHPRHNEISLLLYHLLDSTELKALNLSNKRSVKHAIYWHHAKPYRKENNGFDSYKDISKKLLVNQQGLGLSDIVTQAQSLLKQVIAIDKKYRNSSNSLLEKICLIEAVNELEENLPDAPPLPSYKEYELEESVSSNSDNVKVNALNNIVRACLITADRKVSALSAAELHSAIFERNLDDIVTDLLDVESTLSSDIDACLSAFFPSSERSKKQSDIARQLTTAEDVAVLAGAAGCGKTKIALEWAKLQGAKRIIWVCPRVQVCQGLFYELTSEQYLPNSTIEINTGEFKFHNQWDNPIPDEENFSGDIVITTIDQILGSVISHTKANTLIDFLNVHVVFDEFHEYVNMPSFNLLFAELIAAKKMQQQQANTLLVSATPHYVFVEDLLNIHPDDIKVMPSFNKSQYQLDFKIFDDSKLDNTNPLFEQQSNCTFVISNMALTAQNSFIANQHSENAVLLHSKFIKSDKRKWFEEVFEAFKRNGTRKYEVLRSGPIVQASLNISCDYMIAEIASAEDCLQRLGRLDRFGENSNVNIYTLAVPESIANGRGKSSAANFLGKMYVLSSVREWYQFLHNELTDRTFTLPDIYQLYFNFHHNERERSFIESDLVAALKNSVQQINAKVIDPIIASPKKNKNQSRSKISKTSLRGDNRFVQLALIDLTNSTPEFLEKYAYSIPLDDDSDIDNLTYSTSAISGYGQSDKDLLSHMFKKHHNIMGGVKSFKDSILLNDARNPEFPIYLSYTTNDLIAVGGESSRHPNAIYYAVCDKQPIGAMSINQINQTTEDEE

SEQ ID NO: 14575 - protein, 743 aa, Oligella ureolytica
MKFYAHSVEGQPKTSWQALQEHLVSVGDIAANFASAFNAQEHARTAGLLHDLGKYTQEFQGRLEGGVRVDHSTWGAKKAIEIYPQMGQLLAYTIAGHHAGLANGKYSGKQKKSSLDVRLTNELPVLCDAWQEEISLVSQLGLPSGFTPKNKRGRFQLSLLTRMVFSCLVDADFIDTDNFYRKVENRPLRDAYTYSSLVELNTKLDVLLNSFKPDTQVKQLRSEILQHVQKQADQPSGLFSLTVPTGGGKSLTSLSFALRHAIKHGMQRIIYVIPFTSIVEQNAAVFRGAFGELGENAVLEHHSAFEDDGSKALESKEKRRLAMENWDAPIIVTTSVQFFESLFANRPSRCRKLHNIANSVVILDEVQTLPLKLLRPCVTLLDELALNYKTSLVLCTATQPALNKEQGFLHGFENVKELAPNPIELYEKLRRVSVRHVGALSDEELVKEFEENEQLLCIVNNRRHARALYQAIEHLPGIYHLTTLMYAKHRSEVLAEIRQRLKAGKSCRVVSTSLIEAGVDVDFPFVLRAEAGLDSIAQAAGRCNREGLRGINQSETRVFATLNEDWTAPPELEQFAQVFRSVARKHGEDLLSLEAVEDYFKQLYWQRGDQELDAKNLLGILASSCPASLPFETLAQEFRFIESKMMPVIVPFIPGTNQIRSEVETVLKDLEFAPSAAKKLQAYLVQIPERAFKELKKSGALYAVGEERFGEQFMRLESPDLYSADYGLHWETPEFIHAQSLVF

SEQ ID NO: 14576 - protein, 1129 aa, Terrisporobacter glycolicus
MEKYTAAYSYTNYNFVIQNIEGKDNINNKFYPLICVLKNILQRGCPTRMSSYLTEKLGDIDLKKVKYFGLIDDETPRWINTIKGDSENYNYPAKVFFEELIPLYFGEYAFVQKLIKPEVEIKDIVEKENPEFIYQKVDFYLHRCKLVIEIDGHHHEEPIQKYQDTQRDNYLAEQGIRTIRIKTKDINDKSKSFHERIDEILNHISKYEKVLMIYKDVRNIDDYNGNEIKSLKACAIIRMQLTLLSLLQKEKIHIDDKEWKINILQRDIYGFIELAIEDLFAWFENLCILNNMEFKRPKINIIEGRRVEDFVYYQDYINIDFSINKRYTDENEINKKVIYVRGAYFDKVNYFKVNTTDPICYRIDKENRKCVEALEFLLKSIFGYDKFRDGQLPIIINSLQGEDTVGILPTGSGKSICYQLVALLQPCISFVVCPIKSLIYDQEENLKKVNISNVASITGDKDGEEKAEIINSFSNEKYQFIFISPERFQSKVFRQSLEDLNLYSTVGLAVIDEVHCLSEWGHDFRTSYLNLVRTIRNYTPSSRLLGLTATASNFVLNDIKKEFEIDSYNIKTLTSFTREELDFKVIRCNEMDKEKKKILFDTLKELNDKNNIFDLSGEETNAGIIFTPNVNGKRGCYQISQEINSKFKANSNYYSGKSPEKYRKPIMDTKTYTEHKNKVQENFKNNKIPLLVATKAFGMGIDKQNVRYTIHFGIPMSLESLYQEAGRAGRDKNKADCFVLYESEIVDENIIDKFFSLDTPVEELREIQQDLSYDEQKDVLNNFFLWLSNNKGIEHEFHVIKSVYDNYASPGVTKKVQCKKLGFNLSDVQKAIYRLSVMGVVYDWTIELWDSNKGILEVLFDDFDIDKIKKAIENYIHKYNKEFDYTSLYSTNSFKHNKTNLQMKQVLEDENFDEIERQVRALLIWVYDNIVYTRRQSIKNISDTCRNFTDGESFKKVIENHFKFDDDTYLLDYIAENPTEYHNWFDILTPKKEIQSKIYIENIKGTLGRFLESYRYNTGLNFISGITRLICDEFTNVDGKQRLESAFNQICEYDDYSRNEILDFCLKIGDSLTEENKIHLSKILCDNYKDKLKIHEALEDNHSLKLMIEENNARLKNILGRIQCQKLEN

SEQ ID NO: 14577 - protein, 712 aa, Blautia producta
MYLAHISEDKLREQSIIEHAEGVAELSGMFAACFGCKEWGYGCGLMHDIGKYSVEFQQRLHGGPKVDHATAGAKELKLKGNVMQAYCVAGHHSGLPDGGSPAEPDTFYGRMKKELKDYQAFKEEIKIPKFPAAPLKPIGKGGFSAAFFIRMLFSCLVDADYLDTERFMKQGQTARGNYDSIEQLFDRLYKHIASWLTNYNENTVNGRRSSILRACLEKGRGPQGLYQLTVPTGGGKTVSSLAFALRHANEHHLERIIYVIPFTSIIEQNAQVFKDILGKNNVLENHCNVVCDNDKELEDMQLAAENWEKPIIVTTNVQFFESLFANKTSKCRKIHNISKSVIIFDEAQMLPVNYLRPCIQAVSELIYNYHCSAVLCTATQPALKPFFPEFIKAEEICPDVKGQYEFFKRTNVKNMGEISEGNLISELKEKQQVLCILTSRKRVQRVYEALKGENVYHLSTYMYPKHRRTILDEITKALKDGRPCKLIATSLVEAGVDFDFASVFRELAGIDSVIQAAGRCNREGNRGKDESKTIIFSLEQSDDIHIPGQLKLPISVAKQITEKYEDITSPEAIYEYFQRLYHFRGESLDIKNIVENFEKGIPSFNFPFASAAKEFHIIESQTKTILIDKEPEAMEIVERLRRGEHSRELFRAAGQYCVSVYENDFDNLDGAGMLDALCTGIDTDFYILRDKGLYTDDRGLTVRAERGDALLW

SEQ ID NO: 14578 - protein, 793 aa, Spirosoma luteum
MAVTDKALQSFHGHVTMQTDLPLTDVLRLVGMYHDLGKYTTHFQNYLLKTGTFDQELKQHAKFGGFTLYQKYRLQGFDTLALWAAYLIIHHHKSLTDINDLKGYVVEESKDEFIFYQQAKTIVPVLAQISNELNEQNLENYIRYPDRTLIKAIRELAKKPDIHNYFLINYLFSLLIESDKLDASETVLYTRQSLSPTLVDQRIAPVVFQPRTADELTRLGQNELRNYVRGAVMQKLDRTDILEKRLFTLTAPTGIGKTLVALDFALRLKAKIREHERHEAQIIYALPFINIIEQAIVEYKRVIPDKEGRVLAHYQFADALEQLSKKNDDEENQGWNQKTMLLDTWQSDVVITTFVQFLQTLIGHRNKLLKKFHHFAGAIIILDEVQTIRLEQLPLIGAALYYASKFLNSRVILMTATKPKTFELANREIIAKEGDKLDVTELLTEHEAVFSAFQRTKIIPLISHPVADEAAFVDDYFAPFWSAGKSCLIVCNLVKRSVDLFTEIQTYVGNCGYLNKVYYLSTNIVPAHRLYVIDRVKLDLKYGFKPILIATQCVEAGVDLDFDMGFRDVGPIDSIVQVAGRINRENSYVRRHSPLYVVDFDDCEKIYDRTTATQSRQALTKGAAENNGEIPEEKYLTLIGEYYDNLSADGVKSFKMARDIFGSMKRLNYDNDDKNTAPVSSFQVIDHKGFAVSVFIELDDEATAAKEAFKRLIRKKMSKEEFETKHKLAFNQRIITVPKYLNKVKELQQDKKLNELAEGLYIVNRNEVQDYYNEITGFDRSKENNQMNPVVLF

SEQ ID NO: 14579 - protein, 769 aa, Thioalkalivibrio versutus
MDEEDALRLWMGCFFGHHGKPVQGGSAPLSAAFLEEDLRALEAFSRAAEGLLQPAWPSELLGDEAWRKEALAPASWQIAGLAVLADWLGSNADIFAYQAEPVPLQQYWNETALPRAHQALAETGLLHRPGPVSYPGFTSAFGFQPTPLQAWAETAPLAEGPQLFLLEDITGAGKTEAALTLAHRLLAERQHEGLYFGLPTMATSNAMYRRLGGYYRRLYPPDTEPSLILAHGARDLNEAFRQSVVLSTSDDAPYTRNEDSAGSACRAWLADNRKKALLAEVGVGTIDQALLAVLPRKHQPLRLLGLAGKVLIVDEVHAYDTYTSGLLKALLDAHARQGGSAILLSATMPRVLREDLVGAWQQSRGENTAGTLNNDSFPLATHVRGAEVDETPLAASPFSGRNLPVEFVHTTEEALDIVVGAAREGRCACWIRNTVDDAIAAYQQVSEQLTSPEQAMLFHARFTMADRQRIENAALQRFGCDSAAADRQGQVLVATQVVEQSLDLDFDVLVTDLAPIDLVIQRAGRLHRHRRDTRGNRVDHTHAGEDRPAPALHVLAPEWTDTPNPNWLPPLLRGTGYVYPDTAQLWNTCRILREEGAIRLPERARVLLEAVHGGTRVLPEGLEDTHYGHYADQNVARSVARFNALRPEQGYQIPLDGAGWDDDQELGTRLSNEKTISVALVKETDGHLLPMHEHERHPWAMSTVQLRESQARRLPPLPQALESEADLLREMHRFLRGTVFWLPDEEDASRYDTTLGAIIARGSGRGESV

SEQ ID NO: 14580 - protein, 762 aa, Actinobacillus capsulatus
MEDYTVHSFYAHSGLLEDHSDWQTLLSHANNVGLLAAEFAAPFASQEIARCTGLLHDLGKYSARYQKRLHGGERVNHSTAGAKIAVDRWGPLGKMMAFCIAGHHAGLANGSGEGKNRSTLTQRLQEQFGHTHKDLPVLDAIWQQELNLPEKLPLPPLKPSKNEPFFSYAFFIRMLYSCLVDADFLDTEAFYANLEKRPLERGNYPNLTALHQQFNQFIAQFRERIATQTPNTQEAQRKAEVNCLRSEILDYAVTQATQETGLFSLTVPTGGGKTFTSMAFALEQAKQHGLRRIIYVIPFTSIIEQNAAEFRKAFGELGESSVLEHHSTFDHDSLPDKSSRDKLKLASENWDAPIVVTTAVQFFESLFADRTSRCRKLHNIAGSVIILDEAQMLPLNLLRPIMAAIDELARNYQCSVVLCTATQPAIHQANGFYKGFENVREIAPNPTALFEKLKRTTVKHIGIQTDAELQTKLADNPQMLIIVNNRRHARALYDSAKHLDGTYHLTTLMCAKHRSQTLEEIRLRLKQNLPCRVIATSLIEAGVDVDFPLVMRAEAGLDSVAQAAGRCNREGKRLAEESNVWVFQPEEQWKAPSELGLLSGCMRSTVHTHAEDLLTPQAINHYFQAVYEAKGKELDKPNILKACYDAGQSLNFPFQKIADDFQMITSHLIPVIIPFDQEAKNFIDHLRYADQVGGILRKLQPYTVQIPEKALAELYNAGRVEAINEVNFGKQFYSLIGMDLYDEVAGLSWGNVDFLEAEKLVL

SEQ ID NO: 14581 - protein, 711 aa, Phocaeicola barnesiae
MGNSYDYILAKHEDNGLIPLSEHLLLVAIAAESIARNIGLDASLARKGAILHDIGKASSVFQKTLKHGYVRPCDFIFRHEIASLFFLSILEEEERKVAIEMIVAHHKSIYKDIHELGLLDLEDMEDSFGIHSKDFTSWVPDALGILSSLGLAVHEITLDEAEDNYNYALSYCEKIGLGFSVWKGVLMGADHLASALGDKTEDEIGKLFILPDLSFYCRQNSLYPLSLCKVDDARKHTLVTAPTGAGKTDFLLRRCKGRIFYTLPFQASINAMYDRLKSDLKDTNAQIHLLHAASNLKLEQGKWEERIMQKHIGASIKVMTPHQMASIVYGVKGYEAMLADLYRCDVILDEIHTYSSEIQAIVLRIIEILANIECRIHVGTATMPRILYNRILEILGGPSQVYEVYLSSDQLNEFNRHVIHKINELEDALPAMEKALSDNNKILVVCNQVKRAQAVYLSLQTDYPDIPIMLIHSHFKRIDRQHLENSLKNHYNISKEACIVVSTQVVEVSLDISFDMMITECAPIDALIQRFGRINRKRSRETIGHYKPIYVMAPYTGNDALPYDEEVLQRSYAVLPNGTVLEENKVQQMLDEVYPDTRFMNIDYSGVIFKDNQWILKKLCHRAKSTLLEALNINSVSCILESDVESYKEGDSGERTKMEIPMSFKSVGFNHLQVVKVGTYPFVVPDKSYTESMGLDLAYAKPEYYKQFEML

SEQ ID NO: 14582 - protein, 735 aa, Campylobacter ureolyticus
MLYSHPKKEYKNHIKNLVDSFDDKEFAKCAFYHDFAKQSDNFQKYITLKKENFNTKEEFEKERNRLKTTHSLESAYIYFFMQNDKNIDFIINLCAILKHHSNLENFESMLNYLTCIENNLNSDENISNITSSLKVADLKDFLEIIQKDKIYEFADFFDDILDEVKNFFKIENFFKFKDRYSKLILADKFEAIFDEPYKDFDFISSKICENIIQNIHAQISNKPPNNYKNSSRKIIFKNYETNKDKDKFIIKAPTGIGKTYIALELALKIATQKPKKRIITAIPFTSIIDQTFLEYEKVIPENLGLLKYHYLSKYTDDEKEQFSKKIFLADIWHEPLIITTFNQLLNIFFSNSNKDNLKLQTLKNSVIIVDEIQNISRVLLQDLAFVFNEFSKIYNIDFIIMSATMPHLNLENFTIISESDFYKSKQNRYKISFFDEIKNIKDLVCVLNSQTKSTICVVNTIAKAQAIYKELKKDENLYLLTTHQTPKHRIELLKEIYKKLEEQKPVKLIATQLIEAGVDLDFSVGFREFAPFTSIVQMAGRVNRNGIKSKISECFVFDFLEFENVDKKLPYHGIDLQEEFVKNSLKNGIYENEIFEILEEYFKRVKDETTHTKINEKMRKLEFTTIYGDFTANFMPKQPWKVSVFIEERKDEFKEFIEKRDNILNSYDDKFEALAKIKDLEKTLLGQTININHKLIENLQLKEIFGRYILNFGFKNYTKEFGFTTDLTIKEEAFS

SEQ ID NO: 14583 - protein, 656 aa, Arhodomonas aquaeolei
MLLAPTAGGKTEAAILPVFSRMLSEHWTGLSVLYLCPIKALLNNLEHRLRMYAALFGRSVGVWHGDIGASTRKKLRRQPPDILLATPESLEVMLDSALMDHRTFFASLRVVVVDEIHAFAGDDRGWHLLAVLGRVGQLTPHVIQRLGLSATVGNAEGLLNWLTKGTTSGSRRVVSPEVAETRAPDVTLDFVGGLDNAALVISRLYLGEKRLVFCDSRQQVEELALRLRELGVTTYVSHSSLSQDERRRAEDAFADGRDCVIVATSTLELGIDVGDLDRMIQIDAPGSVASFLQRIGRTGRRNGQRNCLFLATTRAGFLRAAGLLHRWREGYVEPIVPPPYPVHVLAQQILALVLQEGGLVRSEVQRALQPFLAATEIAPEEYQKLLDHLLSEKVLFEVDGLICLGDEGERRYGRKNFLELFSVFLAAPLMSVMHGRSEVGTVDMASLFPIDAQPIVLTLAGKGWRVIHLDWKQRRVWVEPSDRRGTSRWSGAPPGLSGAVTQGVRAALVEPGINDLLSNRGQDALQEAREEFDWLDMKGSYLIDGIAGVSWWTFLGASANTAIAAALKNQGSSCTADAWRIRFKPPMDATEQSLADCIRSLNADQLTVPIEACERRYKFSDLLPAQLGAKFARERGAKARREEIDWLLPIVRVRVE

SEQ ID NO: 14584 - protein, 812 aa, Salinispora fenicalii
MDQVLDRVLAKSARLGRPAELLIEHLDATLGAAVDLRRRIGPIAVTEPVLGERFWPVSLLAALTHDTGKVPAGFQAMVTGGGLWGERHEVLSLGFLPPLVPDGGMLLWVAEAVVTHHRPLTSPTGAGLRSIMTLYGGCTLTDFRERFGPVDPVVAAALERWLIHAGGDLLAADRADDTVTGPDVVARAHQVLTDVLGRWRRRRATADEGLTAILLQGAVTLADHLSSAHGTLHVTQPIGPGFSERLRQRFSENGRRPYPHQEQSGALRGHLLLRAPTGSGKTEAGLFWAARQVTDLIAAGAGAPRVFLVLPYLASINAMADRLVGVLGDRELVGVAHSRAASYHLATAIDEAASTDPDTPGQDGSLPLYAARKAVARRAATELFRETVRVGTPYQLLRAALAGPAHAGILLDSANSVFVLDELHAYDPKRLGFILAGAGIWVRLGGRVAVMSATLPAVLADLVRDAIGDPVELVTAPAGLTLPRHRLRLRPHHLTDEEALREARAHLTAGRSVLMVANNVADAQTVFDALAADAIAAHGPDGAILLHSRFRRMDRTRVERKIIDRYGAHRTDCGRRFPGLVVATQVVEVSLDVDFDLLFTSGAPLEALLQRFGRINRAGTREPADVVVHEPSFGPRRGEGRQVDYADGVYDSEPTHAAMRILHQHADLAVDEEHATKWLDEIYASTWGQEWRHQVDTARVDFQQAFLTFKRPYDDRSHLADAFDSMFDGTEAVLLEDLPEYEAALTSAAGRAEGRLLAADWLIPLPGWAVGLSRLDRSLGVEIIDGDYRPDRGLTAIRGAVGANRYQPGEVI

SEQ ID NO: 14585 - protein, 796 aa, Salinispora pacifica
MGYPQLARRVSDRLAYRVAQIVGGHHGRFQQTSGPHGGRAQLGKGGWSKQRAALVRVVHEALGSPERPPAIGAAASVLVTGVVILADWLASQEHFLRQQSSRVPQYTGAEAASTHLAALSAPVAALLDDAGLGSPSFRAVGFDDLFPHRPNALQRSIIEELLPVVDSPGLVVVTAATGDGKTEAALVAAKRLAEVCGAHGFFFALPTMATSDEMYRRVRAFAARLAAGPAPVTLLHSMSWLNAEYEARAVVDPGGAAEVVSDEPSGDVVAPEWLRGPKRGLLAPMAVGTVDQALLAVLTTKHNALRLLGLSGKVFVVDEAHAYDDFTTSLLCRLLNWLGAYGCPVVLLSATLPSSQAATLVGAYEEGAGVGPTNTSVPYPGWTFVPAIQGRATVSISPTMREALVSGRTVEFTLDVRPVRHLVGPESDPADRRAVVRQVLAPVVEQGGCAAVVCNTVNDAQQTYRVVRDWAPGGVEVLLLHSRFPARRREEITTQIVGRLGKDGNRPRSMIVVATQVLEQSLDLDFDLLVTDLAPMAQLLQRAGRCHRHRRTRPPWAAQPRVVVLDPQGPDGVEHVRPAAWRDVYARYLLRATHLRLMGVDMIAVPHAVQGHVEAVYVPQEIHNDPVLSSEHNEYRAQAMAERGTAELGVIPEPVGLADLVALSQTETPEWRASTRLGAESERVLCCYRDPDGMQWLDPQGRIPLPQRGSGPDGRFRSEEVRAILQETIPLRADILAGYDPPAALPASWGNNAWLKRIRPLWLPILPTGPGPAAWARRSVHLDPELGLVVATAGAE

SEQ ID NO: 14586 - protein, 796 aa, Salinispora pacifica
MGYPQLVRRVSDRLAYRVAQIVGGHHGRFQQTSGPHGGRAQLGKGGWSKQRAALVRVVHEAVGSPERPPAIGAAASVLVTGVVILADWLASQEHFLRQQSSRVPQYTGAEAASTHLAALSAPVAALLDDAGLGSPSFRAVGFDDLFPHRPNALQRSIIEELLPVVDSPGLVVVTAATGDGKTEAALVAAKRLAEVCGAHGFFFALPTMATSDEMYRRVRAFAARLAAGPAPVTLLHSMSWLNAEYEARAVVDPGGGTEVVSDEPSGDVVAPEWLRGPKRGLLAPMAVGTVDQALLAVLTTKHNALRLLGLSGKVFVVDEAHAYDDFTTSLLCRLLNWLGAYGCPVVLLSATLPSSQAVTLVGAYEEGAGVGPTNTSVPYPGWTFVPAIQGRATVSISPTMREALVSGRTVEFTLDVRPVRHLVGPESDPADRRAVVRQVLAPVVEQGGCAAVVCNTVNDAQQIYRVVRDWASGGVDVVLLHSRFPARRREEITTQIVGRLGKDGNRPRSMIVVATQVLEQSLDLDFDLLVTDLAPMAQLLQRAGRCHRHRRTRPPWAAQPRVVVLDPRGPDGVEHVRPAAWGDVYARYLLRATHLQLMGVDMIAVPHAVQGHVEAVYVPQGIHNDPVLSSEHNEYRAQAMAERGTAELGVIPEPVGLADLVALSQTETPEWRASTRLGAESERVLCCYRDPDGMQWLDPQGRIPLPQRGSGPDGRFRSEEVRAILQETIPLRADILAGYDPPAALPASWGNNAWLKRIRPLWLPILPTGPGPAAWARRSVHLDPELGLVVATAGAE

SEQ ID NO: 14587 - protein, 886 aa, Salinispora pacifica
MWDRYLAPNQRRVIAEGLATDDSHAKSLIMFWAGLHDVGKATPGFQKKDGSAFDALRSAGSYEDEVCDGSLRHDTAGQLALPDLLAPLGYPQLVRRVSDRLAYRVAQIVGGHHGRFQQTSGPHGGRAQLGKGGWSKQRAALVRVVHEALGSPERPPAIGAAASVLVTGVVILADWLASQEHFLRQQSSRVPQYTGAEAVSTHLAALSAPAAALLDDAGLGSPSFRAVAFDDLFPHRPNALQRSIIEELLPVVDSPGLVVVTAATGDGKTEAALVAAKRLAEVCGAHGFFFALPTMATSDEMYRRVRAFAARLAAGPAPVTLLHSMSWLNAEYEARAVVDPGGGAEVVSDEPSGDVVAPEWLRGPKRGLLAPMAVGTVDQALLAVLTTKHNALRLLGLSGKVFVVDEAHAYDDFTTSLLCRLLNWLGAYGCPVVLLSATLPSSQAATLVGAYEEGAGVGPTNTSVPYPGWTFVPAIQGRATVSISPTMREALVSGRTVEFTLDVRPVRHLVGPESDPADRRAVVRQVLAPVVEQGGCAAVVCNTVNDAQQTYRVVRDWASGGVDVVLLHSRFPARRREEITTQIVGRLGKDGNRPRSMIVVATQVLEQSLDLDFDLLVTDLAPMAQLLQRAGRCHRHRRTRPPWAAQPRVVVLDPRGPDGVEHVRPAAWGDVYARYLLRATHLQLMGVDMIAVPHAVQGHVEAVYVPQEIHNDPVLSAEHNEYRAQAMAERGTAELGVIPEPVGLADLVALSQTETPEWRASTRLGAESERVLCCYHDSDGMQWLDPQGRIPLPQRGSGPDGRFRSEEVRAILQETIPLRADILAGYDPPAALPASWGNNAWLKRIRPLWLPILPTGPGPAAWARRSVHLDPELGLVVATAGAVVSH

SEQ ID NO: 14588 - protein, 796 aa, Salinispora pacifica
MGYPQLVRRVSDRLAYRVAQIVGGHHGRFQQTSGPHGGRAQLGKGGWSKQRAALVRVVHEALGSPERPPAIGAAASVLVTGVVILADWLASQEHFLRQQSSRVPQYTGAEAASTHLAALSAPVAALLDDAGLGSPSFRAVGFDDLFPHRPNALQRSIIEELLPVVDSPGLVVVTAATGDGKTEAALVAAKRLAEVCGAHGFFFALPTMATSDEMYRRVRAFAARLAAGPAPVTLLHSMSWLNAEYEARAVVDPGGAAEVVSDEPSGDVVAPEWLRGPKRGLLAPMAVGTVDQALLAVLTTKHNALRLLGLSGKVFVVDEAHAYDDFTTSLLCRLLNWLGAYGCPVVLLSATLPSSQAATLVGAYEEGAGVGPTNTSVPYPGWTFVPAIQGRATVSISPTMREALVSGRTVEFTLDVRPVRHLVGPESDPADRRAVVRQVLAPVVEQGGCAAVVCNTVNDAQQTYRVVRDWASGGVDVVLLHSRFPARRREEITTQIVGRLGKDGNRPRSMIVVATQVLEQSLDLDFDLLVTDLAPMAQLLQRAGRCHRHRRTRPPWAAQPRVVVLDPRGPDGVEHVRPAAWGDVYARYLLRATHLRLVGVDMIAVPHAVQGHVEAVYVPQEIHNDPVLSAEHNEYRAQAMAERGTAELGVIPEPVGLADLVALSQTETPEWRASTRLGAESERVLCCYHDPDGMQWLDPQGRIPLPQSGSGPDGRFRSEEVRAILQETIPLRADILAGYDPPAALPASWGNNAWLKRIRPLWLPILPTGPGPATWARRSVHLDPELGLVVATAGAE

SEQ ID NO: 14589 - protein, 729 aa, Paenibacillus terrigena
MSDHPFYRLAPFIQEYIYRKRWDTLREAQVEACRVLFDTPNHLLIASGTASGKTEAAFFPALTELHNQPSQSVGILYIGPLKALINDQFERLKELLQEAHIPVWHWHGDVPQSEKTKLVRDPSGVLQITPESLEGLLMNKPNAIPALFHDLRYIIIDEVHAFMGADRGMQVLSEIARIERMAGCRPRRIGLSATLSDYATASEWLRAGSADGVEVVAPQGGRKLRLSIEHFSFPSARDEEQAEQLANASRAYFDYIYDHTRLKKALVFTNSRSDAELATLELRRTAARRQEPDVFHVHHGSISAMLREEAEAALRTGHGPAVAMATVTLELGIDLGELERVVQLESPSSCSSFVQRLGRSGRRGDMPSEMMFVIPEEEDEQAQLPARMPWTLMRAIAIIELYVRHKWVEPLSLRKKPVGLLYHQTMSVLKSMGEAEPKDLARMILSLPPFQYISPDEYQQFLQYLLQTDHLQRTEVGGLIIGLTGEKTVNNYRFYAVFQDDEEYVVYNGSEEIGSITTVPPPEYCFSLAGKLWKVIEIDRKHKAVYVKPSLGKVDTLWLGGRGDIHTEVMRKMKDVLTDDTIYPYLAPRAVNRLERARRLARESGLLEKTVIPAGGDSMFILPWIGTKPFRTLERLVKHRLADRLSLRSIVPMEPYYMVISGRADAENLLAEIQAECTHDVDPMGLLKPDESPYLGKYDEFVLPELVRLAFAEDGLDLEGLRAALRAQE

SEQ ID NO: 14590 - protein, 804 aa, Salinispora arenicola
MGYPPLVRRVSDRLAYRVAQIVGGHHGRFQQTSGPHGGRLQLGEGGWSKQRAALVRVVHEAVGSPERPPAIGAAASVLVTGVVILADWLASQEHFLRQQSSRVPQYTGAEAVSTHLAVLSAPAAALLDDAGLGSPSYRALGFEDLFPHRPNALQRSIIEELLPVVDSPGLLVVTAATGDGKTEAALVAAKRLAEVCGAHGFFFALPTMATSDEMYRRVRAFAARLAAGPAPVTLLHSMSWLNAEYEARAGVDPGDAAEVVSDEPSGDVVAPEWLRGPKRGLLAPMAVGTVDQALLAVLTTKHNALRLLALSGKVFVVDEAHAYDDFTTSLLCGLLNWLGAYGCPVVLLSATLPSSQAATLVGAYEEGAGVGPTNTSVPYPGWTFVPAIQGRDTVSISPTMREALVSGRTVEFTLDVRPVRHLVGSESDPADRRAVVRQVLAPVAEQGGCAAVVCNTVNDAQQTYRVVRDWASGGVDVVLLHSRFPARRREEITTQIIGRLGKDGHRPRSMIVVATQVLEQSLDLDFDLLVTDLAPMAQLLQRAGRCHRHRRTRPPWAAQPRVVVLDPRGPDGVEHVRPAAWGDVYARYLLRATHLRLAGTDRIAVPHAVQNQVEAVYSPQSVDHDLVLSAEYDEYRAEAMALRGMAELGVIPDPAQVADLAALSLTETPEWRASTRLGAESERVLCCYLDAGGRQWLDPERRILLPQRGARPDGRFSSQEVRMILQETIPLRTDILMGYDPPAILPASWSNNAWLKRLRPLWLPILPDGPGSAAWARRSVHLDPELGLVVLSSSEGRQPGVVSE

SEQ ID NO: 14591 - protein, 712 aa, Salinispora arenicola
MAYWLGALHDVGKASCAWQDRLAVVACTGGRVGIDHKSLGTRVAYERGLGGFAGAIFGHHGGLVDTPNLRERYRSRLAEAPGDVASAERELPGLLPDLPEQFDHLVPAQWRADPLVGEMALRLCYSALVDADSLDTSAHFQGLSGPRVRPDADFGHLYKVFEQRRRDELAGRGGTPIGSLREQVYADCLAAAERERGVFRLGAPTGAGKTLASGGFALRHAEKHNLRRVIVAVPFLTITEQNAAVYRRLLDQDGADQVVLEHHSQVDFDDPGAGRWARLAAENWDAPFVVTTFVRLFESLYARKPSAMRRVHRLANSVIVLDEVQALPHAMLAPILDGIRLLVRHFGVTVLLSSATQPSFWALDEFKDVPRTDLIHDTPKLVSDLRRVRYEWQLDPKPTLADVGDQAASEQAALVVVNTTADAKTVYDRWREIGASGVAWHLSTRMCPDHRRRVLGTVRARLRRGEHVLLVATQLIEAGVDVDFPLVFRAMAPADSLLQAAGRANREGRMADGGRVVVFAPEDGGQPPTYKTLVGCTGRQFGPDKADPDDLMALGRYYRNVYSLLNLQDVQHVGQRIQQARRRWEFETVADGPIDASTKRRDRKLAFRMISDDGISVVTPQGAGTPELRRELEQLIEELRQAPVPDLKKLRRLQAYTTNLHPNTLRQPGVTALLRPVLGGSEVRRGVLAEWVGEYDDATGINLDPSLEQFVL

SEQ ID NO: 14592 - protein, 804 aa, Salinispora pacifica
MGYPQLVRRVSDRLAYRVAQIIGGHHGRFQQTSGPHGGRAQLGKGGWSKQREALVRVVHEAVGSPERPPAIGAAASVLVTGVVILADWLASQEHFLRQQSSRVPQYTGAEAASTHLAALSAPAAALLDDAGLGSPSFRAVGFDDLFPHRPNALQRSIIEELLPVVDSPGLLVVTAATGDGKTEAALVAATRLAEVCGAHGFYFALPTMATSDEMYRRVRAFAARLAAGPAPVTLLHSMSWLNAEYEARAVVDPGGAAEVVSDEPSGDVVAPEWLRGPKRGLLAPMAVGTVDQALLAVLTTKHNALRLLALSGKVFVVDEAHAYDDFTTSLLCRLLNWLGAYGCPVVLLSATLPSSQAATLVRAYEEGAGVGPTNTSVPYPGWTFVPAIQGRATVSISPTMREALVSGRTVEFTLDLRPVRHLVGSESDPADRRAVVRQVLAPVVEQGGCAAVVCNTVNDAQQTYRVVRDWAAGGVDVVLLHSRFPARRREEITTRIIGRLGKDGNRPRSMIVVSTQVLEQSLDLDFDLLVTDLAPMAQLLQRAGRCHRHRRTRPPWAAQPRVVVLDPRGPDGVEHVRPAAWGDVYARYLLRATHLRLAGTDRIAVPHAVQNQVEAVYSPQSVDLDPVLGAEYDEYRAEAMALRGMAELGVIPEPVQAADLAALSLTETPEWRASTRLGAESGRVLCCYLDAGGRQWLDPERRTLLPQRGARPDGRFSNQEVRMILQETIPLRTDILMGYDPPAALPASWSNNAWLKRLLPLWLPILPDGPGSAAWARRSVHLDPELGLVVLSSSEGRQSGVVSE

SEQ ID NO: 14593 - protein, 724 aa, Salinispora pacifica
MARDFSAPFGGGEVTYWLGALHDVGKASCAWQDRLAVVASTGGPVGIDHKSLGTGIAYERGLAGFAGAIFGHHGGLIDTPNLRERYRSRLAEAPGNVASAERELPGLLPDLPERLDHLVPAQWRDPLVGEMALRLCYSALVDADSLDTSAHFQGLSGPWVRPDADFGNLYKVFEQRRRDELAGRGGTPIGSLREQVYADCLAAAEQGRGVFRLGAPTGAGKTLASGAFALRHAEKHGLRRVIVAVPFLTITEQNAAVYRRLLDQGGADQVVLEHHSQADFDDPGAGRWARLAAENWDAPFVVTTFVRLFESLYARKPSAMRRVHRLANSVIVLDEVQALPHAMLVPILDGIRLLVRHFGVTVLLSSATQPSFWALNAFKEMPCTDLIHDTPKLVSDLRRVRYEWQLDPEPTLADISDQVAAEQAALVVVNTTADAKTVYDRWRETGADGAAWHLSTRMCPDHRRRVLETVRARLRRGEHVLLVATQLIEAGADVDFPVVFRAMAPADSLLQAAGRANREGRMTDGGRVVVFAPEDGGQPPTYKTLVGCTGRQFGPDKADPDDVAALGRYYRDVYKLLNLHDVQHVGQRIQQARLRWEFETVTDGPIDASTKRRDQTLAFRIISDDGISVVTPQGAKTPELRRELEQLVEELRQAPVPDLTKLRRLQAYTTNLHPSVLRQPGVTALLRPILGGTDVRQGVLVEWVGEYDDATGLDPDPSLEQFVL

SEQ ID NO: 14594 - protein, 810 aa, Salinispora pacifica
MDQVLDRVLAKSARLGRPAELLIEHLDATLGAAVDLRRRIGPIAVTEPTLGERFWPVSLLAALTHDAGKVPAGFQAMVTGGGPWGERHEALSLGFLPPLVPDGGLLLWVAEAVVTHHRPLTSPTGAGLRSIMTLYGGCALTDFRERFGPVDPAVAAALERWLIHAGGHLLAADRADDTVTSPDVVARAHEVLTGVLGRWRRRRATADEGLTAILLQGAVTLADHLSSAHGTLHVTQPIGPGFSERLRQRFSENGRRPYPHQEQSGALRGHLLLRAPTGSGKTEAGLFWAARQVTDLIAAGAGAPRVFLVLPYLASINAMADRLVGVLGDRELVGVAHSRAASYHLATAIDEAASVDTPGPDGALPLYAARKAVARRAATELFRETVRVGTPYQLLRAALAGPAHAGILLDSANSVFVLDELHAYDPKRLGFILAGAGIWVRLGGRVAVMSATLPAVLADLVRDAIGDPVELVTAPAGLTLPRHRLRLRPHHLTDDEALREARAHLTAGRSVLMVANNVADAQTVFDALADDAIAAHGPDGAILLHSRFRRMDRTRVERKIIDRYGAHRTHSGRRFPGLVVATQVVEVSLDVDFDLLFTSGAPLEALLQRFGRVNRAGAREPADVVVHEPSFGPRRGEGRQVDYADGVYDSEPTHAAMRILHQHADLAVDEEHATKWLDEIYASTWGQEWRHQVDTARVDFQQAFLTFKRPYDDRSHLADAFDSMFDGTEAVLLEDLPEYEAALTSATGRAEGRLLAADWLIPLPGWAVGLSRLDRSLGVEIIDGDYRPDRGLTAIRGTVGANRYQPGEVI

SEQ ID NO: 14595 - protein, 848 aa, Thioalkalivibrio
MDTETLVSFFVYSLALHDLGKFARSFQGLARPQVPFLVQPAALPYNERHDSLGAQAWYEKLLIPRLNDRQQAGASRLDLMDEEDALRLWMGCFFGHHGKPVQGGSAPLSAAFLEEDLRALEAFSRAAEGLLQPAWPSELLGDEAWRKEALAPASWQIAGLAVLADWLGSNADIFAYQAEPVPLQQYWNETALPRAHQALAETGLLHRPGPVSYPGFTSAFGFQPTPLQAWAETAPLAEGPQLFLLEDITGAGKTEAALTLAHRLLAERQHEGLYFGLPTMATSNAMYRRLGGYYRRLYPPDTEPSLILAHGARDLNEAFRQSVVLSTSDDAPYTRNEDSAGSACRAWLADNRKKALLAEVGVGTIDQALLAVLPRKHQPLRLLGLAGKVLIVDEVHAYDTYTSGLLKALLDAHARQGGSAILLSATMPRVLREDLVGAWQQSRGENTAGTLNNDSFPLATHVRGAEVDETPLAASPFSGRNLPVEFVHTTEEALDIVVGAAREGRCACWIRNTVDDAIAAYQQVSEQLTSPEQAMLFHARFTMADRQRIENAALQRFGCDSAAADRQGQVLVATQVVEQSLDLDFDVLVTDLAPIDLVIQRAGRLHRHRRDTRGNRVDHTHAGEDRPAPALHVLAPEWTDTPNPNWLPPLLRGTGYVYPDTAQLWNTCRILREEGAIRLPERARVLLEAVHGGTRVLPEGLEDTHYGHYADQNVARSVARFNALRPEQGYQIPLDGAGWDDDQELGTRLSNEKTISVALVKETDGHLLPMHEHERHPWAMSTVQLRESQARRLPPLPQALESEADLLREMHRFLRGTVFWLPDEEDASRYDTTLGAIIARGSGRGESV

SEQ ID NO: 14596 - protein, 847 aa, Paenibacillus massiliensis
MSYELFDVVYSCFDKMIGVSHTNYIAHIRESDKTIQTVPEHLSGVREYAEQAGSKIGFRHFAGLTGLLHDLGKNTEEFLTYIQQAAASTKLEDAPRRGSVDHSTAGGRLIHSRYHTKDAKPEHQYTAEWLANCIISHHQGLRDYIPPDGVSPYLERVEQRMLKQYEEAVDEFFRHVPPHELDELFALATDEFKQYLRSIREHQLPPIVATLLLKYIFSCLIDADRTNTRLFEEEKADHSEALSQVTDSPRKHHSFFLSSYEALMAHLHELDQQQEGNPQIKRLRQEMSEQCEKAAYRPSGTYTLSIPTGGGKTLASMRYALRHALETGKDRIIYVVPYTTIIEQNAKEIRKILGNEDMILEHHSNVVDHSDDERTAEDDGEVYETRRKQTKLARDHWDRPIIFTTMVQFLNTFFSSGTRNVRRLHRLANAVLIFDEVQSVPVHCISLFNSALNFLQVVGGASLVLCTATQPALNYVKHELRLSPDAEMIKGLSDVEQSFRRVELVDLATDAPSGWGAEQISEFLQEQMCEVNNALVILNTKAAVRKLYSQLQSADWVREQNIRVVHLSTNMCAAHRKYVLSDEDTGLIPSLEHERIICISTQLIEAGVNISFECVVRSLAGLDSIAQAAGRCNRHGRDVIRKVYIIRCADENLTRLREIQIGADTTEDVLREYRGKPELLLSAEAMRLYFEKYYCQVQQKMHHPIPKLEQNLFDLINTNAYYKDSYLNRNGTLGNLKNTAAIATADRYFEAINSHAIPVLVPYEEGKNLILDLNGELPHGPDVLGDLFRKVQLYTINIQRHQLDRLYKEGDAYPLLHGQAWALAETAYSLEYGLTLESEGEWGSMVL

SEQ ID NO: 14597 - protein, 717 aa, Paenibacillus massiliensis
MKVAVYVHREETSWRLCISLAMSMDVWWWLDGGFQRAGYLIMLGDRIPLPWAIQLRESFRSLAVMDNWKEREWNGWMVRELKGELESLSESGEDHHLGEKYILYPAGREVSRYSQSYQDGDGSPRMGTNLLRDAQYFSQIMEGRQLFADEVKTLWEQNGIHNEDENKRIFPNSIQSSSQMGLSWQEAAQLAYLQGTIHYDTGIASQITGVRRASRMNRSSGRPHCRRCGTATVESTPCASCGLSACAYCAACRTMGRSRACSLLLYHEEHKQTAFLGGNLGVPGSMKLDKWGLSPAQRAATTRALQFLASPKDTNPVGISVERTGSKDKNDEAPYFVDWRMGWRRFWSRASSHTSEEGIRLECLRLLIVGSRDPDQHRRGQSQLQDQGRFLLWAVTGAGKTEMIFPLLDYVVSRGGRALVATPRRDVVLELAPRLEKAFPHIRITVLYGGSTDRWGSGQITVATTHQLMRFRSAFDLVIIDELDAFPYHNDPMLAHAAATCCKQKGKFVYLSATPPLKLQQEVQRGLLPYAKVPARFHGHPLPVPVRISGSSVAKCLQQRRLPKGLLSSLQISLKRGAQIFVFVTRIAQIPSLVHLLSTYFAGISIAGTSSEDEHRADKVKAFRAATIRMLVTTTILERGVTIPRSDVYILDADNGLFDEASLVQMAGRAGRSKEDPAGKVIFVSPEWTRAQRQAIRQIQSMNELAHRGGYLKKMGG

SEQ ID NO: 14598 - protein, 712 aa, Salinispora arenicola
MAYWLGALHDVGKASCAWQDRLAVVACTGGRVGIDHKSLGTRVAYERGLGGFAGAIFGHHGGLVDTPNLRERYRSRLAEAPGDVASAERELPGLLPDLPERFDHLVPAQWRADPLVGEMALRLCYSALVDADSLDTSAHFQGLSGPRVRPDADFGHLYKVFEQRRRDELAGRGGTPIGSLREQVYADCLAAAERERGVFRLGAPTGAGKTLASGGFALRHAEKHNLRRVIVAVPFLTITEQNAAVYRRLLDQDGADQVVLEHHSQVDFDDPGAGRWARLAAENWDAPFVVTTFVRLFESLYARKPSAMRRVHRLANSVIVLDEVQALPHAMLAPILDGIRLLVRHFGVTVLLSSATQPSFWALDEFKDVPHTDLTHDTPKLVSDLRRVRYEWQLDPKPTLADVGDQAASEQAALVVVNTTADAKTVYDRWREIGASGVAWHLSTRMCPDHRRRVLGTVRARLRRGEHVLLVATQLIEAGVDVDFPLVFRAMAPADSLLQAAGRANREGRMADGGRVVVFAPEDGGQPPTYKTLVGCTGRQFGPDKADPDDLMALGRYYRNVYSLLNLQDVQHVGQRIQQARRRWEFETVADGPIDASTKRRDRKLAFRMISDDGISVVTPQGAGTPELRRELEQLIEELRQAPVPDLKKLRRLQAYTTNLHPNTLRQPGVTALLRPILGGSEVRRGVLAEWVGEYDDATGINLDPSLEQFVL

SEQ ID NO: 14599 - protein, 750 aa, Halomonas zhanjiangensis
MPPETVHFYAHSLPEVGKQNWQALDDHLKCVAEMAATRAERFGMADAGYAAGLLHDLGKYSVPFQRRLEGFPERVDHSTAGAIIAKQQFRKGVGDLLAYCIAGHHAGLANGRDSGERSSLDDRLNAEIPAIDSAWQHALTLPAEPAPPSTFTQLPERAFFQLSFLTRMLFSCLVDADYIDTETFYARHETGLTHPRGGGASLKQLRKALNEHLETFDTEKGINRLRGHILREVRQKADTKPGCFTLTVPTGGGKTLASLAFALDHAIAHGMDRIIYVIPFTSIVEQNAAVFRHALGQYGAEAVLEHHSTFEAEKTTKGDKTSLDKLKRDSENWDAPIIVTTSVQFLESLFAAKTSRCRKLHNIARSVVILDEAQTMPLPLLRPSVAALDELALNYHTSIVLCTATQPALIETDDPEHSFAGGFKNVEELAPHPKELYRDLQRVTVRHIGSLDDAQLRDELLAVEQVLCIVNNRRHARVLYESIADQPGAFHLTTAMCAAHRRQVLHHIRETLKEGKPCRVVSTSLIEAGVDVDFPRVLRAEAGLDSIAQAAGRCNREDKRSAEESEVRIFATANEEWAPPPELKQFAQATREVLRQHSHDPLALEAIDAYFKLLYWQQGADQLDKHQLLSLIEKGRLDGLPFETLEKKFRLIDNNQRSVIIPFDTDASKAIKELAFATGAGGIARKLQLYTVQVPYNGFRALEKVGAIAPIERDKFNDQFMLLVNEDLYDNALGLNWSDPTFMRAESLQW

SEQ ID NO: 14600 - protein, 744 aa, Prevotella
MERSILLAKSNPKISLNEHIDDCLSICRQLSMVISNIPVEDKASFWNIVRKSLIMHDTGKGHVEFQKTLLGKASLWYHQRHELFSIYFIHNSNLSESEKTLVSFGVLGHHKSLGDLFDFVNRNYYNDEDWDEEGLSYADECDKLCYEEIKEILDRYELNLITKNVPCIKSILRLAKNKNIEGKANIENILFIGAIKHCDHMASAGIKHLYRLEKTDFAFLYKYPFFTHQLRDAEASCSVILNAPTGAGKTEAALVWLKNQLEHRGQGRVYYILPYTASINAMYKRLNSCIGDSSKKVGLLHGNLMQYLDLQMENHSIDTIKLQEQVEDFKSMLMPLKIVTPFQLLKHLFGIKGFEKGIFEWSGGYFIIDEIHAYEVKIFAQIIVLLSFAVQYLKVRVHIMTATLPTFMRCKIASVIGPYQEIIADKQLYLSFRRHRLFCLDGLLTDYLDNIQVDINQGKKVLVVCNTVDESQMVYKYLHASKKVLLHGRFCAEDRFKNEVKLKEDDVSLLVGTQAIEISLDVDFDLIYTAPAPLDALLQRFGRVNRKREKGICPCYVFKERNDADKYIYKNAGVIERTLEVLKQIEQDEGGIIQENKLQALIDVVYPCWSEEEQEDFSMTKTLFEDYVEKDLRPLEYSAEREEEFYKQFDDKKVIPAALVPEYQSRISNLQFVKAEGLLVSISKRRFANMLHEGNIEQKTFVYSKNEDKQIISIKQYVINSEYDERLGLVFSETEKQIGGDIFL

SEQ ID NO: 14601 - protein, 778 aa, Coprothermobacter platensis
MGERNNSASNNLYSHPQKLLAEHLLNVANGTKQILQESIPDSYTYKDTVIKAGYLIGLTHDLGKCTTHFQEHLFKGKKGDITYHSALSSLFSFYIVKNMLDKEQIPDDLRTVLEALSVVLVKSHHGDLDNAIEVLESCYESVVLQQINAISQSSLEQLFRTIHLENWYPAKISTETLKNWYRQANEKDLVCLVPCLIDTLNSQEKPTYYVLSNMMFSALIEADKMDATIGSMVSVPDYSVSIDTIEQYQGNLARRPLSNLREQAYKEAMSNIDTVIQQGLPHRLMLLTLPTGLGKTITSFAVANRIRTTLNKPYRIIYAVPFINIIEQNADVFSNLIKTQYGREPTSDMLLLHHHLGDVYYKTDEKDYDVNKSSILIDSWNSSNIVTTFVQLMHTLIGRSNSMLMKYNKLANSIIILDEAQALPLGYWKLTSKMLNETLEELDSYAIVMTATKPLYFEGVNLVNNKYDIESRYTLDASTYIGISSMEQFAEQFAIEPDKSYMFIMNTIREAETMYELIKSKIPSEQIGFLSTHIVPKQRREVIEKAKNGTFRILVSTQVVEAGVDLDFDVVVRDFAPLEALVQSAGRCNRNAVREKGMVFATNFADEANNNKPFALYIYDKTLLDLTEELVKGKAIEEENISGLFEQYLCKVEQRKDTDTVSDRIYKDIMELNYSGIEEFKVIKDEHPQVDVFVELDDEASEIWSEAEKLGNIENPFERKHKFEELKRKLYQYVVSIPADVENQPIVTDLLPYVPKGNLSDYYDPKTGYKVKGSSNTR

SEQ ID NO: 14602 - protein, 767 aa, Porphyromonas gulae
MINKESPILAKPSGITLDVHAENVIQEGALLLKGLGCTKEKYFQTTAKQIVQRVELACKYHDLGKRNKIWQDACKKDYKAYLIWKKIHPNRSFEDYTIECREEAGKFLRQTHVRHEFYSIKGLLNNNPPPWLKIAIAAHHRKLSMKHEERWLSSDEDICSVWKDIRRLSNCFFDDRNSVLSDIVIKQYEFAGPRSLLQLADHRASAKEESKDVPDPVAFSYTFPKEWEKRPVQKLVEKHWRDELLLVRAPTGAGKTDAALLWASLQIKHRKADRLIIAMPTRFTSNALALNVSSTLSSTGLYHSSAWTQNFSSKIDNGEIALEQARYYHNQARLLQTPITVCTIDHLLSSLTLCDEEHQTITFALANACLVIDEADFYDQFTQANILVLLEVLKYWKVPILLMSASLPDNLVQEYRKIGYCIKDILEDTSDIERARFSLIEKRDVSEISQMQDLLQLSLDRGSAIIFANTVDRAQEYYQWFLENGHEEDVILYHSRYTETDKIEKEAQLLLRLGRSAWDNGRANGIAILTQIGEMSVNISADIMISDLCPIDRLTQRCGRLCRFSRKIGDLYIIRPMREGNLFPAPYYQNVGPSQKLEPNDALIKTDELLEKGMYSADNLVQLLNKVYANQTVFSTEAIYNADRLREMFKANWLINPMEHLKEEIGSTNFWRARNIMPRCRIYIKRPLQSFRNYSDFRRWETDVAIDVPIYVIKKAMRMRDTVCSRVKVIIGKDDYTLVVINAKCYNNVRGLFFSESVLEEPSFEFL

SEQ ID NO: 14603 - protein, 846 aa, Rubritalea marina
MQLTKPAGHIDQESSLQQFLEAVTAAGLDLYDHQEEAILEIFENHNVILNTPTGSGKSLVALAHHYKSFCAGRISYYTVPIKALANEKFLSLCKTFGPEHVGMVTGDATVNPSAPIICCTAEILANIALRDGSSAKVDDVIIDEFHYYSDEERGIAWQVPLLTLPQARFTLMSATIGDNEFFVDCLSKLTGAVTTLVQSDQRPVPLEFDYSEIPLSEKVSELVENDKAPVYLVHFSQRAAAESSQNLLSQNFCSKEEKHAIAEQLRDANFRSPYGKEISKLLRHGIGIHHAGLLPKYRILVEKLTQQGLLKVICGTDTLGVGVNVPIRSVLFTQLCKFDGSGVKILTVRDFKQIAGRAGRRGYDDRGYVVAQAPEHIIENIRLEAKAAASTKKKKVVKKKAPEHGYVAWNEDTFYKLENSAPEPLKSSFRLRHNFILNVLSRRHEDGCASLQAILENCHENDSSKQKLREQARKMFIALVRGGVLTIIPPSERAVSAAAPKVQLHIDLQDDFTMNQALGLYLLETVPDLDREHPEYALQVISLIEAILEDPAAILKAQISKAKGKLIAQLRDEGVSYEERMERLEDVTYPQPGKGFIYDTYNQFREKHPWVRSEGIRPKSIAREMFEEYLDFEDYIKDYKLERSEAILLRHLSEVYKVLAQTVPPNLKNDTLLEAEQYLKEHVNNIDSSLIDEWELMQNPNFLEEKAAKAKETAEKPLSQQKRKLDKLLRQKILQALKFLAYDEIDSFLQQFAPKDQNDQAWNFERIDPIIDTYFQNHHSMRLDPEARNSKNTIIKISDDQQFWQINQVISDPDELNDWSINCLLDIHTTNKLGEPYFILQSITEI

SEQ ID NO: 14604 - protein, 733 aa, Saccharibacillus kuerlensis
MSAEHPFYRLAPFIQEYIYRSGWEELREVQVEASRVVLDTNHHMLIASGTASGKTEAAFFPALTLLDQEPSSSVGILYIGPLKALINDQFQRLEGLMRDAHIPVWHWHGDVPQSEKTKVMRNPSGVLQITPESLEGLLMNRPNAIPALFGDLRFVVIDEVHAFMGADRGSQVLSQLERLSRMAGCSPRRIGLSATLGDYDSVKNWLAGGTHIPVELVSPPGGRKLRLSIENFAMPDARDERQAEALENAKKSYNNFIYDHTHLKKALIFTNSRTTAETTILEMRRIAALREQPDVFHVHHGSISSMLREEAEAALREGYGPAVAAATLTLELGIDLGSLERVMQLGAPYSCASFVQRLGRSGRREGAVAEMMFVCAEEDDEEAQLPARMPWTLLRAIAVCELYVKEKWIEPQVVRKLPLGLLYHQTMSVLRSFGEAEAGELARAVLTLPPFANFTTDQYRELLEYLLATDHIEQTEEGTLIVGLMGERVSGHYRFYAVFPDEEEHSVYDGSEEIGSITTVPPAGYCFSLAGRLWKVDEVDNRHKAVYVKHAKGKVDTLWLGAGGDMHTRILRKMRDILRENTLYPYLAPNAAARLERARRLSRETGLTERLVLPAGGDSMFVMPWIGSREFRTLERLLKNNLSQQLSLRSIVPMEPHYMVVAGRTDADELQHLILSETERMEDSMQLLDEFEAPYLGKYDEFTPPSLIRAAFAADGLDLEGLRRGLRMQDLGL

SEQ ID NO: 14605 - protein, 875 aa, Aromatoleum toluclasticum
MNQDLSEACAFGKLDRHPDGVTWHPLVDHLADVAAVFEALCTCRGIRRSLETGAGRSLDEQDIARLSTLVFLHDFGKANAGFQAKRWLNDERPRGRLSAGHGAEAVALLEASDYSEEAEGLLLRLPLLEMCEWGSPETLNNLLRASIAHHGRPIAEAPDWFNARIHWTAHDGYDPAEQLDCIGATLKRFLPRAFAEGGLPLPDTPRFAHYFAGLVQLSDWLGSETRFFRFSECGEDRLVTSRTRARDAVRDIGLDAEPYRQQLEHTLPSFADVFAAPAAYPSQAAMADVALGRVVALEAETGSGKTEAALWRFFHLFERGHVDSLYFALPTRVAATQAYRRVCDAVARVWPTSTPVAVRALSGYAAADGETAQALPDFKVLWSDEPSDADAGRRWAGESAKRFLAAPVAVGTVDQALLGTLQVKHAHLRHALAARSLLVIDEVHASDAYMGVLIEQLIAAQVALGGHTLLLSATLGAAARARYLAAGTRKALQTPTLAQASAMPYPAISDVTGLRATSGAQREKCVAWRCEDAIDDVDRVAALALDAAAQGARVLVIRNTVPAAVATLAALEASTPDASLLFGHAGVITLHHSRFSREDRPMLDMAVETQLGKKRPNGPLIVVGTQTLEQSLDLDADFLITDLCPMDVLLQRIGRLHRHLRPPEARPTPFREARVVVLAPSGGDLEPYLARPRHGLGRFRDGGGVYADVRTLEATRQLIDSEPHVRIPADNRRLVESATHPDALQAMAALGEAWAAHGQQIDGDTGARRTSAKLGLLPLDTAFAELAFPKEVKLATRLGAADRVVNFYPPPLGPFGNRIRELPIRHHLLPVGLPLEAQSEDIEAESGGFTFRLGEARYRYSRLGLERLAQPATPE

SEQ ID NO: 14606 - protein, 746 aa, Aromatoleum toluclasticum
MMTNSPASSSDAASHSFGQLDERIQRWIWQEGWTALRDAQEKAIPALVEADRDVIVAAATAAGKTEAAFFPILTHMLRHEPEIGSVLYISPLKALINDQWGRLTGLCESLDIPVVAWHGDVAASRKHKFIKDSKGVLLITPESLEALFVRRGTAMPGLMSKLRYVVVDELHAFIGAERGKQLQSLLHRLERTVGRRLPRVGLSATLGDMALAAKFLRPEDGGSVELIVAKNGGQELKVLIKGYVEKPPRSDSESDLENPQMEDLVHGSTLEVAEHLYKVLRGSNNLVFPNSRRQVELYSDLLRRNCERNDVPNEFWAHHGSLSKEFREDAERALKDGSRPATAVCTTTLELGIDIGAVKSICQVGPPPSVASLRQRLGRSGRRKGEAAILRGYCIEPELGPKSSLSDCIREGLIQSIAMVRLLIRGWFEPPLVGGLHGSTLIQQILSVIAERGGATAGELWATLVKGGAFEGFDRDDFVLLLRHMGEKQLLTQDSSGLLLHGEVGEKLVNHYEFYAAFASDEEFRLQCEGRTLGSLPVSHPLVPSQRIIFAGRRWRVLDVDTEKKVIVVTPDKGGAPPSFDGGGAMVHDVVRQEMREVLRDKAPVPFLDQGATALLSEARDFYRRANLDTVQLFQRGNEVVLLTWRGDWVNDGLAMLLAGVGLAATNEGVALTVPRVSTDRLFDALAEIAEMSVLDPVVVLADAKNILREKWDWAMPDEMLRKSYASLNLDLIEARGLAETLRLAN

SEQ ID NO: 14607 - protein, 857 aa, Megamonas rupellensis
MEADILKNLVKNLNQYKAHKKSKDNEIIYETLLAHTELTNKYFFKFWQSKNSDEIFDRFCDVFWQKENIDNKLKNKAKDLLKEIIMTIPIFHDIGKVNPNFQLMKLKVNDFKENEAYVNTHHSFLSSMFYMDYCRKLVYDEKNEDEIVNLLAEFILYNGYIIARHHSELGSLTEFTKLINLDDDTYFSKLKRIINNEDIYSVKIDFIKSDIEDMFRNLNKVDKDAEKVGKRSIKQGVYLSIYIRWLYSLLVASDYYATSEFMNEADFSENTDLNDIDKWDSVYENTDLLKNIRQYQQERYPISNEELNTVTDINILRSEIFCEVEEKIKTNADENIFYLEAPTGSGKSNTAINASFKLMQHDKRLQKIFYIYPFNTLVEQNLETLEKVFADNEDIKQNIAVINSITPIKVSEKDLNDNEEKDVYQKALLDRQFLNYPMILSTHVSLFNIIFGNRQSDVLAFYQLANSVIVLDEIQSYKNKIWAEIICYLKELAKMFNIKIIIMSATLPDLDILSRFQAQAVDLLENSSRFFAVDCFKNRVKLNYDLLKIDKDDILGELKTHLKQYLKSDKKILIEFIKKKTAHDFWVDLQENEDFKDVQIEYLSGDDSIAERKRILDKVKKATDTIILVSTQVIEAGVDIDMDIGYKNISKLDSEEQFLGRINRSCKKEGIAYFFEVDEASDIYKDDVRLSESIVLKDVNMQKILELKLFDEYYKKVLETTMGKYSYHFDEFIKDISDLNYESISTHMKLIDDTQDMVQIYLVRTLCVDGEVLDGKQIWDSYVDLWENGRKTMSYAEWKIELSRIISKMNNFIYQVSKHNLHIGKFYEQMGNIICLEDGDKYFTKDKFNREILYIKN

SEQ ID NO: 14608 - protein, 742 aa, Succinimonas amylolytica
MDTNINNLHPVILKWLNRQGWTRLHDIQEKAIMPVLKAQDDIIISAATASGKTEAAFLPACTRILSRNLPGVRIIYISPLKALINDQYKRINALGEATGISVTPWHGDIGFSHKKNLFNAPEGIILITPESLESLLINHQEWCISSFRNLTYFIIDEFHAFIGTERGYQLLSQLHRIEFMQKRKIPRIALSATLSNIKSVKQWLRPNSTGNTEIIESSAGSKGIKLQIRGYDIRKAATPEDEVKDYEYLSRDIFRLLRGSTNLVFANSRNKTELIAGTLTRLCQDNFVPVEFFPHHSSLSKDLRERLENRLKEGRLPTTAICTQTLELGIDIGDISSIAQINSPQSVASLRQRIGRSGRRDKDAVLRIFIPEIQEPENEKPALNALLRDETFSSAAMIELVLNRWFEPPTRHEYALSTLTQQVLAVTAQYGNVQARSLYRLLCKTGPFNLVDPQTFGDLLHSLGKHDLLTQMGDGCLTLGLTGEKLLSNYSFYSAFKVQEEYTIDNNGQKIGTIPLNQPLEVGDTFLFAGKGWEVVYLSDEKHEIYVRSCKEDTDPLLLDGNSGRIHDGVREKMLELYIGEKPLPYLNKTAQKHFEEGRRHFKDLNLSDNRFIIGITGIYLLPWKGDRIMHTIVQILKKHGIRRAKKIGSYIYIPEITSIRFKDTVKTILSMNPPTEEELAKSVSNLEFEKYDSFLSRELLQKAYGFRNFDVPGALEFFKTVIPMSHSPFNPRNGASYPVYA

SEQ ID NO: 14609 - protein, 810 aa, Cohnella laeviribosi
MTFIAHIREADRKIQSVKEHLLEVQRLAEAYGAKIGVRYIAGLAGVLHDMGKYTDEFREYILKAVAHPDAPPKRGSVDHSTAGGKLLYERYHTGTPSQISWLLAEVVGNAIISHHAYLHDFLDPNLESGYLKRVRDKTDLVEFEQSVERFFANVMSESAFQDYVRQAMAELEAFLAKPAPESLEGKLMFLTKFVFSVLIDADRTSTRIFEENRAEEENEPEQNHESLFAAYYDKLIAKINAFLQQDDAQTPVNRLRHEMSEQCDRFAERPSGIYTLSIPTGGGKTLASLRYALKHALLFHKKRIIYVVPYTTIIEQNAETVRRILKDEQHILEHHSNVVEETEENDESEDGRITIRQKLKLAKDNWDVPIVFTTMVQFLNTFYGNGSRDIRRLHNLCESIIIFDEVQKVPVSCISLFNHALNFLKTYGKSSLILCTATQPALDFVKHKLDMNPDGEMIRRLDQVIDAFKRVEIIDRATNERFTTEELADFVVDKIAEVQSVLVILNTKSVVRRLYCQLKGCGVPLYHLSTSMCAAHRQRILRQVQNHLKNREKVICVSTQLIEAGVDVSFDCVIRSLAGLDSIAQAAGRCNRHGKNGIQHVYVIDHAEEILDRLKEIRKGKAITQKMLVDLRRNPALHGGHLLSRQAMTYYFQAFYKEEEADLDYPIPKLGVAMTNLLLADRKHNPFNSAYVAKHEASIPLFIVNSYRTAAEHFRVIEDATASAIVPYGEGRRIIAELSSNLTITDLSRRLREAQPYMVNLFPFERQQLERNGGLVCLLDGNVLALRESAYHEEFGLDLDNDSGFDLSLY

SEQ ID NO: 14610 - protein, 712 aa, Salinispora arenicola
MAYWLGALHDVGKASCAWQDRLAVVACTGGRVGIDHKSLGTRVAYERGLGGFAGAIFGHHGGLVDTPNLRERYRSRLAEAPGDVASAERELPGLLPDLPEQFDHLVPAQWRADPLVGEMALRLCYSALVDADSLDTSAHFQGLSGPRVRPDADFGHLYKVFEQRRRDELAGRGGTPIGSLREQVYADCLAAAERERGVFRLGAPTGAGKTLASGGFALRHAEKHNLRRVIVAVPFLTITEQNAAVYRRLLDQDGADQVVLEHHSQVDFDDPGAGRWARLAAENWDAPFVVTTFVRLFESLYARKPSAMRRVHRLANSVIVLDEVQALPHAMLAPILDGIRLLVRHFGVTVLLSSATQPSFWALDEFKDVPRTDLIHDTPKLVSDLRRVRYEWQLDPKPTLADVGDQAATEQAALVVVNTTADAKTVYDRWREIGASGVAWHLSTRMCPDHRRRVLGTVRARLRRGEHVLLVATQLIEAGVDVDFPLVFRAMAPADALLQAAGRANREGRMADGGRVVVFAPEDGGQPPTYKTLVGCTGRQFGPDKADPDDLMALGRYYRNVYSLLNLQDVQHVGQRIQQARRRWEFETVADGPIDASTKRRDRKLAFRMISDDGISVVTPQGAGTPELRRELEQLIEELRQAPVPDLKKLRRLQAYTTNLHPNTLRQPGVTALLRPVLGGSEVRRGVLAEWVGEYDDATGINLDPSLEQFVL

SEQ ID NO: 14611 - protein, 632 aa, Streptomyces prunicolor
MRRVVELWGLPEPEGLPWHEVRLSPEAVVGLAGLTSVSDWIASARAEEDYVGTDVDLASYLVQARQVEVKKVERLAWRPWRPAEDTRFRSLFPEERTPHPVQVAVEDVVSRMRGPGIVVVAAPTGEGKTKAALQAAATLVRRFGLRGFYVAMPSRVTSNQAFDVVDQLLHGQEAPPVRLLHSTAGEYLKARPAEADAAEAVRPVGVDVDGGSDGDGDAAEWFAHKRGLLAPLGVGTVDQALMAALRSSHVFVRLSGLSGKVVVFDEVHGYDVHMSTLMDRLLWWLGKMRVPVVLLSATLPARRQHTLVESWRAGASGEMPHEPSPSELHAGAYPRVTWADTETHAAETVEVEASSLNADRVVELVRVDFEKRAEWAVQQACLDRCVAVVHNVVRHAVDAYEQIVERVDQLPPEERPEVFLLHGQLLQAHRARVETQIRTKFGRPDDRGTAERPLRAIVVGTQLLEGGLDADFDVMISALAPIDSLIQRMGRIQRHRRGGDRPGLLMALTGVEEKRKRIVFPPYTTHVYAESVLLRTWALLRDRTRLNCPHEVQQLVDLVYGPGEALECPQGREDQWVKAAGQLGRSIARKEENAQAVRLPQPRDDVQLWELTAKATGASRTRQESYQRDEGR

SEQ ID NO: 14612 - protein, 915 aa, Peptoniphilus senegalensis
MISKFFWAKKEEKDGLFKWLPLRQHLEDTRNVICGLWEHYLSLGQKNFIIDSLSFNSIDISGEEIGKNLSIFLALTHDLHKCSPVFQTMPGYKNSSDLDDYLIERLESYGFYDLKNFDRVSSKMSHHALGSECLLSWYGVGDDVASIVGAHHGKPIDSARIIDIQKSSYASNYFQYEDENNEVHKKWDEEQRKIFKYAMDEAEFKSIEDIPKISQEGAFILSGLLIMADWISSNENYFPLFDIEIFEPEDNYKRFVEGWSKWYKNDPININNFSETKDIFKSRFGFDSPNEIQERFVDAISRAKDPGLIILEAPMGIGKTEASLAAVEELIYKTNRSGLFFGLPTQATSNGMFTRVEDWLKNLSKDLELNTSIRLSHSKASLNDDFTSLAKNVEPENEEGSVIINEWFSGRKQTALDDFIIGTVDQFLLLALKQKHLALRHLGFSKKIVLIDEAHAYDCYMMQYLNEALRWMGAYKVPVIILSATLPKNRRLELVENYMRGRGLKWKEVKKPEEISSTAYPLITYTDGDEIKFQNNFSKRENKEIKVIREDKENLLDLLSQLYENEGVIGIILNTVKDAQELARECEKLFGSESVELLHSNYIATDRIERENLLLSLVSKNAKRPKRKIIIGTQVIEQSLDLDFDVMISDLCPIDLLIQRVGRLQRHDIKRSEFYKNPRLYVLGTSENFEYEKKTKAIYDEYILMMSQYFLPEVIKIPEDISILVDKVYEGGEVDLKEDLLKLIKNSKERRDININNKKERAKTYRLGKPDHTGKKTLIGLLETPVPLDTEEIGYARVRDIDDTIEVIALKKVSKGYGSFRDDFDLSMNLDNPDTAKIIARETLRLPLVLSKFPKAFDNTIKELEEYNKKNLSKWQEKTWLRGSLGIIFDEDNSFILNGYKLRYDKKFGLLYERV

SEQ ID NO: 14613 - protein, 803 aa, Bacillus massiliosenegalensis
MEYIAHIREKDGKIQTVREHLDEVRQLCEQFGGKIGLQHLAGLTGLLHDLGKSTEEFYDYIQAAVANPDNPPPRGSVDHSTAGGKLLYSKFYDDAQDPIVKLTVEWLAMCIISHHSGLRDFLSSDLTSPFLNRVKEKDIKEFDNARDTFFNVQIDESNFDDYFEKAKNEVVHLLKKFREDKLKPFTFSLIVKYIFSALIDADRTNTRVFEEDENEESAFDSDVFFEESYYSLMERITSFQVSEAASHPINQLRNEMSEQCEAFASHPSGIYTLSIPTGGGKTFASLRYALKHAVKYKKERIIYVVPYTTIIEQNAKEVRDILKNDEFILEHHSNVIEESGYENEDYDLKTKKLKLARDNWESPIIFTTMVQFLNVFYSRGTRNARRMHNLANSIVIFDEVQSVPIKCISLFNEALNFLNGFCNSSIVLCTATQPALDFVENKLHVSTDAEMIKDINLVNRSFKRVNIIDKTTPSGMNAPELTNFILTEMETVDNVLVILNTKTAVRKLFEELKEHKEYELFHLSTNMCPAHRKNILQRLKDSLSKKRRVICVSTQLIEAGVDISFQSVIRSIAGLDSIAQAAGRCNRHGEDVIRNVYIIKSADEILTKLREIRIGSEQTARVLEEFKGNPEMFGNDLLSQEAINIYFKYYYYQIQNELDYPIPTIEKNLFDLLNFNQDYFSAYFNKNNAKFPLISRQSFAIAEQYFQVIDSPTTSVLVPYNFEAREIISKLNGEVDSNELSSILKRAQQYIINVYSPELEELSKAKNIDLLFHGSVYALKEVAYSEAMGLDPKGNGIWSLEMY

SEQ ID NO: 14614 - protein, 444 aa, Staphylococcus delphini
MFGDSFRDIYITAATGAGKSVMFQLPALFLANKYKDDKPLTLVISPLIGLMNDQVENMRSKGINSSATINGNTPPYEKENIIEGIQNQIIDVLYLSPETLQARSDIKMLIGDRNIGVVIIDEAHIVTTWGKSFRADYWYLGIYLARLRKEYKFPIVTFTATAIYGGREDMYLDTRNSLNMISPISYFGYVRREDLFMKVHSRQKDLEKEGRDYRHTKNSLALKHMKEAIEKGQKSLIYFPTVKLLLDFYNFVCLNKPDIKGKVGKYFGTLQKEEKDEVLREYKSGDIQFVLATKAFGMGIDIPNINNVYHYAPTGNVVDYIQEIGRAARDKNKVRYGFGVIDFLPKDMNEVKRLQGMSAIRKSQIIEVMKKVLSVYKEKGNNRNVIISPEDFKYIFVQNKRDEDTLDNKVKTVLLMIEKDFSSPNKLGYSPFVARPRSLFGNDL

SEQ ID NO: 14615 - protein, 725 aa, Stenotrophomonas maltophilia
MSQSSAFHLLHPEIQRYLWAEQWEALRDVQEMAIPLILPGDRDVIVAASTASGKTEAAFLPALTHFLERPAPGLIIYISPLKALINDQFGRLERLCENLDIPVWPWHGDIGATSKQRFFKKPLGVLLITPESLEAMFCNRGTAVAGIFKSLSFLVIDELHAFIGTERGKQLQSLMHRIELVTGRTVPRIGLSATLGDLSSAACFLRANGQAAIVDAPGTGSELQLVVKGFEEPIPQAGTQSGDSSSKAIAAHLYANLAGSSNLVFPNSRREVERYTYLLNELSEGAKRPREFWPHHGSLSKEIRTDTEAALKQKERPATAICTNTLELGIDIGAVKSVAQIGVPPSVASLRQRMGRSGRREGEPAILRAYVVENAIDAESGLPTRLRLDTVHAIAVVHLLIEKWFEPPIVNGAHMSTLIQQLLSAIAQYGGLQAAQAYSMLCAKGAPFDGISSAAFIELLRHLGQQDVLIQDGSGLLLHGPVGDKIVNHYSFYAAFTVDEEFRIIAGGKSLGTLPISQMLTVGQRILFGGRTWLVEEIDEAHKTIYVAPSKGGTPPLFNGSGGRVHTKIRQTMRALYRGQVEPRFLDATAQRFLNEGRATYAKHSLDSALLVNQGSEWLLLTWLGDDANEAIACLLNAKGLRAQSGKLGVEIKRGSETTDEIAKLLAEIASQPPPAIDTLLAEAKNMASQKWDGLLSPTLLRKSYASLHLNLDEATEWLGASIKS

SEQ ID NO: 14616 - protein, 842 aa, Neisseria lactamica
MFQIWRIDVNFNYIAHARQDSSKKWHSHPLQKHLQKVAQLAKRFAGRYGSLFAEYAGLLHDLGKFQEGFQKYIRNASGFEKENAHLEDVESTKLRKIPHSTAGAKYAVEHLNPFFGHLLAYLIAGHHAGLADWYDKGSLKHRLQQADNELEASLLGLAESGLPKDFFPLSDDDLMRDFFAFWEDGAKLEEVHIWLRFLFSCLVDADFLDTEAFMNGYADADTVQAAGLRPKFPSLDELHRRYEQYMAQLHEKSDKDSFLNQERHAILQQCFSAAETDRTLFSLTVPTGGGKTLASLGFALKHALKFGKKRIIYAIPFTSIIEQNANVFRKALGDEVVLEHHSNLEVKEDKETAKTRLATENWDAPLIVTTNVQLFESLFAAKTSRCRKIHNIADSVVILDEAQQLPRDFQKPITDMMRVLASDYGVTFVLCTATQPELGKNIDAFGRTILEGLPDVREIVADKIALSEKLRRVRIKMPPPNGETQSWQEIADEIAARPCVLAVVNTRKHAQKLFAALPSDGIKLHLSANMCATHRSEVIALVRRYLALYHAGSLHKPLWLVSTQLIEAGVDLDFPCVYRAIAGLDSIAQAAGRCNREGKLPQLGEVVVFRAEEGAPSGSLKQGQDITEEMMKAGLLDDPLSPLAFAEYFRRFNGKGDVDKHGIATLLTAESSNENPLAIKFRTAAERFRLIDNQGVALIVPFIPLTHWEKDGGPQIVKANELDDFFRRHLDGVEVSEWQDILDKQRFLQPTDNSFGQTDQPPLPEPFESWFGLLESDPLKHKWVYRKLQRYTITVYEHELKKLPEHAVFSRAGLLVLDKGYYKTVLGADFDDAAWLPENSVL

SEQ ID NO: 14617 - protein, 724 aa, Stenotrophomonas maltophilia
MTASSAFQSLHPRIQRYLWTEQWEALREVQELAIPLVLSADRDVIIAASTASGKTEAAFLPALTHLLNTDEESLIVYISPLKALINDQFERLQRLCEDLEVPVWPWHGDISGSTKQRFFKHPRGVLLITPESLEAMLCNRGTSVAAAFSKLLYVVVDELHAFIGSERGKQLQSLMHRIDVLLRRRTPRLGLSATLGDFSSAGRFLRAGPSPALVNAASNDNALQLVIKGYEEPGAPNGPEDEPTAPNAVSQHLYRTLCGTNNLIFPNSRREVERYTHLLNRLSEQDGRPREFWPHHGSLSKEIRTDTEAALKQKERPATAVCTNTLELGIDIGAVKSIAQIGPPPSVASLRQRLGRSGRRKGEPAVLRGYVIENAIDADSPLETRLRLATVQTIASVFLLTQKWYEPPSVNGLHLSTLVQQLLSSIAQYGGLKAAQAYQLLCTDPGPFHGLSQDAFAELLRHLGQEQILIQDSSGLLLHGPVGDKLVNHYTFYAAFSVDEEFRIVASGKTLGTLPVSQLLSPDQRILFGGRTWLVEQVEDAQKTIYVAAAKGGNPPLFNGSGGQVHTQVRQTMRRLYQQELEPVFLDPTASRFLQEAQSAYFHLGMDGKLLLDQSSNLLLLTWLGDSANEAIACLLNAQGFVSQADRLGVEISKGGRSLDDVIKVLGRIARTPAPSPETLLHSAKNLTTQKWDGLLPTRLLQRSYASLRLDLEEATSWLAHTFN

SEQ ID NO: 14618 - protein, 940 aa, Streptomyces sp. AA1529
MADSGEVAGRLWDHWLPVQVRRSIAAAMPGGEAEARLLTVWLATVHDIGKATPAFACQVEDLAGAMQDQGLTMPTRRLLTERSASPHGLAGQILLEEWLEQRGELPKSARGQFTVIVGGHHGLPPDAGQVRHLRGRTELIRTRGTSEALWRSVQTELLDAAAAACEVAERLPSWRDVRLPQPVQVLLSATVIVADWIASNPDLFPYYPDAQGQTSAERVETAWGGLELPRPWEAVNPPEEADAHYSSRFALPPGAQVRPVQAAAVRLARELPAPGLLIIEAPMGEGKTEAALAVAEVFAARSGAGGCFFALPTRATGDAMFPRLTDWLGRLPDADGKRGAHSVFLAHAKSALNPHYTALMGAPSRPLAVETDDMWERGSHREGGHIRHTAELVAHHWLRGRKKGMLSSFVVGTIDQLLFGALKTRHLVLRHLALAGKAVVIDEAHAYDAYMDTYLDGALAWLGAYRVPVVVLSATLPAARRRELARAYAGSQAYPDTLRPDGAGHSYPLLTAVAPGGTAVERAPAASGRGTQVHVETLADAPEVIADRLAAELADGGCSLVVRNTVDRVRDTAAVLRERFGADAVTVAHGRFVDLDRAAKDADLRERFGPPEICAGKRPEGAHIVVASQVAEQSLDVDFDLLVTDLAPVDLILQRMGRLHRHERERPARLRTARCLVTGVEPDDGGGEWTGTVGPPPVPIRGSRAVYGTWPLLRAAAVLRPHLADCGDAVRLPADIAPLVQDAYSSVPQGPAGWQEAMAAAEKTDEAHRAEQQRKARTYRLPAPRAAGRSLLGWIDAGVGDADDTPAGRQQVRDTEDSVEVLVVQRTAVGALRTLPHLPPDERGRARGGLELPTDAAPDPHRARAVAASALRLPYQFCFATADRAVAELEELYVGAWQGRDCHWLAGQLILALDEECQCSLAGFELRYSPDDGLEVTRAP

SEQ ID NO: 14619 - protein, 921 aa, Pseudoxanthomonas sp. GW2
MAYWGKAGRWGSVGAYHPLVFHCLDVAACGQAYIDCQPGLLGQLARWLGLDDTSARQVLVFLLAVHDLGKFAESFQYKVPELVEQGFDPPLPRLTGSRRHDEIGALFYAWLAEEGRLPEQLRGWDADTWGALLAPAFGHHGMPPPTLPPGRGMALAALCEVMSPQSRDAAEAFFAWCARTFLPGTLPASCNEARAKLASWWIAGLAVLADWIGSNTTWFGYAAPGLHGLSLMEYWQRHALPSACRAVEEAGVVSVRPRPYHAPEVLLPRLAEGLRPAQAVAADIDIPAEPQLFVLEDATGSGKTEAALILAARLIDRGLADGLFFGLPTQATADQMFERVTRDVPAWFEDPARATLVLAHGARDQSHAFLRHLAQLDDDVPGEGRSATMRLSEWLAQGNKRALLAQVGVGTLDQALLAALRVRHQSLRLLGLFRKVLVVDEVHSYDPYMTQVLLRTLELHAASGGSAILLSATLPLALRSRLLSAYSTGIRRWQADERQPGRGRRRSAPVKAPQAQSTDYPLLTRWSPSLGSQVQELAFPSAPHSRRVLDIEYLTDEGQVLERIAAWHTAGEAVVWVRNTVGDACKAWERLVERFGIDACTLFHARFAAVDRRRIQEDVLAALGRNSGAASRKGRIIVTTQVFQESLDADADRMVTDLCPVDVMLQRLGRYRRHLRDAQGNPLEHGCTQDGRPPGLVVVFGPDRDVEPDADWYSRFSRGAAYVYAAHGRIHRSARAIGDRIELPDQFRTLVEAVYGDDAAPIPDALQTAEDRDLGKVIAQGTQAAQNAVALSEGYGGSRWQGEERIGSRLGDSIEAVLVRVTPQGLEAWATGRCGEDEDVWALSTTRLPGHWLPKMEAAVCLDGRLAGMAEELRNKVPALRYRLILPLVEDGNGTWSCTLAGSPPLSLSYCDRRGLQRLSR

SEQ ID NO: 14620 - protein, 773 aa, Chelatococcus
MYYAHSTEDGHRGNWQPLREHLEDTAVRAAAYGAAFKAGKAARLAALLHDLGKYTPGFAARLDGSKVPVDHSTAGAALVLALAKGDDRLIGELIAYVIAGHHAGLPDKQGESLATLSERLKGFSDASLDPVWRAEIAPDASGLVPAFRWEPPPARGAAPAEADAVRARLAFQFAFLGRMLFSCLVDADFKDTEGFYCRVEGRQVDRAWPALQAILPELLARYARRMEALGSRDTMVNSVRSAVLDHVLSRAGEAPGLFTLTVPTGGGKTLASLGFALDHARIHGHRRIIYAIPFTSIIDQTAAIFRELLGGEVVLEHHSAIDEARAERAPAAAADSEAASRNKLRLAMEDWAAPVVVTTNVQLFESLLAARPGRCRKLHNIAGSIIILDEAQTLPRPLLAPAVAALRELATNYGCSIVLCTATQPALDAGNFPAGHPVGLPLAGRELAPEPQDLARKLRRVTLRFAGKMDDAALVAALMDQSQGLVVVNSRKHALALYQAGQEAGLDGLVHLSTRQHAADRRAILADVRQRLKDGHPCRVIATSLVEAGVDLDFPRVWRAEAGLDNVAQAAGRCNREGRRPVDESIVTIFTAPDHPPPPEIKSLSGDLGRMADKHEDLLSPQAMEDFFGEVYWRVGPEGVDKKKILADFRMHRGEHGPETIFAYRCVAEKFRMIESGMEPVIVANTPEAWSIVERLGSAAIPSGALARELQPYIVQVPPKARALLLANGHVVFRAAEQRGDQFAVLMTGSLYRPDIGLIWEDAGYLGLEQWMV

SEQ ID NO: 14621 - protein, 808 aa, Paenisporosarcina sp. TG20
MQYIAHIREKDGEIQTVQQHLESVQQLCEKYGEKIGVKHLAGLSGLLHDLGKNTGDFKEYIQEAVANPDNPPRKGSVDHSTAGGKLLFDQFHDGQNNFTEKIAVEWMAMCIISHHQGLRDFLSPDMSSGFLKRVEEKELDHYGSAVSAFFETQVSVEEFKDYFEEAKSEAEKMLISMKEKKLQPITTSFLIKYIFSCLIDADRTNTRMFEENELVEQQFDRNAFFSESYVALMKRITSYNHAEDANHPINLLRKEMSNQCEDFASNPSGIYTLSIPTGGGKTLASLRYALKHAMKFEKERIIYIVPYTTIIEQNAQEVRDILNNDQYILEHHSNVMKEKETTDELYNLNAKKLNLAKDNWDSPIIFTTMVQFLNVFYSRGTRNVRRLHNLANSILIFDEVQSVPIKCTSLFNESLNFLSDYCNSSIVLCTATQPALDFVENKLKIFTDAEMIRDLKNVSESFKRVDVIDKTTPQGLNATELKEFIEIEMQEVKSILIILNTKTAVRKLFEELNSKSDFQDNDYKLFHLSTNMCPAHRKEVLKDVKNELLTGKKVICLSTQLIEAGVDISFECVIRSLAGLDSIAQAAGRCNRHGKDKIRNVYIIKSADEVLTNLKEIKIGAEQTKRILDEFKRDADKFGSDLLSQKAMSIYFQYYYHQIEGELKYTILELQKDLVDLLNQNKDYYAAFKNKNGIKPPIVCRQSFATAEKYFNVIDSPTTSVLAPYNEEAKEIILALNGDMNIKELSGLLKKAQQFTINVFEHELKRLEKEGDVFFLLNGNILTLRDTAYTKEMGLDSKGEGSWTPAFA

SEQ ID NO: 14622 - protein, 779 aa, Paenibacillus sp. OSY-SE
MSRIVPFGQCIARPGSLLGEHLIQVRRSVERFLNNEPDALIRLAGLAGICHDIAKCHVEWQDYICKKTKKGPNHSACGAFFFSYLGYHMLQSMGEWERYCIEWLWLVRDIADHHSRLHNLTEDSWLKDYDWTALDLTGIEVFIHEQYRKLSAVKINADSLKTWLKEDAEEAVEEALDALQIGYGAWRPLRLMQSVQKWRQITTSLIAGDRFDVKQVNTSWFDTNAHHQHQELIDDYCRRKQDDSMSVIRIQAQEDIMAQLLQHPEGRFFTLQMPTGYGKTITSMKIASWFGEQQQFQKIVYVGPYLSIIEQTSVVIEEVMQEKALEHHSLALLEEQDNHNQRMSKSQLAVESWAHAIVCTSFHQFGKALFPKQSQDVLRRTFLQNAVIIIDEPQILNPDVWNVFLCGLEALTELMNLKVIFLSATMPPFQYGLSKQPVNLQVKASSNHDRYQLFVEEAQNEGSLASFMKEKEVSSQAVILNTIEDAYRVYRNMEAKDVYLLHGLMIPLHKKIAIETIRRELINENRKQPLYVVSTQIIEAGVDVSFQHVARALPIMPSIVQAAGRVNRHLEGTVLGRVSIFPFYREGMRDTRSLVYPKPLQQITDQLLQQQSMWMESELTVLVQNYYEEMFRHNTYEAAMAYIRDAYEGEWEKLSSFQPFDQSMLTLPVFVPWNPNEEEQKLLPKSYSILQKKFKLYHADDIYERYSDKGYMKRLTFEDQKQFMILFNYYVLNLPVKKALKVASKEDFLTHRIPMLYGTEVYDSQVGLRTQFEQFDNFI

SEQ ID NO: 14623 - protein, 772 aa, Limnohabitans sp. Rim28
MNEQATPTYYAHTGNRSDGTDWQPLKNHLTSVAQLAQTRAQAFGAADWAHLVGLLHDLGKYSRAFQKRLHGSNERADHATAGAKVVVDHIVEIMGPQFLPLGKLLAFAIAGHHTGLANGIDEGQERSNLKQRLALEFGKNLPALDELWRQEIELPKTLRIPALKPHLPQGKYTNFGLIFFARMLFSCLIDADRIDTENHARSTDGKAPLATNFPNIAILQAQLGQHLQQLAKGAKQTDVNVLRQHILTHARQQALKPRESGLYSLTVPTGGGKTLTSLAFGLDHAVQHQLRRVIYVIPFTSIIEQTADVFRQAMGEHKDAVLEHHSAFDRDKLPEEIKTASKSRQADYRDKLRLAMESWDAPIVVTTAVQFFESLFSDRTTQCRKLHNITGSVIVLDEAQTLPLKLLRPIMASIDELALNYGCSVVLCTATQPALKDSDEFNNGFSKVQEIAPNPQELFKKLRRTQVQPLGVQSDEQLVAHLRSHTQVLMIVNNRRHARELFDGIAIEEGAYHLTTSMCAEHRSEKLAQIRQRLKDGLACRLVATSLIEAGVDVDFPTVYRAEAGLDSIAQAAGRCNREGRRLLADSQVYVFQSPDWKAPPELAQLAAPMRSILRNHEGDVLAPEALKSYFQQVYYAKGADLDHHQILNKIRITDGCDFPFQDIARDFRMIDSHMLPIIVPFDDVASDNLELLRNLPENMSVGKIAQKLQRYVVQVPERTFVQLLKLGAVAVIAPEKFGNQFYELVAQSLYSPIAGLNFSDPVAMSAESAVF

SEQ ID NO: 14624 - protein, 645 aa, Roseomonas
MADGKKLRATRFGVDYRLEPYDGWQAHTGPLPPAQAMVPPAGFQPSPHPGFSQAFLTRMLFSCLVDADFLATEAFFARSRGGAPHRGGHSPLDMLRQRLEVSLAALPTTGAPDINALRQRVLEHARAKAALAPGLFTLTVPTGGGKTLTSLAFALEHARRHGLRRVVYVVPFTAIIEQTVDVFRSALGTQDDVLEHHSGVDWEGPESEEGTEPDSLTRLKRAAENWDAPIVVTTAVQFFESLFASRTSRCRKLHNLAKAVIVLDEAQTLPLPVLRPCMAALEELARNYGSSVVLCTATQPALRQKDSFKGGFDLDDTRELAPEPRALYAALKRVRVEVMPQPVSDAAIATRFADQPQMLCIVNSRAHAAALYEAIRELPGAMHLSTLMCAKHRREVLAQARKRLRDGGPVRLVSTSLIEAGVDISLPEVWRAEAGLDSIAQAAGRCNRHGELPAGRVVVFTPQEDKVPHSLKRFRQAAQGVLGRTEDPLGLEAIRAYFQALYWTQGDEALDATMVDGYRGVLPALAEGRRSGEFPFRSLSEAFRLIDETMLPVVVAWDAEAKELLRKIEAMDRPLPADLRKLQPYTVSVLRQARAQWLATGALRPVHVGLGDALLTFVAEAPYDQQTGLRLGDSALLRRVEENVW

SEQ ID NO: 14625 - protein, 711 aa, Roseomonas
MERLGWQLAGLVTLADWIGSRQEWFPYVAPEALDDPAGYLWNQALPRAVQAIEAAGLGSARVAPFGGVRALFPLIGQPSPVQSWAETVTLPPGPLLAVIEDLTGSGKTEAALTLAHRLMAGGQADGLFLALPTMATAGAMFGRLAGAYHRLFVASARPSLTLAHGRADLDPRFRAAITREDDTATAPDFGRAPSDPADETAEAHCAAWLVDDRRRALLAQVGVGTIDQALLSVLPVRHAVLRQRGLAGKVLIVDEAHAFDPYMNRELRALLCFHAALGGSAILLSATLPHAVRQGLVDAFRDGLEVPRAALSATAYPLATLAGAAGVTERTCAPREGLPRRVAVTRLPNEVAAIARITEAASAGAIVAWVRNTVDEAIAAAAVLRAQGLDPILFHARFAMIDRLRVEAEVLRRFGRAGDPAARRGVLVATQVVEQSLDLDFDLLVTDLAPMDLLIQRAGRLWRHDRGPRLVPGPELLVVSPEPVEEPSAGWLRDALPGTAAVYRDPALLWRTARAVFGQGAITTPGDMRPLIEAAYDRASPGAVPPALARAAQEAEGKAHSAAGLATQNVLDVWKGYKREHGAWEPDTRTPTRLEERETVTLRLAVVRDGVAVPYADDPDLQRAWALSEVSVARHRVAACPVPAELEAAVTAAKASWGRWERDSPRYLLAPMGNGGSIDAVSEAGSMVKLQYEKMSGLMWSDNGQNDSPPD

SEQ ID NO: 14626 - protein, 807 aa, Calothrix sp. PCC 7103
MLPYTKFMTDFKGFKPLLAKSLPKKDSESNSEQARGAAKYTGHISLVMQAAEVLVEVLGEQILKQLGLTDVDLHYFAKTVKLGAYSHDWGKANQHFQEMVYWKSLDLKSKEPKVLNFKKVLKDLASQHSNKQMLRHEIISGILALQVPSFRKWLQECKNVDLVAAVWAAMGHHLKTGVNKNDKPAEFIAEIPDGTGDELNIYTHHQDFQAVLKMGCRYLGLPEKLPELPKETWSKSELQTALNLLRNEFTQLESDITWEQQKFIAAVKATVMAADLAGSALPLVEEDFKSWMREVLSLTLSSEEIQKLVNQRLQGKPLRPFQQKIAQAPRQVTLVKAGCGTGKTVGAYAWAKKWAVNRKLFFCYPTTGTASQGFIDYAEGTNIEAELMHSRADLDRELLFSGDSDDSEGIDARLSAFAAWRKKLLVCTVDTVLGLIQNNRKPLYAWAAIVQSAFVFDEVHAYDARLFGALLQFIKTFRGAPILLMSASFTPGQLTKLRELMAELGEEIDEPIEGPEELEKLKRYEIRELREVSNTEEIKEVWEGVLGALKNRQKVLWVTNSVQSCIDLYRQAKTKVQDLPVEVNPLIYHSRFRYRDRVCKHKAVIDAFKTGSYVLVITTQVCEMSLDLSADLLVSAMAPFSALIQRLGRLNRRMTKPEEGTRLAIIYPWMNDKPYKIAELNTGKDLLNKLTSKIVSQQDLSEIAAELSSDIPESVKSIWLEGNWCTYPDFLRQPGYTITVLLQDDLASIKDAASKRPDKSFMREAQGWSVPVQIDNNLYDWHRIKFYPVAPPEDIHYSEETGAEPCK

SEQ ID NO: 14627 - protein, 802 aa, Pseudanabaena sp. PCC 6802
MFERLLAKSTNSVTCTSATFTGHIWAVYKSTKTIIAEIGDRIFQQLGLAAEDRKRFERTVELAAYLHDWGKANQHFQEMVYLKSKGLAHVDLTKGKKSWRSHGQRQMIRHEVLSGILALQVPEFREWLSQIPDADLIVAVWAAMGHHLKLDANKIDGFPNGTGASLKVFTSHEDFELVTKKMGVKYLGLPASVPTVPTRDWSREELERAIANLTKEFGSLEKRNEYEQRFIATVKATVIAADLAGSALTEQGEDIKTWIPKMLKLVLEPGDLHNVLQEKLGDRKLRSFQEEIANTNHRVTLVKAGCGTGKTIAAYAWAQKWATGNSNQSARKLFFCYPTTGTATQGFIDYANGSDTESALMHSRSDLDRELLFSGEQDDSESIDARLSSLQAWTKKIVVCTVDTVLGLMQNNRRPLYAFPALMQAAFVFDEVHAYDDRLFGALLKFLKTCRGAPILLMSASFSEEQKEAIQNIIEEDLNEGINILDKGYQPLEEIKRYKFDYRPDIDSKIENLQPLFEAVTQALERGEKVLWVTNSVQSCIDIYRKAKEYIAKLDDPNIKHLIYHSRFRYRDRAGYIDKKGVKQLGKHEQVIQAFDSAVPCLVITTQVCEMSLDLSADLLVTAMAPAAALIQRLGRLNRKLEEYAPEQFRVEKICTAIFYAWDGMPYTNEEMRTGIRLVEALNDYDAISQEDLASTAKEIALPIPKKEDISSAWLELDWENYPVPLREGGGTITVLLEDDMAAIKEASQANQKSFMQETQAWSVPIRLVKGWETWKRCKFYLRAPGDAVQYSEEMGAEPCRH

SEQ ID NO: 14628 - protein, 811 aa, Paenibacillus ginsengihumi
MDYKDYIAHIREADGEIQTAEEHLREVRRLCEEYGGKIGLRHLAGLSGWLHDMGKLTQSFKSYIEEAVANPDTPPRRGSVDHSTAGGKLLYERFHREAKTPGDKLTAEWAANCIISHHQGLRDFYGPESDSPFLDRVANKKLEDYEQAKEHFFQLADRAEFERYFAEARKELEEIIGRIQKNSHSSINVSLVIKYVFSCLIDADRTNTRQFEEKEAAEEPFDREAFFNRCYDALMRKIKEFDNDPDAGHPINRLRREMSDQCEAFAWQRPSGIYTLSIPTGGGKTLASLRYAIKHAMATGKERIIYVVPYTTIIEQNAAEIRDILQEHDLILEHHSNVVDEMDEETEDYDVRKKKIRLARDNWDRPIIFTTMVQFLNTLYAKGTRNIRRMHRLANSVLIFDEVQSVPLKCISLFNEALNFLHFFGNSSIVLCTATQPALDYVKHQLRLSEWPEMIGSLDDVADRFKRVEVEDRTEPEGWGAERLADFVGERLEEVRSVLVILNTKTAVRKLFARLVQDLRIGESGVKLFHLSTNMCAAHRKKALGQVIEALTGEERVVCVSTQLIEAGVNISFDCVIRSLAGLDSIAQAAGRCNRHGKDPMRTVYIIKSADESLTQLPEIKIGAQMTERLLYEYRQSPERFGRYLLSAAAMKSYFHYYFHHMKERMDYPIPKLDNKMFELLSTNKTYYESFKNTRRRVPEILSRPSFATAEQYFEVIDNAAASVLVPYNEDARTLIADLNGELDSRKLGDLLRKAQQYVVNLYDQEKRKLVQNEALYPLLNGHVLALREFAYSDEFGVETGGEGEWEVALI

SEQ ID NO: 14629 - protein, 820 aa, Proteiniphilum acetatigenes
MKETFNIFYKHLTGFTPYQYQIKAVELLLSGKNVILSVPTGAGKTWASVMPFLYATQNKISDFPQKMIYSLPLRTLANSIYNDIEATLNKEDTQALYPELSKLISIQTGEYSDDPYFEKRIIFSTIDQTLSNFLCFPLPLSQRQANINAGALIGSYLIFDEFHLLEPKLSMATSLGMIRILKNLCHVCIMTATLTDDYIQFIKNELGFEVVSINDFPEDIDKINSLKPAEGKIIKKSVTVCSDKKINASDILDKHKDKTIVICNRVETAQKLYLELEKHKPKETMLFCIHSRYFDSDRKQQEQKVKEYFGKDNKKQNAILIATQVIEAGMDISCDTMHTEISPINSFLQRVGRCARFANEYGDIFVYDVLNLEEKEKIKIETEDKDDRAEIKKLNNKYLPYSKKLCEKSLIELSKYDSINENTAIALVNTILREDESQKIGNITANLYNIVRIRESWNDCNKNHYKETIRDIQGIEIVLIDLENWKNKEIIPWKYETISIYKWSFIGWAKQIEQNKIAPDDWVFAKAIHGEESVFDFEWQDKDSCFLRRLQFEELKNHFDVVFVDNRYFDYTTAGLMVHSNDNNISSPIKDSREKNKQIITYKKDTFYQHNKALLNCFETEFKPYLKFTFNELDRFWGGKNDWEQLIRLTICLHDYGKLNAAWQKPMKEFQKRKTGIDNPTEVLAHTDYDDSIDKELAKECRIKSKPPHAGIGALQAYEILYDEYSESIAKGVCNAILKHHSPETKSFPDFFISDICIKEMEHLLMEYKIKGNLIKKERGELLDDIIPNNDKEWILYFFVVRILRLCDQKATESFEKYYI

SEQ ID NO: 14630 - protein, 820 aa, Proteiniphilum acetatigenes
MVSDIERLKSHPDKLLLNHIQGVRDNVKKLTNSHLAELVALLHDLGKINPNFQDKLDPEKTVNGYSNHAYLSGYAFFCAFCCNRNNFEVLKQFLQIEDLTQNDLIALVVIIAKHHGNLPDFCPKDYTGTGASILSKDETFALFRFLNHEQNLPVCEFIRHFLPIEDFRQLLFSSVMQKGYSEQLVFRDDKNKLALDFFLDFQFAFACVLQADKADAGKIGGFIDKQQQDVRSFSENFSSQLNLYLNKLDQNSELNKLRTKIRDNALQNIFVGLKSEKHVFELTAPTGSGKTLMMLSLASEIIKEKGAKRIIYALPFLSITEQVETEVLKIFGGQGNFIQRIDSKSENIQFENLQKELDGNPTKENILEASILEFQENTFAYPFVITTFVRFFETLLSNRNAELLKLPNFSNCIFLLDEIQALPPRLYGFFVAYLSRFCEKFNSYAIISTATQPNFELPKDNQEAIEFFKDYSRPYPLLPLNYFDSDLFNRYQINYFKNSIDLETLKESILAENRSVLVILNTIDDTKELYKLLQDELGNEELLLLNTHFTPRHRKIKIYMAKRRLREDKKIIVISTQLIEAGVDIDFPIVYRDFTTVASIVQSAGRCNRDGKLQEYGKVKLIRLQKNGQERVNLIFRNRRDKDILKLTYGALKGINYQEKDLLRVQKAFFDSIQKDLDWGKHSQCGPKFEFDFIKDIQECMYNKIGQFRLIDKQLFGEERQYYVAEKDSDDSFEKLLALDNGLMTLLKNNADASIIRIQRKKIEMQIKKMSLNIVNVRFTSHNFEPVLGNEKSYYNLYKLSNSAYSFELGVDLRNSFCII

SEQ ID NO: 14631 - protein, 820 aa, Selenomonas bovis
MNTYAAHITRRHHQGEPTEEVQTVAEHLQHVSSLMGKDAEGMGLSALAHLIGILHDLGKISDEFQRYLRHNVEHPDQKWPRGTVVHSTAGGKFLMERYGSLQEPGVIETIQLVGLVIFSHHSPTGLLDFLSPEGKDTYRRRLSDEDLPEVDLSYFFEAVISPEELDNLFQAAVREVVALADQFGSYGEGIADHMPEVVTFFCGMTEKMMYSLLIDADWLDTAAFAQGEDPTAWECRWETEALWQRLAQRLDTRLAAMGREGHGNPIAQARAQVSEEAYAAAARPQGIYRLSAPTGSGKTYASLRFALHHALRQHQKHIYVILPYTSIIEQNARDIRQVLQEDEAILEYHSDVLAEETLAPADEEGTVRALLAERWDVPIIFTTQVQFLQALFAGSAASARRLRSLRDSVIIFDEAQTIPVKCTDIFNLAIDYLAAFQRDTVVLCTATQPSLGALSYPLRFAAQAEILKDRSALFAAFRRTRIEAELPPGGERIEALAAKAVHEAMREGSLLFICNLTKEARLLYQEAQETAAEVGAPLQIYHLSTKMCPAHRRECLARIRKALKGKTPLLVLSTQLIEAGVDISFACVYRVLTGSASIAQAAGRCNRHGEKPYGRVKIVSIEQENLAHLPDLAKGAQVTRDLLALGREADTLLEPEAIEEYFQTFYRRYTEAEKAYALADGITLLDLLSCNAHGLQAYLERGGAEAELPCFLQAFQRAGKEFFVIDRNTVSVLVPYGEGRSYIEAFSAPPQPWEMAEAYRKLRAAQPFMVNLFSWELKKLEEAGALWESPAGIYSMREEYYDESIGVQFENQKNEFCFMG

SEQ ID NO: 14632 - protein, 927 aa, Thermus scotoductus
MEVQTQALTLWAKSGDPFHPLLAHMLDTAAVAWAILEREPGRTRKLYATDWNLGEKEALPWVAFLAGLHDLGKASPVFQAAWDEGAKRVWDAGLTWDEELVREQWVAHGVFTELYVKDVLKRHGPPLRLADPLAKGLGAHHGFLAQGEELKTARLHVKSEASTWQEVRDHLALRLAQSLGLNLPLVLPVEDAEAPAILRVMALASFADWIASDPRFFPYGRDPEALEYWQDALELARKALEDLPWPRVSPRGVRRFEELFPFSPNPLQSSVPELLEKTPGDSVLLLVEAPMGLGKTEAALYASHLLRERLDHRGLYVALPTQATANGLFNRIREFLERLSGGERWELQLQHGAALLNPQYAELLERTRPMEVYDIELERNPGQESGGVAASTWFSAKKRAMLAGHGVGTLDQALLGVLKVKHHFIRLWGLMNRVVVLDEVHAYDTYTSGLLKSLLLWLRALGSSVILMTATLPKKKREELLSAWGVGGVELPPYPRVAAFSGGGLLGARHVPLEEKTLHLQGAPTEVSQVAEALKEQLPGALGAIVNTVDRAQALYQALGEGERLTLDELLDSFGAGPNQGAWPGLWEIREEKGRWVVGKRLKDGTLVFLLHARFPAEERALREAVTLALFGKHGPRPEKAILVATQVAEQSLDLDFDLLYSDLAPVDLLFQRAGRLHRHTRKRPEGHQTPVLLVGGLTDEPEFGRELHWNRVYEDYVLLSTWLALQGRETVKVPADLEGLLEEVYERLPEGFPDSLRDRARKSYQNLIDRLQKDASMAGNLSLAELDRLLSQLDASALASDFRLDDEEENASTQRFLTRLGEPSVSVVPLYRRGEEWFLDADGRRPAKMKGDLGKEDVLALWSRAVRLSRFPIPQTLLGEKPPSAWAKSGLLRGLRPLEVERVFAREDSVLKVVVDEELGVVYVDV

SEQ ID NO: 14633 - protein, 757 aa, Propionispira raffinosivorans
MAYIAKSNPIQTVKEHTDDLLLLWEKFLKLYGDQFSEQEKEFIYLAAFYHDLGKLNALFQYKLHKVIGRKYEGVAPKADEEEIPHGFLSPAYMNTEKLEELYGEDIELVVTAIYNHHIREDSYTEGALERYIDRYLPDSYTYDTKQIFYKNTDYLDLGYLITAFTNNPRNKGNMTAKEAHEKWLKYIVVKGMLNKLDYAASGRNLEQIEIAPLPAGVLTNVIQKQWKVIRPVQEYMMHRKDENLVVLAATGSGKTEAALFWLDGSKAFYTLPLKVSINAIYERISGRKDHQYHYDEDKITLLHSDLLAYYFAKQEVNEHSFAMEDPLIRKEKAKLLAYPLTICTVDQLFWFVFKAMGSEIVPATLKYSKVIIDEIQMYSAEILAYIIYGLKIITQLGGKFAIITATFPPVLRHFLVQQNIEFQIPESPFRGEYDKRHKIEFIEAEDFDYEKIIDEAQNKKVLILCNTVGRSQSVYDQLKDQNEYVKLLHSRFIRQDRKLLETEIMKFSDSDETGIWISTQIVEASLDIDFDVLFTEMCPADSLLQRMGRCYRKRNYDGINPNVYIYNTKNGCGTNNVYQYVDIYQYSVDDLQKYNHNYFLETEKFEYINAVYDTARVKATSYYKKIEECLKTLQDLPPSTIDAGTAHQQFRNIQSITVLPERFYQADNVQEYINIIKDKKQYDMKTRIKAENDLLQYTISLNANLLKSKKGKGAIDRYPIEAIKWLGIHRCTRVYDFAALSGSGLCLEKEDESENLC

SEQ ID NO: 14634 - protein, 965 aa, Deinococcus apachensis
MTSPDTPPPGSPQSRAVQVLWAKSGQKSAGEGWLPVLHHLLDVGACAAAILEREPATTRDLLAADLDLAPGEGTDLAVRWTSALAALHDLGKASPAFQHKAAPLAERVWKVLPWQDHRENTPHGLVTQKLLPDLLTARGWASQVASRIAQAVGCHHGQRERTPRAPDRGTGPEWHGVQDELVTLVLTAFGLQDEPAPPVTEFGGGAFMRLAGLTSFADWVGSSFPLRGDPDPLPFTDPATYLQGATVQARAALDAIGWTARQPLTPHPGAVDDTFAFLPGFRARPLQTLLADLLSTPDPRPALILVEAPMGEGKTEAALYTHLQLQNAAGHRGLYLALPTQATGNAMYRRLRTFLNHQAAGRPDPITVDLQLLHGGASMQGDYQQDLTNTRARSDAQQAIDLKPNTRKDEGDMVRAAEWFSHRKRALLGEYGVGTVDQALLGVLNVNHQFVRLWGLGNRVVVLDEVHAYDTYTTQLIHALVRWLRALNSSVVIMSATLPAQTRQDLLNAWNVTPDAAPTYPRLTVARAGDPTPTSRPIPGPRRAQTLTLRATDPDPGALAVQAVTLAEAGGTVTVLVNTVQRAQDIFRAVRTLLGPRFQSMCWGSKHPEKIGVHLYHARYPAQDRGEREERVLRYLGPQPATYLKNGTRHTDDVRPERFILIATQVAEQSLDFDTDVLITDLAPIDLILQRAGRLHRHDVNTGRRGAHETPTLYVAGLGDWPEAALDEYQWKYVYAPALMYRTWHALQGRTHLTLPNDLDPLVQRVYDLNSPALDNLSEEQQRTLLKADRALQTERRNQTLTGGLAHIGQPDTFLDLPPQPSLGEPDGEPAHDDASATTDDTATEAPHYGTRLGDDSLRIVPIHHNGADTLDEKGDHSAQIETLQKHDWDTARAIYARSLQVSRHDIVRHYRDHPTRRGGDHAGWAAHPLLRDTEPLILINNQAVIGKTRVILDPELGLVYERLE

SEQ ID NO: 14635 - protein, 441 aa, Rhodonellum; identical to SEQ ID NO: 13221

SEQ ID NO: 14636 - protein, 1024 aa, Nocardiopsis sp. CNS-639
MTTALEITVTAPVVSFRNPLYSGVQVTLPCPPPSTVAGLLAAAVGGWGRMPADTRMAMSFTARGKGVDLETFHPLDAEGKKRDATPKDHEFLADTTLTVWVLNHLDLWERALRRPVWPLRLGRSQDLASARTRRVTLHPGTGTQGHALLPVETSTSGMQVRMPHAISPDRSRIQWGTYRYAPKGSTALVDSPLRTDSGQAVVPLRAVHPEAAAEERAELPHIWAKSPDKRIRPPQPGEALTTHLQATARALDLLRARVGTLPGVDERFWAWARLACLFHDAGKIPNGFQAMVGNPAPAQPWGRRHEIYSLAFVDHVLAHLPEEERIWVGLGVLTHHRPLAGGEGSIRGEQRTLTNPQQVQDSFGPVDTASANALATWLAARVSAPAPAPLTQADLAQATHRLLEEILKEWDRGESPDEKAGLTAALLQGAVTLADHVASAHSPLLTAHPLVGTDYPRRLRLELASKGNSTYPHQKRAEATTTHMVLRAPTGQGKTEAALLWSNTHTRGLADDTGGTPRLFYSLPYLASINAMATRLRDDLGQDQVGVVHSRAASFYLSTASCDDHGGAHQQSGPQQERQRASRAVAQANASRLFRELVRITTPYQLLRGALGGTAHSSTLIDSANSVFVFDELHAYEPRRLGMILAMMRQWADLGGRIGVLSATLPDRLLDTIRETLGENHRVELVEPDADYAWPRRHRLHLREEHLTDPTSVEQISDALRAGQSVAVIANNVADAWNLYGQLAPLAEELHGEGAALLLHSRFKTGDRTRIEKAIRERFGTKVTPRRPGLLVATQVVEVSLDVDFDVLHTSAAPLEALLQRFGRVNRVGALERPAPVIVHQPHYAPRGRSGPEFADKVYPAEPTRLSWDILARDDGQELDERLFTAWLNEIYASSWGDEWRTQVDDSIQVFQDRFLGFEQPLNDTSQLSEAFDEMFDGVDGILAEDRQDYEDALLEKSPGEERGTGRLLASQYLIPLPHYARFLGTWDHKLKVLIIDAEYEDDRGLTAIKSASSTGSYQPGVLV

SEQ ID NO: 14637 - protein, 810 aa, Paenibacillus fonticola
MYIAHIRESDHTYQTVEEHLLGVKKLAESHGGKMGIKHITGLAGMLHDLGKYTDEFKEYILKAASHPDVPPKRGSVDHSTAGGKLLFELFHTGNIDRHKGILAEIVGNAIISHHSYLQDFLNPELESNYLLRVRDKDLTDFAKTKQMFFEHVISEAEFHQYVNEAASELEAYLAIPSSFSSENKLMFLTKFIFSVLIDADRTDTRLFADNAVAEPIDSLNSAALFEIYYNRLMTKVHSYAELSNANIPINLLRRDMSEQCDKFAEKPPGIYTLSIPTGGGKTLASLRYALKHAKLHNKKRIIYVVPYTTIIEQNTAEVRGILKDDVHILEHHSNVVDDANDNDEHLDGLSYIQQKLKLAKDNWDSPIIFTTMVQFLNVFYAKGSRNIRRLHNLSESVIIFDEVQKVPVACVSLFNEALNYLRNYGNASILLCTATQPALDFVEHKLEINPEAEIIANLDHVIEAFKRVEIIDKATNEQFNNDKLANFITEKLEEVESVLVILNTKSVAKKLYQQLQEIGSDIPVYHLSTSMCAAHRNKILTEVRQQLKDGNKVICISTQLIEAGVDVSFACVIRSLAGLDSIAQAAGRCNRHGEREVQQVYVIDHVEENLKHLREIKVGKEISRKILIDLKRDQTNHGGHVLSIQAMERYFKEFYSEFDSELNYFIPKLRKKMTELLAAKKEDNSYFQAYCSKFKKQPPLFLANSYRTAAEHFRVIDDLTTSVIVPYGEEGKEIIAELNGAGVIDDFTRLLRRAQQYTINLFHYELQLLSKNGGLESCLDGKVLVLKEGAYSREFGLDIENDSQFDLSIY

SEQ ID NO: 14638 - protein, 726 aa, Stenotrophomonas
MTASSAFQSLHPRIQRYLWTEQWEALREVQELAIPLVLSADRDVIIAASTASGKTEAAFLPALTHLLNTDEEGLIVYISPLKALINDQFERLQRLCEDLEVPVWPWHGDVSGSTKQRFFKHPRGVLLITPESLEAMLCNRGTSVGAAFSKLLYVVVDELHAFIGSERGKQLQSLMHRIDVLLRRQTPRLGLSATLGDFSSAGAFLRPGVGAAPALVNASSTGNDLQLIIKGYEQPAPDAGSDENPAAPAALAEHLYRVLSGTNNLIFPNSRREVERYTHLLNLLSERDGRPREFWPHHGSLSKEIRTDTEAALKQRGRPASAICTNTLELGIDIGAVKSIAQIGPPPSVASLRQRLGRSGRRPGEPAVLRGYVIEDAIDAESTLKTRLRLDTVQSTACVLLLLERWFEPPSVNGLHLSTLVQQLLSSIAQYGGLKAAQAYQLLCADQGPFHGLSQDAFAELLRHLGQEQVLIQDGSGLLLHGPVGDKLVNHYTFYAAFSVDEEFRIVAAGKALGTLPVSQLVTVGQRILFGGRTWLVEQIDEAQKTIYVTAAKGGTPPLFNGTGGQVHTQVRQKMRGLYQQEIKPDFLDPTAARFLQEAQNAYRQLGLDGKILLDQGSDALLLTWLGDSANEAIACLLNAQGFTSQAGRLGVEISMGARSLDDVIKVLGRVAKMPLPSPEALLHSANNLVTQKWDGLLPPRLLRRSYASMKLDLEGATDWLARAFG

SEQ ID NO: 14639 - protein, 819 aa, Ruminococcus flavefaciens
MNANEIVTKVQEWINSSMILSDKLPISSSDNIKSGVAIRMMNAYRRYRIWQNSENTIDFECALRNYLLSFNTDIHINGYNPTFPNSFGLVLNAATDRIYANYDLPDYVNQKFIRNVFSGLSVMKYDDKDNSIKAVNSYIYELTNHRFSKFKSVEQQLAVMGSLRVPQGYTALVAMSTGGGKSLITQTVSYQNKDSLTLIIVPTISLMLDQCRNAKDIIKPANLNEIMYYHSGCDVDGLVERLLNHSVRMLFISPEAIIKNKKLQSNIFKANKSGYLQNLIVDEAHIIIEWGTSFRVDFQCLDSFRKLLIKDNPLLRTFLLSATYSKKTVENLKMFYSDDERWIEIRLDTLRKEPRFDIVKCSSYTDKHNKMIELVRKLPHPMIIYVNTPNDAEKIRDELSDTGFNNTRMFTGRTSSSDREKIIDEWVQDRFDLMIATCAFGVGVDKRDVRTVLHTYVPSGPNQYYQECGRGGRDGQPCLSTMLFTEDDINVARSMTQKVLTVEKLSGRWFSMLNSDKTNKKLAKVIMDTSVKPDYNEKDSFYIEASNADITWNVYVILLLRRAGLLNIVEVNYVDDKYIFVVSILDQRIMFKNDAAFELFNSIREDESKSIYNEINELTSKLYRVGKICWSSMFNDVYLLTDEYCAGCNNHENLKTEKHSNFPLKKPIVYPLAKANSRLSEIMSYNEEMLIISKDKKQYMIKALSNAGADIIVMPNDKDCSFMLLEETNEFSAQTYMDYSEFFELCRMRCNYFLSGCIVFYVDDDQELAADLLNITASKEYKRVYLVSGDFFVPKRNKNISELVNGVCKFDYIIEKELI

SEQ ID NO: 14640 - protein, 834 aa, Acidovorax oryzae
MTWVREFPQEHRLRMTGTHPLRTMAAEAPHPAWPGRTEPRQAIEREFLLKDDTQGSGHVSAPADAAAPDAPPGAPAVTPTFHAHSVQDQPESRWQTLPEHLHAVGRMAGDFAAVFNAQELAQVMGWLHDLGKYTLPFQARLRGSPLRVDHSTWGARIAQQRLGVMGQLMAYGIAGHHAGLANGQGEGERTALADRFTATDLPPLHPAWEKDIPLPARLALPAGLKLYGQDRQQALARQPFQMAFLARMLFSCLVDADFIDTERFYLQARGGPDHRSAGPAWPPLPALRAQLDTYLRTLTAECDPAREVNRLRADILRQVRERAECAPGLFSLTVPTGGGKTLASLAFALDHAIRHGLQRVIFVIPFTSIVEQNAAVFRKALGPLGDAAVLEHHSAFTERQPPRDDPEKYQSAEKLRLAMENWDAPIVVTTAVQFFESLFAARPSQCRKLHHIAGSVVVLDEAQTMPLKLLKPCVATIDELARNYRTSVVLCTATQPVLEAPAFDGGLTGVRELAPEPTRLFQQLERVRVRHAGTLDDAALASHMRAREQVLCIVNNRRHARAVYEAMADLPGARHLTTLMCAKHRSEVLDEVRQMLKAGEPCRVVSTSLIEAGVDVDFPTVLRAEAGLDSIAQAAGRCNREGLRNIDASEVLVFANANEEWAPPPELKQYAQAAREVLRQCADDPLSPEAIARYFALLYWQKGGDQLDVPDLMGLLKTRRPDSLPMETLATRFRMIDSVQMPVIVPYDDAAREALEQLRFAEGSVGLARKLQPYVVQLPRQGFDALYQAGAIAPVRPDRWGEQFMQLVHPDIYSQLSGLRWDDPTFIRSERLHW

SEQ ID NO: 14641 - protein, 744 aa, Pseudomonas aeruginosa
MEAESSDTHFFAHSTLKADRSDWQPLDEHLQAVARLAGEKAAFFGGGELAALAGLLHDLGKYTDEFQRRIAGDAIRVDHTTRGAMLAVERYGALGQLLAYGIAGHHTGLANGREAGERTALVDRLKGIGLPRLLEAWCVEIVLPERLQPPPLKTRPERGFFQLAFLGRMLFSCLVDADYLDTEAFYHRVEGRRSLREQARPSLAELRAALDRHLTEFKGDTPVNRLRGEILAGVRGKANELPGLFSLTVPTGGGKTLASLAFALDHALAHGLRRVIYVIPFTSIVEQNAAVFRRALGALGEEAVLEHHSAFVDDHRQSLEAKKKLNLAMENWDAPIVVTTAVQFFESLFADRPAQCRKLHNIAGSVVILDEAQTLPLKLLRPCVAALDELALNYRCSPVLCTATQPALQSPDFIGGLQDVRELAPEPQRLYRELERVRVRALGPLEDAALTEQIAKREQVLCIVNNRRHARALYESLAGLPGARHLTTLMCAKHRSNVLAEVRQMLKTGESCRLVATSLIEAGVDVDFPVVLRAEAGLDSIAQAAGRCNREGKRPLAESEVLVFAAANSDWAPPEELKQFAQAAREVMRLHPDDCLSMAAIERYFRLLYWQKGAEELDAGNLLGLIERGRLDGLPYETLATKFRMIDSLQLPVIVPFDDEARAALRELEFAEGCAAIARRLQPYLVQMPRKGYQALLDAGAIQAAAGARYGEQFMTLVNPDLYHHQFGLHWDNPAFVSSERLCW

SEQ ID NO: 14642 - protein, 920 aa, Streptococcus sobrinus
MRSEYCFWAKKKEENGRLLWLPLTQHLEDTRNVADRLWEHWLGEGQKKLITDSLETKYETDDLGKRLVQFLAAVHDIGKATPAFQTQKGYTNSEDLNLRLLEKLEHPGFEGISSVQLKKPEQSHHSIAGQYLLYTYGVEEDISTIIGGHHGKPIDSTDDYKSQGGSYPTNYFQIQNLENKIHQKWKENQRRIFNWALELSGFTDVDELPKIKQPAQVILSGLLIMADWIASNEHYFPLITIDDTEVKNKSERTASGFRKWKKAGLWEPRVITNFKGVYEKRFGFEPKDVQTVLADTIVNTGKPGIFILEAPMGVGKTAAALVAAEQLAAKTDRNGIFFGLPTQATSNGIFPRIEKWLESIQEDLEENISIHLVHGKAQLNKDFAQLSQLSENINIDEADNGSVIVNEWFSGRKTASLDDFVVGTVDQFLMVALKQKHLALRHLGFSKKIVIIDEVHAYDAYMNQYLLEAIRWMGAYGVPVIILSATLPAERRVELLKSYMLGLGKEFNKKERKELAEVLRTDAYPLITYNDGGEVRQITDFQQDKNKMIRVKSLREAELLETVDKELFDGGVIGLVVNTVKRAQELAKTFAEKFGEDMVELLHSGFIATQRVQKEKDLLQMIGKNAQRPKRKIIIGTQVIEQSLDIDFDVLISDLAPMDLLIQRVGRLHRHDIERPVRHENSKCYVLGTSESLDFEEGSSFVYGDYLLARTQYFLPDFIHLPADISPLVQKVYDFEHDIDFDDELNVKYIESQKQYITKIEKKEAKASRYRINDPDDLDSKGSLIGWLKNPNPDESEEKAFAQVRDIEDTVEVIALKQIGDGYGIFGETEDISSDITNFQITKKVAQNTLRLPLTLSKSYNVDKTIKELEKYYRRHFENWDNSSWLKGTLGIVFDENNEFILNGFKLSYDEKYGVQVERV

SEQ ID NO: 14643 - protein, 920 aa, Streptococcus sobrinus
MRSEYCFWAKKKEENGRLLWLPLTQHLEDTRNVADRLWEHWLGEGQKKLITDSLETKYETDDLGKRLVQFLAAVHDIGKATPAFQTQKGYTNSEDLNLRLLEKLEHPGFEGISSVQLKKPEQSHHSIAGQYLLYTYGVEEDISTIIGGHHGKPIDSTDDYKSQGGSYPTNYFQIQNLENKIHQKWKENQRRIFNWALELSGFTDVDELPKIKQPAQVILSGLLIMADWIASNEHYFPLITIDDTEVKNKSERTASGFRKWKRAGLWEPRVITNFKGVYEKRFGFEPKDVQTVLADTIVNTGKPGIFILEAPMGVGKTEAALVAAEQLAAKTDRNGIFFGLPTQATSNGIFPRIEKWLESIQEDLEENISIHLVHGKAQLNKDFAQLSQLSENINIDEADNGSVIVNEWFSGRKTASLDDFVVGTVDQFLMVALKQKHLALRHLGFSKKIVIIDEVHAYDAYMNQYLLEAIRWMGAYGVPVIILSATLPAERRVELLKSYMLGLGKEFNKKERKELAEVLRTDAYPLITYNDGGEVRQITDFQQDKNKMIRVKSLREAELLETVDKELFDGGVIGLVVNTVKRAQELAKTFAEKFGEDMVELLHSGFIATQRVQKEKDLLQMIGKNAQRPKRKIIIGTQVIEQSLDIDFDVLISDLAPMDLLIQRVGRLHRHDIERPVRHENSKCYVLGTSESLDFEEGSSFVYGDYLLARTQYFLPDFIHLPADISPLVQKVYDFEHDIDFDDELNVKYIESQKQYITKIEKKEAKASRYRINDPDDLDSKGSLIGWLKNPNPDESEEKAFAQVRDIEDTVEVIALKQIGDGYGIFGETEDISSDITNFQITKKVAQNTLRLPLTLSKSYNVDKTIKELEKYYRRHFENWDNSSWLKGTLGIVFDENNEFILNGFKLSYDEKYGVQVERV

SEQ ID NO: 14644 - protein, 737 aa, Actinopolyspora mortivallis
MYAHSVNVNGDRHGFSEHARATAELAARFAEPFGYSELAHALGLFHDCGKARCAWQERLLRVEGTDEPVGVPHKDLGAHLLKPAAGIAAMAIHGHHGGLSNREELKELDPEDGDLTDEPVKRFLEALPEAKEFLDLPVNSLLPPEWAGSRLLAELGMRLVFSALVDADHLDTSAHFDGLGAPRISPESDMSALRDTFERARQWKLADSEDSPINRVREEVYRTAISHATGPTGIYGMPAPTGIGKTLTSAGFGLHHAAAHGKKRVIVAVPFTTVTAQNAADYREMLGAENVLEHHSAVRMPEEGRQALQYRHATENWDSPFIVTTTVQLFDSLFSHKPARMRKLHRLADSVIILDEVQALPLPVLTPILDALRTLSEHFGTTVLLTSATLPSFQTLDVWRDLKVPEIVDAPTELFERMRRVNYEWWIDPRPTLSEVADHAAEHEQVLLVVNTTDDARKIYQHWEESGLENIVHLSNRMCGAHLKTELDGMRARLASGEPVRVVSTQLIEAGVDIDSPVVYRAMAPADSLQQAAGRANREGKGAEFGRVIIFDASDMSQPAGYRIGSDITRQYFGPQPDGSMIDPDNLQVLDSYYQVLYRRSNTENADRATAIQENRSKLDFQAVAEGPKRPSPAGGQAREPSLAFRMLDDDTVPVVAIKYDPEADRRLSRLLSEPERSGPLLRELQPYVVSLPRRLLQDPGIQALCRPVLGDLHVWDHEYHPAYGIDTSTLIERNVF

SEQ ID NO: 14645 - protein, 731 aa, Paenibacillus sp. HW567
MSSNPFYRLAPFIKEFIYKNRWETLREAQVDACRVLFDTPHHLLIASGTASGKTEAAFFPALTELYEQPSASVGILYIAPLKALINDQFTRLNDLLREGHIPVWHWHGDVPQADKSKLVQNPSGVLQITPESLEGLLMNRPNAIPALFHDLRFIIIDEVHAFMGADRGIQVLSQLARISRMAGCHPRRIGLSATLSDYASVTEWLAAGTRESVEVSAPQGGRKLRLSVEHFSFPDARDEQQAEHLERAKQAYHGFIYDHTHLKKALIFTNSRSDAEEAILEMRRLAAKRGERDVFYVHHGSISAMLREETEAALRQGSGPAVAAATLTLELGIDLGELERVLQIGAPYSCASFVQRLGRSGRRGDAASEMIFVTPEEEDEEAQLPARMPWTLLRAIAVIELYVREKWVEPLVVRQLPVGLLYHQTMSILKSMGEAEPEDLKEAVLSLPSFQSIDPADYDAFMEYMLGMGHIEVMDEGGLLIGMAGEKIVNNFRFYAVFKDDEEHVVYNGTEEIGSITTVPPPGYCFTLAGKLWKVEEVDNRHKAVYVKGSRGKVDTLWVGGGGDVHTRIMTKIREVLGATALYPYLAPSAAARLERARRLAKESGLLTHSVLPAGGDSMFILPWAGSRQFRTLERLLKNNLKDRLGLRSVTPMEPYYMVVAGKADWETLEEEIIAEATTVSDPVALLGPDEAPYLGKYDEFIPHDLLRKAFSLDGLDVPGLLGVLRQWRKN

SEQ ID NO: 14646 - protein, 818 aa, Paenibacillus sp. HW567
MEYIAHIRDSDKKVQPVAEHLLEVRFLAERYGKKLRISHIAGLAGMLHDLGKYTEEFRNYIMQAVYHPEAPPKRGSVDHSTAGGKLLFEQFHNLPKDLSNKEDHMYKMILAEVVGNAIISHHSYLQDFLNPDSESNYLHRVRDKHLEEFERSKSSFYQLVMGEAEFQQYVDEAATELEQFFSVDFSTTKELKLMFLTKYIFSALVDADRTNTRCFEENQPDETVNHQELFTLYYERLMAKVDSFQEHENAHSPINLLRKEMSDQCEQFAYKPSGIYTLSIPTGGGKTLASLRYALKHALLKEKKHIIYVVPYTTIIEQNANEVRTILQDKVHILEHHSNVVEAENEDDEYEEGVPNLRQKIKLAKDNWDAPIIFTTMVQFLNVFYADGSRNIRRLHNLSESVIIFDEVQKVPVRCVSLFNQALNFLKTYAESSIVLCTATQPELDYVRNRLEIESEAEMIHDLDHVIEAFKRVEIVDRATVEQFDNGKLADFILSQMQEVNSVLVILNTKSVVKALYKSLKEQIPSTPVYHLSTSMCAAHRNQILQEVKKLLEDKKQVICISTQLIEAGVDVSFQCVIRSLAGLDSIAQAAGRCNRHGEAQIRQVFVINHVEENLKHLKEIRIGKEISRKILVDLNRDPSSHGGQILSVQAMEKYFKGFYTELASSLNYSIPKLGKEMTTLLSCSRKENTYYQAYYNQHKAALPLFLVNSYKTAAEHFQVIDNLTTTMLVPFGDGPEEGKDIIADLNGQQSIPDLTRLLRKAQQYTINIYSYEKELLSKSGSLVAYLDGKVLALKEGAYHNEYGLNLENDSPLDLYMF

SEQ ID NO: 14647 - protein, 755 aa, Kushneria aurantia
MTFYAHSTDSSHHDWQTLADHLQAVAELAAQRADRFGMADSGRVAGLLHDLGKYSHDFQRRLAGSKEAVDHSTAGALVARERFPGGVGELLAYVIAGHHAGLANGRDEGGRTPLAQRLQAELPALDECWRNELELPSQLRPPAGFSTRKDRGFFQLAFLTRMLFSCLVDADYLDTERFYAATEGREAPSRGGGPGLDVLREALDIHLKEKQAQASASDVNRCRAEILDTVREQAGLEPGHFTLTVPTGGGKTLASLAFALDHALAHGMDRVIYVIPFTSIVEQNAEVFREALGEFGNSAVLEHHSAFDNREPRHRHDRDSRDKLKRDSENWDAPIVVTTAVQFFESLFAAKTSRCRKLHNIARSVVILDEAQTMPLPLLRPSVAALDELARHYHTSVVLCTATQPALAESDDPERSFAGGLHHLRELAPEPRGLYQRLARVTVRHIGTLDDSGLHDEMLEVEQALCIVNNRRHARALYQSIADQPGAFHLTTAMCAIHRRKVLAEIRHTLAAGKPCRVVSTSLIEAGVDVDFPRVLRAEAGLDSIAQAAGRCNREGKRSAADSEVRIFATANDDWAPPPELKQFAQATREVLRHHGDDPLAPDAIEAYFRLLYWQQGPQQLDRHGLLKQIEEGRLDGLPFDTLEQKYRLIENTQYPVIIPYDDEARESLRHLAFTEKAGGIARRLQPYIVQVPERGFRALERAGLIAAIEPDTFGEQFMVLIDERPGELNDNLYSSASGLDWDEPTFRSAESNLW

SEQ ID NO: 14648 - protein, 775 aa, Woodsholea maritima
MSEKIFAAHSPNTPNQPWHLLKDHLKQTGALAYKFAGSFGAGPLAQCAGILHDLGKYNLDFQRRIRGETIKVEHALAGAWAVETAVKVVSQSPLTQNLSPADRIFSRLIGYAIAGHHAGLPDWRQLSNEGGGRLKERLENFQPSLLDPVWETEINIQLKGLIPQGFKFGKKTWHGFEFAFLTRMIFSCLVDSDFKDTEHYYATLEGRIPPRDWPSLSMLLPQALTALNERMDAFRTIQKTQNFVEDERARVHNHVRSFASLPKGVFSLTVPTGGGKTLTSLGFALDHAAHHDLRRIIYAIPFTSIIEQTAKTFRSVLGSEVGQHILEHHSAIELNNFPADHALEARSKLNLAMEDWAAPLIVTTTVQLFESLFAARPSRCRKLHNIARSIIIIDEVQSLPWGLMGPCIQALDNLARNYECSVVLCTATQPINQLHLNTDTQENNPLRIQSQVTELAPNPSALVQNFKRVVVRLAGMCDDASLVETLKGSPQALVIVNSRTHARELFQALKEAHLEGVTHLSTRQHATDRQTILEEVGHHLQNNEPCRLIATSLIEAGVDLDFPTVWRAEAGLANIAQAAGRCNRHGKRPPEDSIVTVFTPKDQPANIEMKRFAEDFRRIEHIFKDDLLSLEAVEGYFREVTWRLGAQGVDENEILSLFTLDHNTMLEGQFRTCAERFKMIKDRNLPIIIPSTEIEQVLTDLDQRKIWPSQAARELQRFIVQISPKDREALIQNGAAHYIKPDFYGDQFLLLTRTALYNRDIGLEWERSNTMDIIL

SEQ ID NO: 14649 - protein, 762 aa, Prevotella maculosa
MNILKKNILAKPSGITLEQHISDVIQEAMMICDSFPATCEKYQKIVGKDFRKRLEISALYHDIGKKDIKWQTACQADYVDYCQWRRKHSEATAREIVDFLFYEGGRYIRKCGVRHELISVRKTMQHIPMSVSVAIASHHSKLGMSFKERWIQEGHKDIWNKIECIANEVIESEDLGYIAARAYEYDGVRGVLQWADHRASAKEDGETLPKITAFNYVFPFSEKRGIQKLVEEHWKENLLLVRAPTGAGKTDASLLWALKQIENNRADRLIIAMPTRFTSNALAVNVSKTLSSTGLYHSSAWFAKYNNKVENGTSSLSYALKELDMARLLETSITVCTIDHLLMSLTLTREDHHLSNFNMANSCLVIDEADFYDDFTQANIHFLLKILNYWHVPVLIMSASLPESAIKSYEKTGYHVTEILEEKSDYNRTRFSIEKIFNYGVLSDLDKVIGKAIERGNAIFYMNTVDSAVKLYRYIIKKIEVSENKLPILIYHSRFTELDKLKKEDELLCALGKDAWEHGKAEGIAILTQIGEMSINISADIMVSEVCPIDRLIQRVGRLCRFDVRKKGQLYVICPQKRGYLYPAPYGNYDSKEKRWKSCSALDKTISLLNIGEYSINVLINILNSIYNDKQFFSIKACNNAKNLRSYFIYNWLINPKEKTDKADIDTIFWKSRDIGAQFPVFIKGPSCLSFRNYSSFYKYKLEYAIELPLYLVEKGRRLHRIDIKTIKVGDLHVESIDILREGFYLEDVGVNLIEEEGDIFL

SEQ ID NO: 14650 - protein, 394 aa, alpha proteobacterium SCGC AAA300-J04
MSQNLPIFSVLDELAEQLKKTKRAVLTAPPGAGKSTTVPINLINDPAFSKGKVIMLEPRRIAVKQVAARMAQTLNEPVGKTVGYRIRGETKCSELTKIEVVTDGILIRMIQADQELKDVSTIIFDEFHERSLNADLGLAFCLETANVLRSDLKILVMSATLEVNAVSKLMQNAPIIKCQGKSFSITPHWQKLPQTQEEIIPKAISEVILKVIKTKTGSILVFLPGEAEIIKVAASLKGQVPTDCRIFPLYGRLDFKDQQNAIKPLSDGRKIVLATNVAETSLTIEGIDHVIDSGLSKRSIYDSSSGMARLVTQKISKSEADQRMGRAGRLAPGNCYKLWSKSQDGSFPEFSTAEIEKSDLTPFVLELALWGGNVDDLALLTKPNKNAGEVRNFL

SEQ ID NO: 14651 - protein, 775 aa, Rudanella lutea
MPEGLLADLGYLAGVTHDVAKGTRFFQIYMLSPDHKVTGPKEHALLSALLAKVVVKQYLARFDLNETDRKLLPYLVFTAVKRHHGNLKDFADELYLEEKANILSEQIAAFQDEGETEAILNELLSVVDFSFDWASFKLYIEEQAYLDEYGDFSLDFFDLGEYEDLPADAKNRYFYWHQLFYGTLLLSDKSDVILKGIDVPSATQPALAALETYRQQKGFDKPQSSLDKLKNQAYQETLEAVSRICKPEQHLYSITLPTGLGKTLTSLAVGLALQQKLRLEAGRLVITIPFTSIIDQNFGVFQDVFNNPTSDILLKHHHLAEPAYKVGDDTLDQDKSQFLIETWQSGIVVTTFVQLLETLFSNDKTKLLKLPNLANSVIILDEVQQVKYELWPLIRQTFKTLGERYNCYFVLMSATQPLIFTPDEEITELVPNYRNYFKSPHFNRTRLINRTRQEVSFKEFQQDVIDYCQGNPTKNVLVILNTKKATLECFKTVATTLGEDKTDVYYLTTLITPYERKRIIDRIKKYKGPKQQVIISTQLIEAGVDVSVDTVFRTMAPLDSIIQAAGRANRYNEKAVPSEVFLYAVAEMKRASGMVYGGDLLIKTGNVLKAVSETDEHGYLSLIEAYFEEVRKQADVLVSQELTALQALEFEKVGKFQFVEDQDTESVYVQLNEEAEQLWEQYVAISNRQDLKPYERKREFALIKARFYEYVVNVPLPYLPNGGGKASQIVFDSEKEHFFYVSRRSNPSACYQYNHDNFRQNTGYASVSQPLTHHH

SEQ ID NO: 14652 - protein, 952 aa, Rudanella lutea
MTTEPWRLFWAKTNREKIEGLPDDWTHPLWAHLIDVGSAAQVLWDNFLTPRLKQKMADALGMNLTDAGRFLSIWIGLHDLGKGIPSFQGIPGAAPEVVYKLAEAGLHVHPEANRLHHGHASIAIVRRWLHLDIDEDRQGKPLPESLLDALATCVGIHHGKLSLRRITDGVAEDKRIVAALGDNHWKQAQLDLANAVFNAWGANWPKTGRQNVIDRRSRSGWPDWMMAFAGWATLADWLGSMQTCYDHTVRADDDLATYLESSRAGAMKAYQAAGLKHQAKLRVKSFKAHFGNRPRPLQSIARKVSLDKNTPNLLIVEAPTGEGKTEAAFYLAGRFGQGIYAAMPSQSTSDGLYPRLAAFLKGDKEKKLRGAHVGDTAALRLVHGNDLLRDDALSLLAVEDLTASIVDDDDDERTLPGDTGAKNHLLSWFMPKKRALLVPYGVGTVDQIFLGVLFAKHFFLRLFALCGKTVIFDEVHAYDTYMNTLFGRLLPWLRALDINVVVLSATLPGEARRQMITAWGAQPDLEENSALAPYPVTWQVAGGQMISHSFKPDSKRGQRLTFQWCSEEVSALAKLARKLIGEGATVLVICNKVDRAQELFSLLDDDVLLPPEDRLLLHARMPQAWRQDREEKARERFGPRRPDRPGLLVGTQVIEQSLDLDADAMITDLAPVDLLLQRAGRLHRHHRDNRPAGYETPVLYIACPKAEPGELPNVDELSAAGRIYGRKLLWQTWAVLQHRKGWALPLGDATLPGYRELVEAVYTQQFSFSQPLNPAAQVDYEKANDDWNARNGRQQADADGRLIPPPNHMQDLFQAKENLLTEDEDNPNGNVPKHLQAFTRDPEGVNAEVLLLHRTDDGWGLTPTGPTLIRRGKKQYMTPELLRSIFGAAVRISHGGIVSALWKEPNEDWQQQQEENRLLKRFQLIELTHYTAVVGGVHLELNERLGLIYNKP

SEQ ID NO: 14653 - protein, 762 aa, Brachyspira innocens
MNKNEYLAKSSKKNYYDAESLEMHTKKLIKLFEDFLLKYKNQFKQKEIDLIRTACEMHDLGKINYKFQKEMYKKSCMHFEENKNIEVFYKKYKNIKNIPHGILSCCFINEDELKQKYDFDYNDLEILATSIYNHHNREFDLEDSEIFEKIIANDLNINAKNFGIEYCSSDGLMNNKIKNNVFQLKPKYLYNFWIKFIIIKGMLNKLDYAASTYLYNKKQIGIDTLELEPFDPKENIETKFNKINECQKYMLENKDKNVIVIASTGIGKTEGALLWAGKSKTFYTLPLKVSINSIYERIKNNYYDKEKISFLHSDSKMMMRKEEKEGEEDYQTKYIETRHFVYPFIVCTVDQIFYFVFKSLGTEKFPATLKYSKIIIDEIQSYSPDIIAFLIFGLKVINDLGGKFLIMTATLPPVVTHFLKENIGEKNIADIKTFYKKDNKENIIKRHFIKFIDEKEFDYNKISKSAEDKKVLVICNTVKHSQEVYNILKEYNIKNINLLHSRFIMKEREKKEDDIKNFAPNDINKRKETYGIWVSTQIVEASLDIDFDELYTDMSSADSILQRMGRVYRDRSYNKNEPNIFIYNTKIGIPYVYEQQIYDYSIESIKKYNNKIFTEKDKQKYINEVYDIEKLNQGKNNYYETIKSKINTLLNFPINGLEQKDAKIQFRNINSITVMPQKFYKELEEEKIFEKYDKSFGEEKINILEEIMHYTMSINYYFNRYCNNKISNDNLEHIYITQLKYDDNIGLSNDIDDEADIDSRFL

SEQ ID NO: 14654 - protein, 727 aa, Salipiger mucosus; identical to SEQ ID NO: 13039

SEQ ID NO: 14655 - protein, 730 aa, Clostridium  sporosphaeroides
MNYYAHSPKDGMDAQTYVAHVRGVSLLADRFVQEAGAFSKEDGLLLRQLAIRSAAYHDIGKLDEENQKVLSGELSAKSLPINHVDAGVAHWLDKQHFSAFAAAVTQAHHIGFPDFSDEQNKGDFIFRDEVIAADVDKKLPLFESIHKDFVGQGSDNFIEETISGDRSVFLRMLLSCIADADHTDTARHYGKYPQTERVVLLRANERLDRLNECVLNLQKSGVATERNALRSQMYQACRDSAINTGICSCDSPVGSGKTTAIMAHLLAQAQKRGLRRIFVVLPFTNIIQQSVKTYREMLTLPGENPEAVVAELHHRADFENEDVRHLTALWCAPIIVTTAVAFFETLASNSTAALRRLHELPGSAIFVDESHAALPTTLLPIAWKWMRILSNEWNCYWVLASGSMCRFWTIKDIAEQSDALCVPEIVSPDIRNKLEAYEVSRITYRYKPTPMSTDELASWIVSFPGPRLVIMNTVQSASVLADYICNIYGRTKIEHLSTSLTPNDREATLKCVQDRLRNKSDTDWTLVATSCVEAGINFSFKIGFHELSSLSSLLQAAGRVNREGNDNKAEMWTFRIVEDGMMKINPGLKQAGEVLKDYFERNVHISPQLTTKSISDEIALYGLRGKPYELIKNEALQNFQSVERDFKVIDSDTKLAVVDAEIVSQLRYGKISWKELQKNSVQIAKYKLHEMKAPLIVDNIYYWDSGYDSFLGYMSGIIQLKKYAGQALII

SEQ ID NO: 14656 - protein, 803 aa, Clostridium  sporosphaeroides
MKSHLAHITEINGERMEQTVAEHSLHVAGYAAEKLRGIGLPNTAYLAGLLHDMGKCTANYQEYLLRASAGEEVARGSVNHTFCGCIYLLKQYHAGRPQGMGTVTCEIIVYAVGAHHGQFDCVTPQNTSGFEHRLEKDPKEIDYEEAVSAFLLECAPAEEIDRLFLLAQQEIAALFEAFRARFRKNRTQVSFLMGLAARMVLSAVIDGDRRDTAEFMTGMPQEYCGGSSRFWAEQISFFEQKVSCFRTQTPINAARSGFSEQCRVFARQHGDGIYRLTLPTGAGKTLSALRYTLHHAKAFHKKRILFVIPLLSILEQNSAVIRDYIQDKSSLTEHHSNVVKLFDTKEELNQYELLTDTWESPIVITTLVQLLNTLFSDKTGAVRRMSALSQAVIVIDEVQSLPPKTMNLFTMALNFLAYGCGATIVLSSATTPCFEQTDFPLQYASPVEIVPYEPEAFVVFKRTEIIDKTSPYGMSVEELADFSAEILSRVSSLLVICNTKESALRLYRELAHRCDDCRVFHLSTSMCMAHRTDTLKKINDALKSREKMVCVSTQLVEAGVDFSFESVIRAAAGMDNIAQAAGRCNRSNDFGGIRPVYVVNLNQEAEKLGMLREIAAAQRCALQLLHRFAQNPDRYERDLLSGESVAEYYRFLFQDADIKGKFGFPQRLPDGTTEDLFDLLAVNLRHIERPEFQGKYFLNQAFLTAGHLFQVFDETTTDVIVPYNDEASKLIADLFAEKSAYDLAFLKRCVERAKPYTIQVFQYQIQKLSDYGMLSLTPDKRFTALNKQCYNDKTGLVIENFIY

SEQ ID NO: 14657 - protein, 766 aa, Hyphomicrobium zavarzinii
MHYAHSTEREDRADWQSLVDHLRAVAELAGDRGSKFGARKAAELSGWLHDLGKYSSAFQTYIAGRGQSVDHSTAGAREAMKLAAPGTMDKLIAELVAYAIAGHHAGLPDRQGVSASLDSRLKDKKLPDLDPVWAREIEPESRDLFPARFILQRKSREQAAFQLAFLGRMIFSCLVDADYLDTENHYAQVSGGPVDREWPSLKNNVDGLVLAFDAHMERKLADIPQAERGTPLNILRSDILAQVRSKAAMPKGVFTLEVPTGGGKTLASLAFALEHAKRWSMDRIIYSIPFTSIIDQTAKIFGDVLGENIVLEHHSQLETNARSEADDRCEDQMPEAKLRRAMENWDAPLIVTTNVQLFESLFAHRPSRCRKLHNLANAVIILDEAQTIPLHVLRPCVAALDELARNYGCTIVLCTATQPALLAPSFAGGFETTQELAPDPAKLHDAFRRVTLRVAGELSDDALISELSQVERGLVIVNSRQHALALYRAAKMKGLESLVHLTTRQTAADRKKILATVRSKLDAKEPCRVVATSLIEAGVDISFPRVWRAEAGLDQIIQAAGRCNREWERPKEDSFVIVFRPTEAEPPKEIKDFAAAMTRVAPRHSDLFSQAAIELYFKEVYWHKGDGLDRIPVKNLNGENVKGSVQESFALDGGTTNFSYRTVGEAFRLIKDGMEPVIIAIDDKPKEVLSALRGGMPAGKAARELQGYLVQVPPKHRNALIENGHAAFVEGFDTQFVVLKTESFYSREAGLVWEKADELGIEGNTI

SEQ ID NO: 14658 - protein, 876 aa, Halarchaeum acidiphilum
MPRRYSHPPENGDDGTGLSEHLRDVAARLEHVVPEDATTPSGESLRAVVRTLALVHDFGKATTDFQRYIGVLDGEPESPLRRYHAPVGAFAAYYALDSRGFETETCVAGFVAVGKHHGRLPDVADYVYGRAHRRDGVSGREQNPAERQQLAIGDQLADIDGNARALAADVFEAATDGNGSWAAFFDGFGGLLGDVEEAVASTGSGPGASRDALSESCYALVLQSWSALVLADKTSAAGAPNDAATYAAAEPSLDTLDAYVETLEAEASADADGTRAERLNHHRSRAREDVLANAASFAASGGGVATLTLPTGMGKTLTGLSAALDLRDRLDGERVVYALPFTSVIDQVVDEVETIYDTDAGSRLLTAHHHLAETTLDGTGADDGATADTADLDDDVAGMLAEGWRAGLTVTTFVQLFESLAGPRNRQSMKLPALRDAVVVLDEPQSLPIDWWKLAPRLVELLTERYGATVIAMTATQPDLFAGETELVDDPGSYFEAVERVSYRLDESAARYVNDEGSGETDPKPYGAAASELSAAVDGGGSALAICNTIESARELTDRVRDELGGVTDVGAVYADLLDAVSTADDVTGDALADAVVNASGGDVALLHLSTRLRPVDRLTFIEAAKALTDRERPLLAVSTQLVEAGVDISFERVYRDLAPMDGIVQAAGRCNRSFERDRGRVTVWWLDAPGEQEKTPGEAVYNRGTSLLPVTAAALRTTRGDDGSLTETAVATDAVDEYYRRLHEDRDVGSRAYADYVDDARGDALGQLSLIDQRRSVDVLVCRTETERARADAIRDAVATHEFDALRALLTETKPLRVSVPVYRGDEAAADAIGRLTPLVADDGLYELDVRDLPNYFDETTGFRIPESTVDHQFL

SEQ ID NO: 14659 - protein, 669 aa, Cloacimonetes bacterium SCGC AAA252-N05
MFRNLAKPDETIIDHTLSCLKVAKELTSIFEKEIINNLNSKNISGKELLLLSVLLHDSGKYAQPFQNKTLNVDYKGFWGYRHEIFSAEFVNLLSDLNDTEKNLMKLVILSHHNKTINHLEKATYKESSGFIIPGLNLDAMNENRKEAYKEGKSSIQKYHKEIFSEIQEILNEQNLKINLNYNVDLLYNVFELINEYYRYALNYEDKYNFEKLIFLKGLLVTSDHLGSAHQQIKKIEIDIRKFYKTKFDIPKNGNFRTTQIKCMESKGISAILKAPTGTGKTEASFLWANENLRSNHYSRIFYILPYTASINAMYERLNKSDFSKDKVEVLHGKSTAYFFDLIIKGKSEEEINENIEILNKETKLRKLTAKSFASPIKIVTPHQIIKNIYGLKHFEEAFLQYKNGLFIFDEIHCYDRMFLSELLVAMKIIRDDFNGKFLFMSATFPKIIEELIRKYLNIYYSTIQFKNEELVNYTRIKLNLIDGFIEDEINIEIIQNEIKNGKRVLIVCNTIKKVQEIFSKLKCKNKKLLHSAFNTEDRKIIEEEIINSESSKEKIQVLVGTQAIEVSLDLDYDCCYTEIASIDALIQRFGRVYRNRKRKRNDFGIVNVFIEADNITKLIYNEKISNEEYDIISKTYNESYIQVISATHIIYLNTHKILHTVFCILIIFL

SEQ ID NO: 14660 - protein, 797 aa, Candidatus Cloacimonetes
MFSSKIYSHPDKLLFVHLQNVAASCLKKFKETKHNMSSYFTNNYWEKLVWLMGFSHDFGKATSYFQKYLFEKDEEKRTTMKNQPETGHSLISAVLSFWIAKEYVKDKEDEFLQIMPFYLYLMVKKHHGNINNPIPFSDESNELDIPIEHLDRQLDAIDKKELQFLFDEINNRLSLTIKVTDIPRSLNEYFVTELRRKEKKFFKKFHKKIEYYLIFQFLYSLLLHSDKEDAIFGNVDNDHRVNIDDDLIERYKTLKFGKPVTKIDKIRESIFQDANSKILQINLKYKIFSLNVPTGSGKTLTCLSTALKLRTRLEKSGIKPRIIYGLPFTSIIDQNYEIFDEILKNPDSNILLKHHHLAEISYNQKDNDAEFESGQAKFMIESWESEIIVTTFFQIFHTLFSNRNRMIQKFHKLANSIILLDEVQTIPYKYWKLVRETLLKISELFNVYFILITATQPRIFEPDEIIELVPNKSEYFAQFDRVNLDFVSESIVLQNFIKKCKNEIENSDKSYLFVMNTINSSIDLFQHLTNMKLDADYFYLATNIIPKHRFEKIKNIKKSKNRKIIVSTQMIEAGVDIDIENVWRDFGPLESINQVCGRCNRNFSDKKGNVRIFEILNENHNNTPFSKYIYGKSALSIIETKESLGRKTKISESEFLKNMDSYYQILKEKIANDESEIILRFLANLQFADLYKSFKLIDDKLYNKKDVFIEYDETAIEVWQKFVNLKHIKDTFKRKTEFLKFKKDFYDYVISVPEKYVPENEHENTGIVYISNEQVESCYDKHTGWIRTNDNYDDYVF

SEQ ID NO: 14661 - protein, 552 aa, Aigarchaeota archaeon SCGC AAA471-E16
  misc_feature (450)..(450): Xaa can be any naturally occurring amino acid
MLREYYHRALHALGYKTERKFISEAIERIETSWGEKNLFVIEAPTGYGKTTITASLALMTCEEAGKLIVAYPLRTLLEDQYSKLRNVVDEQRLGKRYMHEESSPYLIKPITLTTVDTLSLTMFGLAPEDLNVVVRGWEEDRFVNTSRGHYLFSWSSVMMSDIVLDEVHLVAEESKSLTFLVAMLEHIISHDQRVVFMTATMPTRFKELILGSLRRFRDRVEWMEFRSTAVDDEYIASCLEKRPEIRIQQLSSDTKFDVIKSWLDDALERGFSRVLVVFNTVGEAVSFYRTLDGYENRLLIHSRFTESDKLAKHERLQRLKSEGKYIVVATQVVEAGLDLSSNALITDLAPMCSIIQRFGRLLRYEGEREGVAYVWYESDLGRDRQLYKVYDRGLSAATLDALREAERGNVSLHVPSGERGYKRLLDKVYQDADLRINYREIEEMLSVFTXLDDISKAVDLFFKMEGSFVRESALVPVRCPEMKEEVSVEMRVFERLLKEGLVKGHIVGNGEEEICELPDWLSIGSKIQQRSLARKVIKHIHPKKPLTSLVSS

SEQ ID NO: 14662 - protein, 733 aa, Pseudomonas syringae
MWSQGWTSLRDAQEWAIPALIEADRDVIIAASTAAGKTEAAFLPILTNLLNSAHPPGAVLYISPLKALINDQWDRLTRLCERLEIPVVGWHGDVSASKKHKFLKSPSGILLITPESLEALFVNRGSALAGLFQNLRYIVIDELHAFIGSERGKQLQSLMHRVESVANRKLPRVGLSATLGEMALAREFLRPGQTRRMDEIISRASGQDLQVQVRGYTMLPLKKLLASEQAAIAKDDDDEEDASGTRHAIAAHLYKVLRGSNNLIFPNSRDRVEWYADRLRRLCENDGLPNEFLPHHGSLSRDLREDTERALKAGTPPASAVCTTTLELGIDIGNIRAVAQIGPPPSVASLRQRLGRSGRREGEPATLRAYCQESTLTPESGLSDQLRQDLVQTIAMIRLLIEKWFEPPRANGLHASTLVQQCLSMIAQQGGASAVELWTSLVASGTFAAINKADFMTLLKALGEKKLIVQDSSGLLLPGEIGEKLVNHYEFYSAFTTDEEFRLVRDGKPLGSVPVSRPLTLGQRIIFGGRRWQVLDVDLEKKVIVVMPARGGEPPVFDGLGAKIHDRVRQEMRAVLTESSPCPFIDANAQALLEEARQTFHRLGLADQYLTGSASSSYLLSWAGDYTNDALCLLLNQSGVMCSGSGLVLEIGASRESALAALGRIAELDANDVEPLLKDVKNLIREKWDWALPKSLLIKSFASSQLDIPGAIALAKALVLHERDAVLTDPPST

SEQ ID NO: 14663 - protein, 760 aa, Pseudomonas stutzeri; identical to SEQ ID NO: 13030

SEQ ID NO: 14664 - protein, 700 aa, Megasphaera
MAERFASIFDAAEWGKMAGLYHDIGKYSAAFQQRILEEGPRVDHSTAGALLMKKIKNVPLAFCIASHHSGLLNTGTRLSKADDGTLKGRLKKELKGKLDYSAYRQELPEPLPIRKAPAFLYGKDRFYYSFFIRMLFSCLVDADFLDTEQFVNAGKVQRGGFATMQELHDLFFAYYATFGEPTTPINQKRQEIYQQCLDAAEKEPGMFSLTVPTGGGKTLSSLAFALKHAVKYKKQRIIYIIPYTSIIEQTADIFRNILGDGNVIEHHMNVDYDKDDNKEDNDKKEDDGLNRKKLATENWDAPVIVTTNVQFFESLFAAKTSRCRKVHNIANSVLIFDEAQMLPEPYLRPCIRSIGELVANYRCTAVLCTATQPSLETYFSQIGEGLKVREICPDTQGLYEFFRRVTYRFMDVDSLESLAAQLKEHEQVLCVTNSKKDARDLYQMMAGDGCYHLSTFMYPAHRRRVLAIIRQRLKDGLPCRVISTSLIQAGVDVDFPVVYREIAGLDSIIQTGGRCNREGKQRTEDSTVYIYDLHKPMNRIPAFVRRPIEITQMVAKHHADIASAESIKAYFDQLHYTIGEDQLDSKNILKRLEGNTPDFTEIAKDFKLIEEDSRPVFIPVDDDLDNQKILTQLIASVCNRSILRKANQYMVSVYENQFEKLWETNKLDALDLGLYVLKDPAAYDPDTGLVVNMEDGIGIF

SEQ ID NO: 14665 - protein, 733 aa, Pseudomonas syringae
MWSQGWTSLRDAQEWAIPALIEADRDVIIAASTAAGKTEAAFLPILTNLLNSAHPPGAVLYISPLKALINDQWDRLTRLCERLEIPVVGWHGDVSASKKHKFLKSPSGILLITPESLEALFVNRGSALAGLFQNLRYIVIDELHAFIGSERGKQLQSLMHRVESVANRKLPRVGLSATLGEMALAREFLRPGQTRRMDEIISRASGQDLQVQVRGYTMLPLKKLLASEQAAIAKDDDDEEDASGTRHAIAAHLYKVLRGSNNLIFPNSRDKVEWYADRLRRLCENDGLPNEFLPHHGSLSRDLREDTERALKAGTPPASAVCTTTLELGIDIGNIRAVAQIGPPPSVASLRQRLGRSGRREGEPATLRAYCQESTLTPESGLSDQLRQDLVQTIAMIRLLIEKWFEPPRAKGLHASTLVQQCLSMIAQQGGASAVELWTSLVASGTFAAINKADFMTLLKALGEKKLIVQDSSGLLLPGEIGEKLVNHYEFYSAFTTDEEFRLVRDGKPLGSVPVSRPLTLGQRIIFGGRRWQVLDVDLEKKVIVVMPARGGEPPVFDGLGAKIHDRVRQEMRAVLTESSPCPFIDANAQALLEEARQTFHRLGLADQYLTGSASSSYLLSWAGDYTNDALCLLLNQSGVMCSGSGLVLEIGASRESALAALGRIAELDANDVEPLLKDVKNLIREKWDWALPKSLLIKSFASSQLDIPGAIALAKALVLHERDAVLTDPPST

SEQ ID NO: 14666 - protein, 525 aa, Pseudomonas syringae; identical to SEQ ID NO: 13031

SEQ ID NO: 14667 - protein, 722 aa, Pseudomonas syringae
  misc_feature (528)..(528): Xaa can be any naturally occurring amino acid
MWSQGWTSLRDAQEWAIPALIEADRDVIIAASTAAGKTEAAFLPILTNLLNSAHPPGAVLYISPLKALINDQWDRLTRLCERLEIPVVGWHGDVSASKKHKFLKSPSGILLITPESLEALFVNRGSALAGLFQNLRYIVIDELHAFIGSERGKQLQSLMHRVESVANRKLPRVGLSATLGEMALAREFLRPGQTRRMDEIISRASGQDLQVQVRGYTMLPLKKLLASEQAAIAKDDDDEEDASGTRHAIAAHLYKVLRGSNNLIFPNSRDKVEWYADRLRRLCENDGLPNEFLPHHGSLSRDLREDTERALKAGTPPASAVCTTTLELGIDIGNIRAVAQIGPPPSVASLRQRLGRSGRREGEPATLRAYCQESTLTPESGLSDQLRQDLVQTIAMIRLLIEKWFEPPRANGLHASTLVQQCLSMIAQQGGASAVELWTSLVASGTFAAINKADFMTLLKALGEKKLIVQDSSGLLLPGEIGEKLVNHYEFYSAFTTDEEFRLVRDGKPLGSVPVSRPLTLGQRIIFXEKKVIVVMPARGGEPPVFDGLGAKIHDRVRQEMRAVLTESSPCPFIDANAQALLEEARQTFHRLGLADQYLTGSASSSYLLSWAGDYTNDALCLLLNQSGVMCSGSGLVLEIGASRESALAALGRIAELDANDVEPLLKDVKNLIREKWDWALPKSLLIKSFASSQLDIPGAIALAKALVLHERDAVLTDPPST

SEQ ID NO: 14668 - protein, 756 aa, Pseudomonas syringae
MNSPVSSSDSYAFEQLHPDVQQWVWSQGWTSLRDAQEWAIPALIEADRDVIIAASTAAGKTEAAFLPILTNLLNSADPPGAVLYISPLKALINDQWDRLTRLCERLEIPVVGWHGDVSASKKHKFLKSPSGILLITPESLEALFVNRGSALAGLFQNLRYIVIDELHAFIGSERGKQLQSLMHRVESVANRKLPRVGLSATLGEMALAREFLRPGQTRRMDEIISRASGQDLQVQVRGYTMLPLKKLLASEQSAIAKDDDDEEDASGTRHAIAAHLYKVLRGSNNLIFPNSRDKVEWYADRLRRLCENDGLPNEFLPHHGSLSRDLREDTERALKAGTPPASAVCTTTLELGIDIGNIRAVAQIGPPPSVASLRQRLGRSGRREGEPATLRAYCQESTLTPESGLSDQLRQDLVQTIAMIRLLIEKWFEPPRANGLHASTLVQQCLSMIAQQGGASAAELWTSLVASGTFAAINKADFMTLLKALGEKKLIVQDSSGLLLPGEIGEKLVNHYEFYSAFTTDEEFRLVRDGKPLGSVPVSRPLTLGQRIIFGGRRWQVLDVDLEKKVIVVMPARGGEPPVFDGLGAKIHDRVRQEMRAVLTESSPCPFIDANAQALLEEARQTFHRLGLADQYLTGSASSSYLLSWAGDYTNDALCLLLNQSGVMCSGSGLVLEIGASRESALAALGRIAELDANDVEPLLKDVKNLIREKWDWALPKSLLIKSFASSQLDIPGAIALAKALVLHERDAVLTDPPST

SEQ ID NO: 14669 - protein, 756 aa, Pseudomonas syringae
MNSPVSSSDSSAFEQLHPDVQQWVWSQGWTSLRDAQEWAIPALIEADRDVIIAASTAAGKTEAAFLPILTNLLNSAHPRSAVLYISPLKALINDQWDRLTRLCERLEIPVVGWHGDVSASKKHKFLKSPSGILLITPESLEALFVNRGSALAGLFQNLRYIVIDELHAFIGSERGKQLQSLMHRVESVANRKLPRVGLSATLGEMALAREFLRPGQTRRMDEIISRASGQDLQVQVRGYTMLPLKKLLASEQAAIAKDDDDEEDASGTRHAIAAHLYKVLRGSNNLIFPNSRDKVEWYADRLRRLCENDGLPNEFLPHHGSLSRDLREDTERALKAGTPPASAVCTTTLELGIDIGNIRAVAQIGPPPSVASLRQRLGRSGRREGEPATLRAYCQESTLTPESGLSDQLRQDLVQTIAMIRLLIEKWFEPPRANGLHASTLVQQCLSMIAQQGGASAVELWTSLVASGTFAAINKADFMTLLKALGEKKLIVQDSSGLLLPGEIGEKLVNHYEFYSAFTTDEEFRLVRDGKPLGSVPVSRPLTLGQRIIFGGRRWQVLDVDLEKKVIVVMPARGGEPPVFDGLGAKIHDRVRQEMRAVLTESSPCPFIDANAQALLEEARQTFHRLGLADQYLTGSASSSYLLSWAGDYTNDALCLLLNQSGVMCSGSGLVLEIGASRESALAALGRIAELDANDVEPLLKDVKNLIREKWDWALPKSLLIKSFASSQLDIPGAIALAKALVLHERDAVLTDPPST

SEQ ID NO: 14670 - protein, 744 aa, Sulfobacillus thermosulfidooxidans
MAIYLAHTAPKHGGHPQPLNDHLRTVRDLAAQFAKPLGYEDEAGLAGLLHDCGKYGDRFQQRLQGKMAHVDHWTLGAYWAFTVRALAASLAIQGHHVGLQQFSSPFFQSLRDLIENQGRSAAGFVMAGDATDTLTRFIEDGFAINAPTRPVINSYPDSRKAIEFMLTIRFIYSCLVDADFLDTEAHFNQTPDGHKTFRERPPNLNPARALELVKQHVTRLTEISTASPAIQKLRNAVWSAALTASERPGNLWTMTAPTGSGKTLAMLAFALNHAQQFRKRRVIVALPYLNIIEQTAMVYRAVLAEMGVNYVVEHHSLAERNADDQEGSGRLASDNWDAPIVVTTTVQLFESLFANRPGKARKLHNLVDSVIVLDEIQTLPLPVVVPTVAALAALGKVYHATVVLGTATQPAFGCLQPALESITQAQYDPQEIVPTLPPLPVRVHWELRDEPQSWEAMAVELRDYPSFLAIVNLKRHALELAEALGEEDDDSFFHLSTNMCSLHRSHVLDQIRKRLKDGLRTHVVSTQCVEAGVDVDFPVVYRAWGPLDSLVQAAGRCNREGGLPYPGRVVIFQPQDDAYPTGPYQQATQIAKALWREDVFHLDEPEAMRLYWERVYGTTRPHETYSELLEAIQVWDFAGVGERYRLIPETTLQVVVPYAEAFDLYESLVLEARQRGLTRGWSRRAQPLSIGLFRPSPDSSLWSYLEPVLSDQGQESGWWIFRDRAYYSARYGLRVPNQWSLWYS

SEQ ID NO: 14671 - protein, 862 aa, Sulfobacillus thermosulfidooxidans
MSRNEGEKCWAKSILRENISVSHLSLAAHCLDVALVFRYLVDLDSIRRALQKMFGTDLSDVLCDRLAVLAGLHDIGKANVGFQQRLRGKGPRAGHIHELAPLLDSEIAASELQESLVHVLSPLLEWFANEESAYSYLMVTFSHHGSPLFFQGGMSGTFLLARDQWWRPSDHYDPFWEISTVVSWLQQAFPRAFDSHAAPIPDSAPFEHRVAGLVTLADWIGSHSEWFPLKRVEFAERYKEDRANIPAILRTIGLDVSRLRPLLTLSTFSERFGMDPRPMQAVCESLSPQDPDNALLIWEDDTGSGKTEAALDWFYQLFSAGKVDSLYFALPTRVAAAALYKRIRKLINHWFPPDSERPVTVLAVPGYPEPTQVPALPDATHGLRYEESRVQDHQWAAERPKRFLAATVAVGTIDQALLSIIQTRHAHLRSVLLDRALLVVDEVHASDPYMARLLETLLQHHQAAGGWAILLSATLGSSLKRRLLPSLNVPASVAEAQTVPYPAVTNATGLPIRPATAVSNREVEFVVQPWYFQLSSIVAFVANALANKASILIILNTVRRSVATFRLLEQDLRIQPYLLRCEGQTAPHHGRFAAPDRVLLDDAIQKLFDKDVEVSPRVAVGTQTLEQSLNLDADLLITDLCPADVLLQRVGRLHRFRSRKRPAAFSTSQCVVLVPPEDLVNGLSPEGRPFSRYTQHGLGSVYSDLRILELTRRAILSQRFWVFPRENRKLVEETTHEEALAQLPDPSWIRHAQDVTGHIIADRVQAGTMITAFHKHFGTFQFNEAGGKVATRLGLDDLHLPLDKPIQSPFGETVTTMIIPGHLRPKTFEETITVELSQSHRAVLKLGDKQYQYSHVGLEVLN

SEQ ID NO: 14672 - protein, 864 aa, Nocardiopsis potens
MRSNELVMDSAEQMTERSKAPHGVAGQLLLAAWLQGRGWSKREVQQFSVVVGGHHGVPPGDMDLQEAAQEPALLYGPAGTESWRQVQGELLDGAAAACRIGGRLPAWRSAKLPQPGQVLLSALVIVSDWIASNSALFPYFRQAGGAGAERVSQALQRLALPAPWRPRPPRGGAQEVFAARFSWAEEARVRPVQQAALAAARAMEGPGMLVIEAPMGEGKTEAALVAAEVLAAASGAGGCFIALPTMATSNAMFPRLTEWIGSLEGVGTASVFLAHSKAALNEHYADLLFGGQEPVQDVDRDGSPDRRGGASGGLVAHRWLRGRKKGMLSDFAAGTIDQLLFAGLKSRHLALRHLALAGKVVVIDEAHAYDTYMNTYLDTVLAWLGAYRVPVVVLSATLPARRRRQLVEAYCQARRGAPEFDPVEQAEGYPLLTSAVLGSPPRVAALETSGRKTEVHIERLADDLWLLSRRLGEELADGGCALVVRNTVKRVHAAVRELREHFEGTDVEVSVAHARFVDLDRAGKDRELLASFGSPAKVAELGGRRPAHPRVVVASQVAEQSLDIDFDLLVTDLAPIDLLLQRMGRLHRHLRGEGQSERPKRLRTARCLITGADWERCPPEPDGGSEFVYRPYPLLRAAAVLAPFLEAASAGGETGVVRLPDDIDGLVQQAYGPGPAGPPEWGEAMGKAAEEHLLEQAKKADDARAFLLGAPARPGRPLTGWVEAGVGDADDTPRGRAQVRDTGESLEVLVLQQRADGALTTLPGLGEDRGGIELPTEFAPPEDAARIAAASALRLPFPLVRPDVIDRVIGELERDCFPAWQGKDAHWVAGELLLVLDEECRARLAGFDVHYSHEDGLEVTDGQW

SEQ ID NO: 14673 - protein, 819 aa, Candidatus Poribacteria bacterium WGA-4E
MNILGKPNQTLSGHIRDCLTVCDEMFVRREPFLRNFCEQYDWDWEEVRCCIRFAVWFHDIGKASDQWQKYIREQGPSVTHALPSFAIGAMSIGVREFERSPRFAALFAILAHHLQMLHDGSFPEERNRRSVDMPVTYVTEHLAYFREFEPDFTLTDRQMPQKIDLGRTCNILDRIKTDVHGETDLQFKVLYSLILNMLTASDNYASANGPDDGSPDNPCGTNLTQDTLAQINNKFPLYNNAPLKVLPFLPEGVMPNDMQREIVASDSDRLILNAGCGEGKTAAALLFGQKWLRENRIERIILTLPTKFTANNLYRDLVSPEKYDIPEKLVGIIHGDSREFLTQLSTEEEARGETEEANANLIAQVFENNFYAKPVTISTVDHLLMSLYHGYKYADRAFFNVASSLVVFDEVHYYEGRTMEAIAEAMRRLTQLKIPHLVMTATIPTAVRQCFDELNHGQPYPFQRAPALIPDTATPKAPFEITRLHETPLDEENIISSKLLNLVEQNQNKRQIIFVNQVNRAKNVYRVLREHGIRDNLICYHSGFIGKDRVKKEKIIRSLFKDPSDRDDGELEVLEECSFNNSNACVLVSTQVSELSLDISADVMYSEIAPIDSIVQRGGRLNRKGASPFDEQTGYICRLYLMPAYGDERACLPYEPSILQKSWEAIGDLYTFQDACAWVDVVYQECQPLMHNELSRAIHTDLVFGKRPQDNYAGETEEEGRVVIREQRYQTYDVVPLEFAELVVENYQQFRNHHLSISAGAFWKAKENNQLYSRESKLELGNRRTGNGRINQIPFTAINATYTFDIGLEIGLERPTNML

SEQ ID NO: 14674 - protein, 723 aa, Hahella ganghwensis
MSESNSFNRLSHGVQRWIYRQGWQSLRAVQEKATPVILDASKDILITAPTAGGKTEAAFLPVISWLEDRGPECGYGVLCLSPLKALINDQFQRLEMLCESSGTAITPWHGDISSSLKKRSWKSPQGVLLITPESLEAMFVTRAHELKARVQNLHYVVIDEFHAFIGRERGQQLLSLLARLEQLIGRPLCRIALSATIGDPDMALGFLRPDGSRSGIHLDVAHESLQLQLMLKSYIPPQDDLPVSIEMAQDLFLWLRGSSHLVFANSRRTVEEITDRLGKLCETRGLPLEFFAHHGSLSRDVRHFVEQRLKGGEKPTTAVATSTLELGIDIGEVTSVAQIGAPANVSSLRQRLGRSGRREGTPAILRLLVTGHGDRNNPSPIDLLEAELFQAIAVIELMLERWVEPPDQYSLHLSTLVQQILSMIAFKGGINAASAYRTLCQQGPWQNITPDFFARVLRGLGANQVVRQLPTGELIVDDVGERIVSSHTFYTAFEVPEEYRLVAKGKTLGTLPLTTPYMEGQLLIFSGRRWAVQSIDPQAKVMTLVRAKSGLAPTFGGESAPVHQRIRQRMRELYLRDDLPRFCDSQSAELVARARQYFRDRHVDTRHFVQDDRNLFWFIWDDDRMLDTLKILATLIDHPADRMGPCIMVQYTGDPRHLISKIHDYLTDYTQDDLATEIKPQPLGKFDESLSEDVIREAFVREKLDVERAAAYISGLMANLARD

SEQ ID NO: 14675 - protein, 707 aa, Candidatus Methanomassiliicoccus intestinalis; identical to SEQ ID NO: 11992

SEQ ID NO: 14676 - protein, 731 aa, Verrucomicrobium sp. 3C
MAVATLAAEMAAPLRLEKAAYLAGLLHDLGKYTADFQSRLAGANVRVDHSTAGAALLLGDLAKGCDRNIADLIAYCIAGHHAGLPDRLNETAACLNRRVEEWTAELDPVWASELSVDASGLVPNFIEEHKPQDRQDAAFIFSVMTRMIFSCLVDADFKDTGAFYSALENRQVDRSWPSLQELLPQFIKRFDAYMRGRSNAVAEINRLRSDILAHVRGKAAQKPGLFTLTVPTGGGKTLTSLGFALDHARAHGHTRIIYTIPFTSIVDQTAEIFREILGDDNVLEHHSAIDDEEADPKETSDSRDKLKLAMEDWAAPVVVTTNVQLFESLFAARPSRARKVHNIANSVIILDEAQTIPRQLLKPCIRMLDELALRYGCSVVLCTATQPALDRRELDGGLPLEGRELAPDPHGLAEKLRRVRIVRVGPMDNRALIEAIRAVPQALVIVNSRRHALDLYREAKAAGLAGLVHLSTRQFAAHRRRILAEVRRRLREGEPCRLIATSLVEAGVDVDFPRVWRAEAGLDSIIQAAGRCNREGKNPAEESIVSVFSAPDYPPPAEIRSLVNDMQRMIERHEDLASLDAIEDYFSEVYWRIGERLDGKKILQRFSRFVRFNGRIGADFAFRSAAKDFRMIESGMVPVIVVGDDKSKRVVSELDVEQISSYSLARKLQAYCVQVLPKARDLLICNGHVAFVSPDLRGNQFAVLQTKSLYREDVGLLWEDADYLDMESMVV

SEQ ID NO: 14677 - protein, 707 aa, Lamprocystis purpurea
MDADVSGFDQLHPALQYHIVNSLGWRSLRPLQEATIAPILRGEHAILLAPTAGGKTEAAVFPVLSRMLSARWAGLSVLYICPIKALLNNLEPRLAHYAGLVGRRVALWHGDVGPARKAKLIADPPDILLTTPESLEVTLISRRIDHRRLFANLRCVVLDEVHAFAGDDRGWHLLYLLERLSRIAGRDLQRLGLSATVGNPDHLCDWLAAGLSQPCSVINPPADTGMPPEVELDWVGNLRNAALVISRLHRGEKRLVFCDSRVRVEELAIELRGLGVSTYVSHSCLSLEERQAAEAAFSQGQNCVIVATSTLELGIDVGDLDRVIQIDAPSRVSSFLQRIGRTGRRPGTARNCLFLITKEEAFLPAAALLLLWTEGFVEPIEPPPLPMHLFAQQIMGLALQESGITAADWPTWLGRLPGLATLARGDFQRILDFMLETEILHTDQGLLGIGRSGERQFGAKHFMELFSVFVSPPSIKVFHGLQEIGEVHQSTFILKEEGPTVLTLGGRSWATKYIDWPRRKAYVEPTELRGRSQWRSAGQPLHFALCQAVARVLSREEPPVTFSRRALEHMAELREAFDWVESGKTFLIADAHDSLVWWTFAGRLVNAAIAHVLAGEATKIIADNLAISFTGAVDLASMAKAIREKVFNETTEITLPLDEDFIAELKFGECLPAELRDREINARYDCSEALALLASAPMAVIWLRDSR

SEQ ID NO: 14678 - protein, 848 aa, Flexithrix dorotheae
MKSNILEYYNNLFPFQPYTYQIKVAEALLSGKNVILSVPTGAGKTWASIIPFLYARENSDIHFPKKMIYSLPLRALANSIYEDVTYIVDASIQTGEFSEDIYFENDIIFSTIDQTLSNFLCFPLPLSPRLANINAGALVGSYLVFDEFHLLDKNLSMATTLGSLKMLGNLCRCCIMTATLSQGFMEELRQNLPNYEIITLDDFPEDQSKITSLLPKANKKKLSVLNQKISAELIARKHENKTIVICNRVETAQQIYKDLIALNLESFENLRGLETENIICLHSRFYDEDRKVKEKNLKRLFGKNANKEEHAILIATQVIEAGMDISCKVMHTEISPINSFLQRAGRCARFANETGKIFIYDVLDIQEAEKISFEPESKEDKAEIQRLNNKYLPYQPDVCITTLAELKKYSTLDNPVPKKLIETILGAGEKDIIGKMKMGHSGGFNQDKIKDAWFTASTDKNGAKNHYRNTIRDIQSVEIMIISEDQLKRVEMFPFQYQSLSMYKYSLVGWLNKIVKGDVSNPPPIPFEDDWLIKKLVDAEDVFLENDEGIKYELKEIAPDGFNNLPTKVYVNAKYFGYDKLFGFNWQYQESFNNLSPTREKVESKKGFGDFQKDTFYQHNKALLVAFEKEFLGENGDKLDFVFHELAEFSGNGAVTKPEFIRLIKLMIVLHDYGKLNDSWQSPMQYYQALKEGVPPNEFKEILGHTDFDPESEEDKQFAQKAKLNKRPPHAGVGAYLAQELLLELDEDERVTSSISLAIARHHSPSNSKFPEFVISPKNFNAAKQLMKELSFDLDLETEEDDGILEGFQYGDWEKEQILYLFLVRVLRLCDQKATEDFQKYLNSQTHV

SEQ ID NO: 14679 - protein, 748 aa, Lewinella cohaerens
MLDHIIAKSASDYGPGEALLEHTDTVVEYWRELHKSYVDELPVRDDFWKLSFLAALFHDSGKITGNFQERITKRVKHWDNHIRHEFFSGVLLWAANRDVFAKDILPLMAVFSHHKPLTDELFKKNNGLEKALQLNEIELTELLEELAYRIEQQKVDFLIFPNLAKGLARITTTKQLYKSFKSVYNQSVDLKQEDRRTYIFYKALLNTADWSGSNHGLLGGELSTSENELRGKIIQKLIAENKPEIAAKFHWRKFQLASKQQVGHVLAIAPTGSGKTEAALLWAAQKKEREKIIYLLPTRVTSNAIYNRLQQYFGKEETAVIHSSAFFYRKELDEEDRYHKGDYLMDKTFFRNVNVCTIDQVLTQGFNLGYWELKTFHTWKSWIIIDEIHLYAPYTLGLIISTIEYLKSAFHARFFIMTATMPTKLRMLLQQTLEIGETQIVRDVELLKKKRNEFQVRDCLIDGLETEIIVALKAGKKVLIVVNTVDEAIRLYQAYKGIAADTICYHSRFIQKHRLEKEQLILQKEKEAQSLLLVATQVVEVSLDIDFDILFTENAPIDAIIQRAGRVNRKRQKKDTKVIVCREQQVTREVIYTEVDGVLDNTFNELKALNGEKLSEEQLLGLVDVVYQHFEVQQHQGFLEGRSAYAKVQRHNHFIKDVMSQDGIYTREGLDTVSIIPACYYEELINANPMEKAQHELSIRRKKIFSLEHKGFQTLKNPDNQDPYIYLCCKYDSEVGLVYEQPSTIVHC

SEQ ID NO: 14680 - protein, 750 aa, Thiofilum flexile
MSDRPIAHVRFDAQGKPIEHWLDEHLQKVAQLASGYATDFKSHEWAYVAGLWHDLGKYNPAFQDYICDKTGYERENAHIELANNSKGKVNHSAAGALYAVKQHKQLGLPLAYLIAGHHAGLPDWTKTAESEGRSLAEILEETEHLDKALQVDVPSSILKQPLPKTAPRGESHEYALWIRMLFSSLVDADFLDTEAFMQPQQFAQRGKYPDLATLLQRFNEHMQSFAVQARPSKVNELRTQVLQQCRAAAQQPSGIFSLTVPTGGGKTLSGMAFALEQAVKYQKKRIIYAIPFTSIIEQTATIYRSILGDCVIEHHSNLDVSDPERETAQSRLASENWDAPIIVTTNVQLFESLFASRTSRCRKLHNLANSVIVLDEAQLLPPEFLNPILSIMKSLVAHYGVTFVLSTATQPALQSLYDPFNKPILKGFDAKQVTEIIPNCEQLFNDLERVTVVIPDDLSLERNWEDIAAEMMEHEAVLVIVNTKSQAAELCRLLPPDTYYLSTNLCGAHRSEKLQEIRDKLKTKQPLRVVSTQLIEAGVDVDFPVVYRALTGLDSIAQAAGRCNREGLLTKGKVIVFIPPNNHKLKGHLGLSASVSKSLLPLFTEPPLYYRHFKTYFEHYYTKTKSRDAQGIEELLTKDARSLKIQFRTAANRFRLIKEEGHAVLVPYGEGEKLIEQLKILGSSRWLLRKLQRYTVTIREQDKNRLRNNGDIRELKELAGVYELVTSGIYDSKLGLMSDPFQLDPEDLLW

SEQ ID NO: 14681 - protein, 720 aa, Desulfobacter curvatus
MEDPCPHIKAKGAPEETSLFTHTWLVYSAIRKFAECLDFSIETAGLGAVLHDIGKASTIFQNNLKPGRRKKAITFRHEIASCFFISLFKEALHPPIIEMVIAHHKSIKDDHGEKGLLDLEEYVKNPFKDHAKNWKDWYQDAVRILSAVGIPAQEVTIDDACNNYQKVVAFCREASKKRGYSPWRGLLMAADHFASALILNTPVRLDKTFIPPNLNYFNRTSDLYPLSLKKADSKKRHTIVVACTGAGKTDYLFRRCKNRVFYTLPFQASINAMYNRVKSDLKSSNPDLDIRLLHAASRFSVLDESKDEILLQKLVGAGIKILTPYQVASIIFAIKGFESLIIDIRGCDVILDEIHTYNGVSKSMVLKIVEVLNHLNCRVHIGTATMPSVLYDKLIDTLGKENVSEVCLEKEELDQFDRHRLHKLESWEDAHSILNQELKKHSKILLICNRIDSAQAIYDQVKERYPEIPSMAIHSRFKRKDRLEKEMDLRGVDDQGNSLNKYNTGSGPCIVLSTQVVEVSLDISFDVMVTETAPIDALIQRFGRINRKRTLETIGKYKPVYIIPPPDTSQEAKPYDLEVLNRTFEILPNDQVLHESEYQEKIDHVYPELDITDIENHSAFKKDGTWNQPMLTHNHRSILFDLLEIDNAAAILSSDETDYKEASPEEQMMMEIPVRLYSVKDFSQLKEGKKPFILPDDAYTEDKGLDMAKAQERIQDLYFI

SEQ ID NO: 14682 - protein, 812 aa, Spirosoma panaciterrae
MEPLAKPSGITLRDHRQHVYDEALALLDAHPFWEQKYRAVTGDDLRYRLRRVAWWHDAGKAHEKWSKACQCDYELYRSWRVKQGKPAEAADDAQNAVEFRQYEAAMRKDRKNSSPHLMATGLRHEFDSLLQAQKALKDEKALTLAEQVAIAAHHGKLGYRHEKRWREDGRAEKSVGPYWSIWQELTDSSKSIGSDGKRARNQDDWKIRVIERYRIAALRALLQLADTRASRRESGGTVPDIMLFSYDFPKEWKLRGVQTTVLEGADQPISILRAPTGSGKTDASLLWAKHQTDHDRADRLTIVMPTRFTSNALAISVDKNVSATGLYHSSAWYTRYGHVSNKDRDDARELHKLARSLATPVTVCTIDHLLLCLTGTKEDHHTSFFFLANSAVVFDEADFYDPFIQANLTVLLDTLRLLQVPVLIMSATVPDSLRNRYGINDTILDVPAEEQTTKRQIVWRGSAETSADVEDILNEMLRLGTGIVYANTVDRAYEYFQWFAEKHKEERGPEPILYHSRFTEPDKKTIEERLIAALGKDAWLEKKNAVGIAILTQIGEMSVNISAPIMLSDACPWDRLAQRAGRLDRFGLEPDGGILYVVEPYKEGISYPAPYGELPKGGNVWIPADAFTQTVQELSSDFGKMPALVTPANFVERVNRLYPKNLDFTSKAEQNRDRLKSLMRLNWMIVSPLSTDEDNGKVSAEWKSRDIPPQQPVFIKLPDADVVLDGNDESLYVFKNWDAYRGYELEFGVSCPDYLIRMGNERKQLMLFRFRIGDDKEQHSIWITEPSIYSPEIGLALLGKGEKTDRAKGVFG

SEQ ID NO: 14683 - protein, 756 aa, Spirosoma spitsbergense
MLDHLLAKTKDRESLGKHTDLVLGASKALQNRYADVLGEDETFWFDCFIAALFHDFGKASLNFQNMLSKALNEPVIEKGYEPMRHEFLSGVLLAAHALLKNRKRQDIHPNPAQVFAVLTHHKDFTPDLFSKDQAKQWKIRPEDVNAFFQYARQHVMENYPAQAGFLNELEAAWAFIAPYPVESLLTIKDRGIVEPVLRDLIENDRYEYRKTYILQKALLVIADWTASGHRNLEEQLQYNTDHIRKKVAERVKNFDDFSKLQKKSATIAGNVLAIAPTGSGKTEAALLWASQREGFEKIVYLLPTRVTSNSLYLRLHEYFGRAADNQDDYTAIVHSSAKLFRLELDETYDNFSYLREAAFFKAVTVATVDQMLTQGFNIGWWEMKTFHLFRARVILDEIHAYAPYTLGLIVATIRYLRTYFQTQFYVMTATMPTKLQTLLAYELGDGVTVLRDRELLEKKRNVFHVTDKTIDQLQPDIEQDLVDGKKVLIVVNTVDEAIRLYDQYAAYSPICYHSRFIVKHRTEKEGAILANEHEKPEEGFLLIATQVVEVSLDIDYQALYTENAPIDAIIQRAGRINRKRGKLPGKITVFPHSEKAEKFIYDYPEGILTSTFDELKKHQDVALSEQNLLDMVDAVYKDWNVENEKLYVDALSKQEKLLRENCHYLYDFNGGFEQAFTREGLDTVSVIPARYQSELIDATILEKSKHEVAVRSYHVKVNKPTDDAKHSWFKYFDCDYDFERGLRFKKKANAALTYHY

SEQ ID NO: 14684 - protein, 753 aa, Salinispora arenicola
MTFLRAHSPAPASSRWHFLADHLRSTAELAREFTAPFAGGDVAYWLGALHDVGKASCAWQDRLAVVACTGGRVGIDHKSLGTRVAYERGLGGFAGAIFGHHGGLVDTPNLRERYRSRLAEAPGDVASAERELPGLLPDLPEQFDHLVPAQWRADPLVGEMALRLCYSALVDADSLDTSAHFQGLSGPRVRPDADFGHLYKVFEQRRRDELAGRGGTPIGSLREQVYADCLAAAERERGVFRLGAPTGAGKTLASGGFALRHAEKHNLRRVIVAVPFLTITEQNAAVYRRLLDQDGADQVVLEHHSQVDFDDPGAGRWARLAAENWDAPFVVTTFVRLFESLYARKPSAMRRVHRLANSVIVLDEVQALPHAMLAPILDGIRLLVRHFGVTVLLSSATQPSFWALDEFKDVPRTDLIHDTPKLVSDLRRVRYEWQLDPKPTLADVGDQAASEQAALVVVNTTADAKTVYDRWREIGASGVAWHLSTRMCPDHRRRVLGTVRARLRRGEHVLLVATQLIEAGVDVDFPLVFRAMAPADSLLQAAGRANREGRMADGGRVVVFAPEDGGQPPTYKTLVGCTGRQFGPDKADPDDLMALGRYYRNVYSLLNLRDVQHVGQRIQQARRRWEFETVADGPIDASTKRRDRKLAFRMISDDGISVVTPQGAGTPELRRELEQLIEELRQAPVPDLKKLRRLQAYTTNLHPNTLRQPGVTALLRPVLGGSEVRRGVLAEWVGEYDDATGMNLDPSLEHFVL

SEQ ID NO: 14685 - protein, 800 aa, Sediminispirochaeta bajacaliforniensis
MNYIAHTPPSEKPELQPHLYSSHIKEMVEYGCPLLKYLLSFSEIDGEQKKILLQTFKAALMLHDMGKLDEENQSVLRGERKGRLPVDHLDAGVAIADSMQNELAAWIIRGHHSPGLSSKKSEKYFIRQLTAETGMKLSTTSLRGLRHKRLANGNSLVKEDFLRHFDAIKKTDSNINNYIARQKECCGVWPDVSMRLPESGLTTRLILSCLVDADHGSAGAYSLGTSLQPFVPLNTLWNKRLSALDKYIRSLRKDVTGLEKERNELRELFYQHCYTDELLKSKLAMCSAPVGLGKTTSVMAYLLRKSIENNASRIIVIAPFSNIIDQTVKVLRKAIVLEGEEPEQIVVAHHHKADFSDKDMRQYTVLWRAPIVVTTAVQFFETLASANPTKLRKLQAVVGASIFIDESHACLPAWLLKISWHWLRELSNSWGCNIVFSSGSMVEFWNDRYLIGEEEVQQLPDLFSKNLQKKAMVAETKRVEFREFEDALSLNDIIDKIQDIQLWNGLHKQIRPSCLIIMNTVQSAAVVAYSLASVLNDMGNSLQNKQVLHLSTALAPKDRDIILKEIQRRQEDSEWNQSRWYLIATSCVEAGVDLDFSIGFRERCSVTSFLQVAGRINRHGLRSSGLLYDFSIVPENGLNKHPGFEDASIVFLELWSDIIRPEISLAELSTTAIRKEYSRINEKDKEGSDNIFFEEKKLDFQEVEREYHIIKTDTATVIIDADVVQKLELGIPVSWQNIQESSVQLWSNKIQKWHLHPVARCKNDDIFSWTDTYEYDSSFLGIMGGILKIDKFFKNEGGII

SEQ ID NO: 14686 - protein, 726 aa, Solimonas variicoloris
MAALRAAPFGGADMARVAGLLHDIGKYTEEFQRRIAGDAIRVDHATRGAMLAVERYGPIGHLLAYAIAGHHAGLANGTDGGETRERTSLRDRLRGVGLPPLFAEWQREITLPDSVPHPQGFRSRADQGSFQLAFLARMLFSCLVDADYLDTEAFYDRVERRASHRDASTPALVDLRSRLDRYLGRFVADTPVNAVRADILRHMRAQAGLDLGLFSLTVPTGGGKTLASLAFALDHAIRHGLRRVIFVIPFTSIVEQNAAVFRAALGDLGDAAVLEHHSAFVAAPPPRDAPDRYQAHEKLRLAMENWDAPIIVTTAVQFFESLFAARPAQCRKLHNIAASVVILDEAQTLPLKLLRPSVAAIDELARNYRCSVVLCTATQPALEAPKFEGARGFEGGLEKVRELAPEPAQLFRRLERVRVRHIGVLDDAALAAQMRAREQVLCIVNNRRHARAVYQAMADLPGARHLTTLMCARHRSEVLAEVRGMLKRGEPCRLVATSLIEAGVDVSFPAVLRAEAGLDSIAQAAGRCNRNGEWPVAQSEVLVFDPGNDEWVPPPELKQFAQAARETLRQHGDDPLSPAAVEAYFRTLYWQKGDQQLDAGNLLGLLRNSRTDSLPMETLAAKFRMIDSAQKPVIVLYGDDGDAKGLVDSLYHADKVGGIARRLQRYLVQLPDKAFGALCGAGAIQAVAPEKWGEQFMLLANADLYDHRLGLNSDNATFVRSERLTW

SEQ ID NO: 14687 - protein, 724 aa, Salinispora tropica
MARDFSAPFGGGEVAYWLGALHDVGKASCAWQDRLAVVASTGGPVGIDHKSLGTGIAYERGLAGFAGAIFGHHGGLIDTPNLRERYRSRLAEAPGNVASAERELPGLLPDLPERFDHLVPAQWRDLLVGEMALRLCYSALVDADSLDTSAHFSGLSGPRVRPGTDFGHLYKVFEQRRRDELAGRGGTPIGSLREQVYADCMAAAEQGRGVFRLGAPTGAGKTLASGGFALRHAEKHGLRRVIVAVPFLTITEQNAAVYRRLLDQDGADQVVLEHHSQVDFDGPGAGRWARLAAENWDAPFVVTTFVRLFESLYARKPSAMRRVHRLANSVIVLDEVQALPHAMLVPILDGLRLLVRHFGVTVLLSSATQPSFWALDEFKDVPCTDLIHDMPKLVSDLRRVRYEWQLDPKPALAGIAEQAASEQAALVVVNTTADAKTVYDRWRETGADDVVWHLSTRMCPDHRRRVLETVRARLRRGEHVLLVATQLIEAGVDVDFPVVFRAMAPADSLLQAAGRANREGWMTDGGRVVVFAPEDGGQPPTYKTLVGCTGRQFGPDKADPDDVAALGRYYRNVYDLLNIAEDQHVGQRIQQARLRWEFETVIDGPIDASTKRRDRTLAFRMISDDGISVVTPQGAKTPELRRELEQLVEELRQAPVPDLTKLRRLQAYTTNLHPSVLRQPGVTALLRPILGGTDARQGVLVEWVGEYDHATGITLDPNLEQFVL

SEQ ID NO: 14688 - protein, 740 aa, Pseudomonas aeruginosa
MSLPPSNSDSAGFGLLDPAIQRWVWREGWTSLRDAQERAIPALLNADRDVIIAASTAAGKTEAAFLPILTNLLEHDDPAGSVIYVSPLKALINDQWDRLETLCQELDIPVIAWHGDISASRKQRFLKSPSGVLLITPESLEAMFVNRGAGLAGVFANLRYLVVDELHAFIGSERGKQLQSLLHRVELVVERTVPRVGLSATLGDMALASSFLRPGKEQGVEIIESKTSEQVLKVQVRGYVEALSQRETANSEEAQRDDDSGVEQAIAAHLYQVLRGSNNLVFPNSRGKVEWYADQLRRLCERDGVPNEFWPHHGNLSKDVREEAEKALKAGNRPATAVCTTTLELGIDIGSIRTVGQIGSPPSVASLRQRLGRSGRRQGESAILRSYCKERSLSDDSSLSDRLRQGLVQSVAMIRLLMANWFEPPKVQGCHYSTLVQQILSIIAQRGGATAGELWRSLVATGPFSTVAQPDFLMLLRAMGEHDLVLQESSGLLLPGESGERFINHYDFYSAFISDEEFRLVCDGKALGSLPVSRPLTVEQRIIFAGRRWQVTDVDANAKVVVVRPSPGGAPPVFDGIGARVHDHVRQEMRQLLSEEAPCPFVDAVGQNLLGEARRCFSELGLASRGLVDVGAVTAVFTWHGDWTNDALVILLEWHGLRCDRAGLVLEVNGSVERVQEALRLIAESPVPPLPELLSDVQNMMCEKWDWVLPPNLLAASYASTYLDVESARKVAVRLGRERQ

SEQ ID NO: 14689 - protein, 745 aa, Leptospira kirschneri; identical to SEQ ID NO: 12856

SEQ ID NO: 14690 - protein, 771 aa, Leptospira; identical to SEQ ID NO: 12849

SEQ ID NO: 14691 - protein, 745 aa, Leptospira; identical to SEQ ID NO: 12848

SEQ ID NO: 14692 - protein, 773 aa, Leptospira alstonii; identical to SEQ ID NO: 12845

SEQ ID NO: 14693 - protein, 745 aa, Leptospira kirschneri; identical to SEQ ID NO: 12844

SEQ ID NO: 14694 - protein, 758 aa, Leptospira kirschneri; identical to SEQ ID NO: 12843

SEQ ID NO: 14695 - protein, 754 aa, Leptospira interrogans; identical to SEQ ID NO: 12840

SEQ ID NO: 14696 - protein, 931 aa, Leptospira sp. P2653; identical to SEQ ID NO: 12835

SEQ ID NO: 14697 - protein, 932 aa, Leptospira santarosai; identical to SEQ ID NO: 12829

SEQ ID NO: 14698 - protein, 758 aa, Leptospira santarosai; identical to SEQ ID NO: 12828

SEQ ID NO: 14699 - protein, 752 aa, Leptospira interrogans; identical to SEQ ID NO: 12831

SEQ ID NO: 14700 - protein, 730 aa, Leptospira interrogans; identical to SEQ ID NO: 12830

SEQ ID NO: 14701 - protein, 537 aa, Candidatus Caldiarchaeum subterraneum; identical to SEQ ID NO: 12051

SEQ ID NO: 14702 - protein, 768 aa, Desulfococcus multivorans; identical to SEQ ID NO: 13035

SEQ ID NO: 14703 - protein, 763 aa, Desulfovibrio sp. X2; identical to SEQ ID NO: 13036

SEQ ID NO: 14704 - protein, 766 aa, Desulfohalovibrio alkalitolerans; identical to SEQ ID NO: 13034

SEQ ID NO: 14705 - protein, 949 aa, Leptospira alexanderi; identical to SEQ ID NO: 13049

SEQ ID NO: 14706 - protein, 865 aa, Ruminococcus sp. 5_1_39BFAA; identical to SEQ ID NO: 12385

SEQ ID NO: 14707 - protein, 909 aa, Salinivibrio costicola
MDNEKPYFSYWGKASTDIGDGDSYHQLAYHCLDVAAVSYHLLHKERPLTKAIAEFLELSPEQLRTLWCFMISLHDLGKYASAFQELNLSVSATLLNPQSKKEYDGREYRHDRLGYYFWQQHETELIHAICGQSLGSIDDETAVYETVDVLAQCVLGHHGQPVNRQTPRRMRSFTEARNHDAVTEFIADINELFQPKINIETLSSDDWRARLEQVSWQLAGLAVLADWMGSDTHFFPYVSQPQPLEQYWHYALTCAEQALDYTDLSRTPTITPFSAFSDIFPFSPTPLQAWAASVEINDQPQLFILEDMTGAGKTEAALTLTHRLMAAGAADGFYFGLPTMATSNAMFDRVANHYTQMVKLGEGELASITLAHGARDMNDRFREMVHTTATVDSNYHQRDATVTAQCNAWLADSRKKALLAPVGVGTIDQALLAVLPRRHQSLRLLGLNRKVLIFDEIHAADEYMLALLESLLSLHLHQGGSVILLTATLSQQQRQRLCQVWQQAAGLTPVIPSQDHFPLATQVAIDKAPALKETAISRQAKQKPAVAVDMLTQFDDCLATVLAAVVKGQCVVWIRNTVDDAREAYETLLSRPDHPERCHLFHSRFILADRKNIEKTVLDNFGKSSSQSERQGRVLIATQVFQESLDADADVMISDLCPIDDLIQRAGRLHRHKRNKQGAYITQGDDERDPPVLYIHAPSWEDEPKADWLSRHFQPTQFVYRSPGRLWLGLRKLRELGEICMPTHARELVEAVYSDEALAQIPTALQPMEEEYLGKTYSIGAKAQSQCIDWQYGYCDRSAKYWFDDDTDISTRYNDIETVDVLLVNVQAGELVPIAKDNRFSVALSTVKLSKRKYADQLAPFPERLEPALAKLIEQHPQLKYMKVWLPENDSRFAYSEEKGFYERPQEAT

SEQ ID NO: 14708 - protein, 499 aa, Haloquadratum walsbyi; identical to SEQ ID NO: 13183

SEQ ID NO: 14709 - protein, 732 aa, Campylobacter concisus; identical to SEQ ID NO: 13196

SEQ ID NO: 14710 - protein, 748 aa, Campylobacter concisus; identical to SEQ ID NO: 13197

SEQ ID NO: 14711 - protein, 737 aa, Campylobacter concisus; identical to SEQ ID NO: 13198

SEQ ID NO: 14712 - protein, 737 aa, Campylobacter concisus; identical to SEQ ID NO: 13199

SEQ ID NO: 14713 - protein, 725 aa, Anoxybacillus ayderensis; identical to SEQ ID NO: 13046

SEQ ID NO: 14714 - protein, 726 aa, Phaeospirillum fulvum; identical to SEQ ID NO: 13040

SEQ ID NO: 14715 - protein, 910 aa, Pseudomonas stutzeri; identical to SEQ ID NO: 13177

SEQ ID NO: 14716 - protein, 762 aa, Mannheimia haemolytica; identical to SEQ ID NO: 13041

SEQ ID NO: 14717 - protein, 827 aa, Bacteroidetes bacterium oral taxon 272; identical to SEQ ID NO: 13038

SEQ ID NO: 14718 - protein, 773 aa, Treponema socranskii
MSSILNEVDKAKRNEYYRDIFVTAPTGSGKSILFQIPALLLAKEGYLTLVIQPLVALMNDQIFQLHERGVKNAATINSSISLDEKNEIIEKINHKEIDIVFLSPELLLSRSDITMLIGNREIGLLVIDEAHIVTTWGKEFRPDYWYLGTYIQKLRKNRNFPIATFTATAIYSGSEDMVADIRDSVGMRDPIKYYGYVPRNNINIEIQKVDKSLLDISTREYSTKKNTVLAVRISEFQKLNKKSLIYFPMIKLINEFGDFLAEYENDVDIQKLSRYDGSMKPEKKKENFERFKNGDANVMLATKAFGMGIDIPDIDIVYHFAPTGNVCDYVQEIGRCARDKDKQGLAAFDFFPSDFKYVNLLQGISSIRKNQLVQVLQIIRSIGAKNNYKRNLLITSSDFQSIFDFAKEDELDNKVKTALLLIEKDFISKFGYSPIVARPRAIFTKGLFKLHKITTDQLTKLIDNDFTWVSSNTVIINLKSVWEKKFSNQSFQQFKYELYSTPKKLNLVGTQKLIPQMEISIRPDKLPSGRNYTCRSIIEFLIKFCDTNRQKSKYFTKKELCKEIQRDLGIMNYYELQTLSDTIIRLLLVFSSTSSSHNSRFIKIKNSIYEEESYLIDTTGYLTLRDFYTYYENDITYESTIYLDIPSFGRSDPIILESNRKRILSILGLFNAFKLLSFEAHGGFNPEIFMRINSYYKIDQIINKHGENYTNDILNKVYNLHIRSVEFLTYIFRTIGIGNTKRFWEYIELYFMGVIPQEVEDLIEMKKNKSIKN

SEQ ID NO: 14719 - protein, 376 aa, Treponema socranskii
MDTQNAFSLLSPEIRAKLQTLSIARPTPVQQKTIPLIIEGKNLLFQSETGTGKTFAYLLPLIDGIEKDEKNGVKILVVAPTLELSSQIRDAAMSISNAKCALFAGSAPIRRQTELLKGNPAIAVGSPVRLLELARLKKLKLAGLRAAVFDEVDRLVKKEIKDDLASLVSFFPKNVQIVGCSATVTKAVRAFFAECESISMPEEDVLRKRISHWAIYAESRDKIDTLKKLIAALDIQKMLVFTSRGDQVENITSKLKYKNIDCESLYAKKDKQKRKRALDRFKSGSCRILITSDVASRGLDFQGVSHVVQMDLNDDDNFFVHRAGRTGRAGKTGINIVVGDEYEMRRYSALEKRLKIIVYPKILYRGEITAPDTVLK

SEQ ID NO: 14720 - protein, 656 aa, Treponema socranskii; identical to SEQ ID NO: 13179

SEQ ID NO: 14721 - protein, 802 aa, Clostridioides difficile
MENIMQKEILAKSYNLRTNQQEQTLVEHIKDLFEVLESILELNLYSDKDVEILKICCVLHDLGKINSIMQQKMEINNKISSGCSEEERKKLESDKKTLKKIARHNIFSGAFLKDILEKMNLSEEDKLYIYKSIMLHHGNYEDYMRLSTSKVQAEIYEYIEKGILEKEEFNLKDIESYINDILNIDFKFGEDVLDYDYIDKLSESMFIDSDYNNGPIDDSVLNYRKFKYILYKGMLNLIDHSASSRQKGIKFYNDFTDEEIDNMILSEIYKSQGNLEKNNIKFNTIQKRLRELSGRNVLTVAFTGSGKTAADYRKTFKRKFFLVPNKISAESFYRKNIFQNKNDLDTRSSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDVDFHLMTATLPKSYKEQMINKGIIFQEESNENVTDKGEIVFIESNKEEEICEGKDVKVSFIKEKEIKSIVEDALENKQKILIIKNTIDSVNRTYEFLKENLSDKYGGVDIDVLHSRFKFKDKKEKYSKILNGEGDVWISTQSVEISLDLDFNIIISDLATMDSLIQRMGRCNRNNKYEYGNFYILPSEDKIYDNKLKSTTKNILKDILKTNSIFTMGIRKTILDDYYDNSVVKKYFEENFISCDKEIKNIYGINKEIFDGLDLIFNFEPYKNIVDSKKEAAKIFRDVDVSYKIILEEDFYKEDRELQQDSIQVSGFIFNRLYYYGLISKVEGYMVLKSSSKFEYNSTVGLILK

SEQ ID NO: 14722 - protein, 773 aa, Clostridioides difficile
MLYAKSNPVETLREHTDELLKQMNVLRESYGKNINSLDFLEEEIFWQLLDFVIEFHDIGKAFSPFQELIKSRMDTKINEPKIVTYLENNVGHNYLSPAFIDYSYIDRKKNKELRAVLNQVIVYHHERDIFIDKDFKNLIQKILDEDLINKVYELQHEFKVRYPIKTEKLSKVYLQSVEKRIDKNHKYYNLYIMLKGILHRLDHSASAHEVVECNNVINIGEQTENYLMKEFGSLREAQSFAKSNRNKNIILIASTGMGKTETALIWIDKDKAFFTLPLRVSINALFDRAKNIVGVGESNDTFLGLLHSTAIDYLEESNQENSSEIVDLAKLLSCKLTFSTIDQIFKFPFLYRGYEKVYSTLAYSKVVIDEIQAYSPEIAAVLVKGIEMIHKIGGRFMIMTATMPTIYIDELKKRGVMNSNLAELTCNTEKIRHCVSIVENSIDENLGKIIQSRMNKKVLVIVNTVKSAVEKYELIEEIVKPKGIDVNLNLLHSMYIQEDRAKLEKYIKEFANSDRNGIWITTQLVEASLDIDFDELHTENSTLDSLFQRFGRCYRSREYEENSPNIFIYTEKATGIGSIYDKDIVEKGLELLKTFINGKECVKMKEKYKVEMVKILYSKESLEGTAFEKRFTSALNILDTITPYSLGSKDAQNILRNIEGYTVIPEDIYNKIEETLIKDYEELGQELINAYSNDDRQLINKIKSKRKKARREIIKKTVNLPIYKAKQNVIDIQVKGLEDLKILLYKYDIYENKHTKQIFGKGVLISNEIDQFI

SEQ ID NO: 14723 - protein, 802 aa, Clostridioides difficile
MKNIMQKEILAKSYNLRTNQQEQTLVEHIKDLFEVLESILELNLYSDKDVEILKICCALHDLGKINSIMQQKMEINNKISYSCSEEERKKLESDKKSLKKIARHNIFSGAFLKDILEKMNLSEEDKLYIYKSIMLHHGNYEDYMRLSISKVQEEIYEYIEKGILEKEEFNLKDIESYINNILNVDFKFGEDVLDYDYIDKLSESMFIDSDYNNGQIDDSVLNYRKFKYILYKGMLNLIDHSASSRQKGIKFYNDFTDEEIDNMILNEIYKSQGNLEKNNIEFNTIQKRLRELSGRNVLTVAFTGSGKTAADYRKTFKRKFFLVPNKISAESFYRKNIFQNKNDLDTRSSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDVDFHLMTATLPKSYKEQMINKGIIFQEESNKNVTDKGEIVFIESNKEEEICEGKDVKVSFIKEKEIKSIVEDVLENKQKILIIKNTIDSVNRTYEFLKENLSDKYGGVDIDVLHSRFKFKDKKEKYSKILNGEGDIWISTQSVEISLDLDFNIIISDLATVDSLIQRMGRCNRNNKYEYGNFYILPSEDKIYDNKLKNTTKNILKDILKTNSIFTMGIRKTILDDYYDNSVVKKYFEENFISCDKEIKNIYGINKEIFDGLDLIFNFEPYKNIVDSKKEAAKIFRDIDVSYKIILEEDFYKEDRELQQDSIQVSGFIFNRLYYYGLISKVEGYMVLKSSSKFEYNSTVGLILK

SEQ ID NO: 14724 - protein, 773 aa, Clostridioides difficile
MLYAKSNPVETLREHTDELLKQMNVLRESYGKNINSLDFLEEEIFWQLLDFVIEFHDIGKAFSPFQELIKSRMDTKINEPKIVTHLENNVGHNYLSPAFIDYSYIDRKKNKELRAVLNQVIVYHHERDIFIDKDFKNLIQKILDEDLINKVYELQHEFKVRYPIKTERLSKVYLQSVEKRIDKNHKYYNLYIMLKGILHRLDHSASAHEVVECNNVINIGEQTENYLMKEFGSLREAQSFAKSNRNKNIILIASTGMGKTETALIWIDKDKAFFTLPLRVSINALFDRAKNIVGVGESNDTFLGLLHSTAIDYLEESNQENSSEIVDLAKLLSCKLTFSTIDQIFKFPFLYRGYEKVYSTLAYSKVVIDEIQAYSPEIAAVLVKGIEMIHKIGGRFMIMTATMPTIYIDELKKRGVMNSNLAELTCNTEKIRHCVSIVENSIDENLGKIIQSGMNKKVLVIVNTVKSAVEKYELIEEIVKPKGIDVNLNLLHSMYIQEDRAKLEKYIKEFANSDRNGIWITTQLVEASLDIDFDELHTENSTLDSLFQRFGRCYRSREYEENSPNIFIYTEKATGIGSIYDKDIVEKGLELLKTFINGKECVKMKEKYKVEMVKILYSKESLEGTAFEKRFTSALNILDTITPYSLGSKDAQNILRNIEGYTVIPEDIYNKIEETLIKDYEELGQELINAYSNDDRQLINKIKSKRKKARREIIKKTVNLPIYKAKQNVIDIQVKGLEDLKILLYKYDIYENKHTKQIFGKGVLISNEIDQFI

SEQ ID NO: 14725 - protein, 802 aa, Clostridioides difficile; identical to SEQ ID NO: 12211

SEQ ID NO: 14726 - protein, 773 aa, Clostridioides difficile; identical to SEQ ID NO: 12212

SEQ ID NO: 14727 - protein, 660 aa, Clostridioides difficile; identical to SEQ ID NO: 12213

SEQ ID NO: 14728 - protein, 802 aa, Clostridioides difficile
MKNIMQKEILAKSYNLRTNQQEQTLVEHIKDLFEVLESILELNLYSDKDVEILKICCALHDLGKINSIMQQKMEINNKISYSCSEEERKKLESDKKSLKKIARHNIFSGAFLKDILEKMNLSEEDKLYIYKSIMLHHGNYEDYMRLSISKVQEEIYEYIEKGILEKEEFNLKDIESYINNILNVDFKFGEDVLDYDYIDKLSESMFIDSDYNKGQIDDSVLNYRKFKYILYKGMLNLIDHSASSRQKGIKFYNDFTDEEIDDMILNEIYKSQGNLEKNNIEFNTIQKRLRELSGRNVLTVAFTGSGKTAADYRKTFKRKFFLVPNKISAESFYRKNIFQNKNDLDTRSSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDVDFHLMTATLPKSYKEQMINKGIIFQEESNENVTDKGEIVFIESNKEEEICEGKDVKVSFIKEKEIKSIVEDALENKQKILIIKNTIDSVNRTYEFLKENLSDKYGGVDIDVLHSRFKFKDKKEKYSKILNGEGDIWISTQSVEISLDLDFNIIISDLATMDSLIQRMGRCNRNNKYEYGNFYILPSEDKIYDNKLKNTTKRILKDILKTNSIFTMGIRKTILDNYYDNSVVKKYFEENFISCDKEIKNIYGINKEIFDGLDLIFNFEPYKNIVDSKKEAAKIFRDVDVSYKIILEEDFYKEDRELQQDSIQVSGFIFNRLYYYGLISKVEGYMVLKSSSKFEYNSTVGLILK

SEQ ID NO: 14729 - protein, 773 aa, Clostridioides difficile
MLYAKSNPVETLREHTDELLKQMNVLRESYGKNINSLDFLEEEIFWQLLDFVIEFHDTGKAFSPFQELIKSRMDTKINEPKIVTHLENNVGHNYLSPAFIDYSYIDRKKNKELRAVLNQVIVYHHERDIFIDKDFKNLIQKILDEDLINKVYELQHEFKVRYPIKTERLSKVYLQSVEKRIDKNHKYYNLYIMLKGILHRLDHSASAHEVVECNNVINIGEQTENYLMKEFGSLREAQSFAKSNRNKNIILIASTGMGKTETALIWIDKDKAFFTLPLRVSINALFDRAKNIVGVGESNDTFLGLLHSTAIDYLEESNQENSSEIVDLAKLLSCKLTFSTIDQIFKFPFLYRGYEKVYSTLAYSKVVIDEIQAYSPEIAAVLVKGIEMIHKIGGRFMIMTATMPTIYIDELKKRGVMNSNLAELTCNTEKIRHCVSIVENSIDENLGKIIQSGMNKKVLVIVNTVKSAVEKYELIEEIVKPKGIDVNLNLLHSMYIQEDRAKLEKYIKEFADSDSNGIWITTQLVEASLDIDFDELHTENSTLDSLFQRFGRCYRSREYEENSPNIFIYTEKATGIGSIYDKDIVEKGLELLKTFINGKECVKMKEKYKVEMVKILYSKESLEGTAFEKRFTSALNILDTITPYSLGSKDAQNILRNIEGYTVIPEDIYNKIEETLIKDYEELGQELINAYSNDDRQLINKIKSKRKKARREIIKKTVNLPIYKAKQNVIDIQVKGLEDLKILLYKYDIHENKHTKQIFGKGVLISNEIDQFI

SEQ ID NO: 14730 - protein, 660 aa, Clostridioides difficile
MNSLDKYKAKSDGISIDKHNEDMNYIMNQLVSIYNISDDMRNDLHEAIVCHDVGKVVKSFQDNIENTIRRVRHELLSASIKHLKRGQKLAILTHHKDIEYLVSQITNSIYEIELNELKEILDVEVEDIRPFIKEISRARNDDTRKLENILLKGYLQYCDYIASAGIKSIDKGFNSIKDFSLPKGVSYNSIQEKVLNMDKNEDIMIMAMTGLGKTATSLYWSDIAQNEGKSKRIYYILPYTASINSLYENLHNRNISVSMLHSKAPYFLNKISDEEDIKQLYQIYKKSVKQINVCTIFQLVKSIFSCKRFEMLLSQLKDSIFIVDEIHCFDTRVLCYTLEFLKYLKENLNVQICIMSASIPTCLKKLIQERLKISTIIEPDKNDLINRHKLNRINKSILDGLDKIENDMIQGKRVLICVNSVDLAQELYMKLQSYNPKLIHGRFNTRDREQAEEGIDKSFLLIGTQSIEVSLDISYDVLYTELAPFDSLLQRFGRVNRKGENKELSNVYIYNYDMNLSIYDYDIVNRTDTIISEIIHKDNSIVNESKVSFYLDNVYLDIDMDKYNKHKTTLEIIIRNMRVGIWNKSASIDMLNNDSISVIPESLIDEYKLFLNQKMYLEASSLFVNVSVKRYNSNRNMFYEDNDVIVTRYSYDNKLGLEFD

SEQ ID NO: 14731 - protein, 773 aa, Clostridioides difficile; identical to SEQ ID NO: 12192

SEQ ID NO: 14732 - protein, 802 aa, Clostridioides difficile
MENIMQKEILAKSYNLRTNQQEQTLVEHIKDLFEVLESILELNLYSDKDVEILKICCALHDLGKINSIMQQKIEINNKIAYSCSEEERKKLESDKKSLKKIARHNIFSGAFLKDILEKMNLSEEDKLYIYKSIILHHGNYEDYMRLSTSKVQKEIYDYIEKGILEKEDFNLEDIEDYIKEILYVDFKFNEDVLDYDYIDKLSESMVIDSDYNNGQIEDSVLNYRKFKYILYKGMLNLIDHSASSRQKGIKFYNDFTDEEIDNMILSEIYKSQGNLEKNNIKFNTIQKRLRELSGRNVLTVAFTGSGKTAADYRKTFKRKFFLVPNKISAESFYRKNIFQNKNDLDTRSSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDVDFHLMTATLPKSYKEQMINKGIIFQEESNENVTDKGEIVFIESNKEEEICEGKDVKVSFIKEKEIKSIVEDALENKQKILIIKNTIDSVNRTYEFLKENLSDKYGGVDIDVLHSRFKFKDKKEKYSKILNGEGDIWISTQSVEISLDLDFNIIISDLATMDSLIQRMGRCNRNNKYEYGNFYILPSEDKIYDNKLKSTTKNILKDILKTNSIFTMGIRKTILDDYYDNSVVKKYFEENFISCDKEIKNIYGINKEIFDGLDLIFNFEPYKNIVDSKKEAAKIFRDVDVSYKIILEEDFYKEDRELQQDSIQVSGFIFNRLYYYGLISKVEGYMVLKSSSKFEYNSTVGLILK

SEQ ID NO: 14733 - protein, 773 aa, Clostridioides difficile
MLYAKSNPVETLREHTDELLKQMNVLRESYGKNINSLDFLEEEIFWQLLDFVIEFHDIGKAFSPFQELIKSRMDTKINEPKIVTHLENNVGHNYLSPAFIDYSYIDRKKNKELRAVLNQVIVYHHERDIFIDKDFKNLIQKILDEDLINKVYELQHEFKVRYPIKTEKLSKVYLQSVEKRIDKNHKYYNLYIMLKGILHRLDHSASAHEIVECNSNMNIGEYTEKHLVKEFGSLREVQSFAKSNRNKNIILIASTGMGKTETALIWIDKDKAFFTLPLRVSINALFDRAKNIIGVGEANDTFLGLLHSTAIDYLEESNQENSNEIVDLAKLLSCKLTFSTIDQIFKFPFLYRGYEKVYSTLAYSKVVIDEIQAYSPEIAAVLVKGIEMIHKIGGRFMIMTATMPTIYIDELKKRGVMNSNLADLTCNTEKIRHCVSIVENSIDENLGKIIQSGMNKKVLVIVNTVKSAVEKYELIEEIVKPKGIDVNLNLLHSMYIQEDRAKLEKYIKEFADSDSNGIWITTQLVEASLDIDFDELHTENSTLDSLFQRFGRCYRSREYEENSPNIFIYTEKATGIGSIYDKDIVEKGLELLKTFINGKECVKMKEKYKVEMVKILYSKESLEGTAFEKRFTSALNILDTITPYSLGSKDAQNILRNIEGYTVIPEDIYNKIEETLIKDYEELGQELINAYSNDDRQLINKIKSKRKKARREIIKKTVNLPIYKAKQNVIDIQVKGLEDLKILLYKYDIHENKHTKQIFGKGVLISNEIDQFI

SEQ ID NO: 14734 - protein, 798 aa, Clostridioides difficile
MQKEILAKSYNLRTNQQEQTLVEHIKDLFEVLESILELNLYSDKDVEILKICCALHDLGKINSIMQQKMEINNKISYSCSEEERKKLESDKKSLKKIARHNIFSGAFLKDILEKMNLSEEDKLYIYKSIMLHHGNYEDYMRLSISKVQEEIYEYIEKGILEKEEFNLKDIESYINSILNVDFKFGEDVLDYDYIDKLSESMFIDSDYNNGQIDDSVLNYRKFKYILYKGMLNLIDHSASSRQKGIKFYNDFTDEEIDNMILNEIYKSQGNLEKNNIEFNTIQKRLRELSGRNVLTVAFTGSGKTAADYRKTFKRKFFLVPNKISAESFYRKNIFQNKNDLDTRSSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDIDFHLMTATLPKSYKEQMINKGIIFQEESNENVTDKGEIVFIESNKEEEICEGKDVKVSFIKEKEIKSIVEDALENKQKILIIKNTIDSVNRTYEFLKENLSDKYGGVDIDVLHSRFKFKDKKEKYSKILNGEGDIWISTQSVEISLDLDFNIIISDLATMDSLIQRMGRCNRNNKYEYGNFYILPSEDKIYDNKLKNTTKNILKDILKTNSIFTMGIRKTILDDYYDNSVVKKYFEENFISCDKEIKNIYGVNKEIFDGLDLIFNFEPYKNIVDSKKEAAKIFRDVDVSYKIILEEDFYKEDRELQQDSIQVSGFIFNRLYYYGLISKVEGYMVLKSSSKFEYNSTVGLILK

SEQ ID NO: 14735 - protein, 798 aa, Clostridioides difficile
MQKEILAKSYNLRTNQQEQTLVEHIKDLFEVLESILELNLYSDKDVEILKICCALHDLGKINSIMQQKMEINNKISYSCSEEERKKLESDKKSLKKIARHNIFSGAFLKDILEKMNLSEEDKLYIYKSIMLHHGNYEDYMRLSISKVQEEIYEYIEKGILEKEEFNLKDIESYINSILNVDFKFGEDVLDYDYIDKLSESMFIDSDYNNGQIDDSVLNYRKFKYILYKGMLNLIDHSASSRQKGIKFYNDFTDEEIDNMILNEIYKSQGNLEKNNIEFNTIQKRLRELSGRNVLTVAFTGSGKTAADYRKTFKRKFFLVPNKISAESFYRKNIFQNKNDLDTRSSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDVDFHLMTATLPKSYKEQMINKGIIFQEESNENVTDKGEIVFIESNKEEEICEGKDVKVSFIKEKEIKSIVEDALENKQKILIIKNTIDSVNRTYEFLKENLSDKYGGVDIDVLHSRFKFKDKKEKYSKILNGEGDIWISTQSVEISLDLDFNIIISDLATMDSLIQRMGRCNRNNKYEYGNFYILPSEDKIYDNKLKNTTKNILKDILKTNSIFTMGIRKTILDDYYDNSVVKKYFEENFISCDKEIKNIYGINKEIFDGLDLIFNFEPYKNIVDSKKEAAKIFRDVDVSYKIILEEDFYKEDRELQQDSIQVSGFIFNRLYYYGLISKVEGYMVLKSSSKFEYNSTVGLILK

SEQ ID NO: 14736 - protein, 773 aa, Clostridioides difficile; identical to SEQ ID NO: 12175

SEQ ID NO: 14737 - protein, 802 aa, Clostridioides difficile
MENIMQKEILAKSYNLRTNQQEQTLVEHIKDLFEVLESILELNLYSDKDVEILKICCALHDLGKINSIMQQKIEINNKIAYSCSEEERKKLESDKKSLKKIARHNIFSGAFLKDILEKMNLSEEDKLYIYKSIMLHHGNYEDYMRLSTSKVQKEIYDYIEKGILEKEDFNLEDIEDYIKEILYVDFKFNEDVLDYDYIDKLSESMVIDSDYNNGQIEDSVLNYRKFKYILYKGMLNLIDHSASSRQKGIKFYNDFTDEEIDNMILSEIYKSQGNLEKNNIKFNTIQKRLRELSGRNVLTVAFTGSGKTAADYRKTFKRKFFLVPNKISAESFYRKNIFQNKNDLDTRSSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDVDFHLMTATLPKSYKEQMINKGIIFQEESNENVTDKGEIVFIESNKEEEICEGKDVKVSFIKEKEIKSIVEDALENKQKILIIKNTIDSVNRTYEFLKENLSDKYGGVDIDVLHSRFKFKDKKEKYSKILNGEGDIWISTQSVEISLDLDFNIIISDLATMDSLIQRMGRCNRNNKYEYGNFYILPSEDKIYDNKLKSTTKNILKDILKTNSIFTMGIRKTILDDYYDNSVVKKYFEENFISCDKEIKNIYGVNKEIFDGLDLIFNFEPYKNIVDSKKEAAKIFRDVDVSYKIILEEDFYKEDRELQQDSIQVSGFIFNRLYYYGLISKVEGYMVLKSSSKFEYNSTVGLILK

SEQ ID NO: 14738 - protein, 773 aa, Clostridioides difficile
MLYAKSNPVETLREHTDELLKQMNVLRESYGKNINSLDFLEEEIFWQLLDFVIEFHDIGKAFSPFQELIKSRMDTKINEPKIVTHLENNVGHNYLSPAFIDYSYIDRKKNKELRAVLNQVIVYHHERDIFIDKDFKNLIQKILDEDLINKVYELQHEFKVRYPIKTERLSKVYLQSVEKRIDKNHKYYNLYIMLKGILHRLDHSASAHEVVECNNVINIGEQTENYLMKEFGSLREAQSFAKSNRNKNIILIASTGMGKTETALIWIDKDKAFFTLPLRVSINALFDRAKNIVGVGESNDTFLGLLHSTAIDYLEESNQENSSEIVDLAKLLSCKLTFSTIDQIFKFPFLYRGYEKVYSTLAYSKVVIDEIQAYSPEIAAVLVKGIEMIHKIGGRFMIMTATMSTIYIDELKKRGVMNSNLADLTCNTEKIRHCVSIVENSIDENLGKIIQSGMNKKVLVIVNTVKSAVEKYELIEEIVKPKGIDVNLNLLHSMYIQEDRAKLEKYIKEFADSDSNGIWITTQLVEASLDIDFDELHTENSTLDSLFQRFGRCYRSREYEENSPNIFIYTEKATGIGSIYDKDIVEKGLELLKTFINGKECVKMKEKYKVEMVKILYSKESLEGTAFEKRFTSALNILDTITPYSLGSKDAQNILRNIEGYTVIPEDIYNKIEETLIKDYEELGQELINAYSNDDRQLINKIKSKRKKARREIIKKTVNLPIYKAKQNVIDIQVKGLEDLKILLYKYDIHENKHTKQIFGKGVLISNEIDQFI

SEQ ID NO: 14739 - protein, 802 aa, Clostridioides difficile
MKNIMQKEILAKSYNLRTNQQEQTLVEHIKDLFEVLESILELNLYSDKDVEILKICCALHDLGKINSIMQQKMEINNKISYSCSEEERKKLESDKKSLKKIARHNIFSGAFLKDILEKMNLSEEDKLYIYKSIMLHHGNYEDYMRLSISKVQEEIYEYIEKGILEKEEFNLKDIESYINNILNVDFKFGEDVLDYDYIDKLSESMFIDSDYNNGQIDDSVLNYRKFKYILYKGMLNLIDHSASSRQKGIKFYNDFTDEEIDNMILNEIYKSQGNLEKNNIEFNTIQKRLRELSGRNVLTVAFTGSGKTAADYRKTFKRKFFLVPNKISAESFYRKNIFQNKNDLDTRSSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDVDFHLMTATLPKSYKEQMINKGIIFQEESNENVTDKGEIVFIESNKEEEICEGKDVKVSFIKEKEIKSIVEDALENKQKILIIKNTIDSVNRTYEFLKENLSYKYGGVDIDVLHSRFKFKDKKEKYSKILNGEGDIWISTQSVEISLDLDFNIIISDLATMDSLIQRMGRCNRNNKYEYGNFYILPSEDKIYDNKLKNTTKNILKDILKTNSIFTMGIRKTILDDYYDNSVVKKYFEENFISCDKEIKNIYGINKEIFDGLDLIFNFEPYKNIVDSKKEAAKIFRDVDVSYKIILEEDFYKEDRELQQDSIQVSGFIFNRLYYYGLISKVEGYMVLKSSSKFEYNSTVGLILK

SEQ ID NO: 14740 - protein, 798 aa, Clostridioides difficile
MQKEILAKSYNLRTNQQEQTLVEHIKDLFEVLESILELNLYSDKDVEILKICCALHDLGKINSIMQQKMEINNKISYSCSEEERKKLESDKKSLKKIARHNIFSGAFLKDILEKMNLSEEDKLYIYKSIMLHHGNYEDYMRLSTSKVQKEIYDYIEKGILEKEDFNLEDIEDYIKEILDVDFKFNEDVLDYDYIDKLSESMFIDSDYNNGQIDDSVLNYRKFKYILYKGMLNLIDHSASSRQKGIKFYNDFTDEEIDNMILNEIYKSQGNLEKNNIEFNTIQKRLRELSGRNVLTVAFTGSGKTAADYRKTFKRKFFLVPNKISAESFYRKNIFQNKNDLDTRSSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDVDFHLMTATLPKSYKEQMINKGIVFQEESNENVTDKGEIVFIESNKEEEICEGKDVKVSFIKEKEIKSIVEGALENKQKILIIKNTIDSVNRTYEFLKENLSDKYGGVDIDVLHSRFKFKDKKEKYSKILNGEGDIWISTQSVEISLDLDFNIIISDLATMDSLIQRMGRCNRNNKYEYGNFYILPSEDKIYDNKLKNTTKNILKDILKTKSIFTMGIRKTILDDYYDNSVVKKYFEENFISCDKEIKNIYGINKEIFDGLDLIFNFEPYKNIVDSKKEAAKIFRDVDVSYKIILEEDFYKEDRELQQDSIQVSGFIFNRLYYYGLISKVEGYMVLKSSSKFEYNSTVGLILK

SEQ ID NO: 14741 - protein, 852 aa, Clostridioides difficile
MYFKKVELFDISNNINNCKNIYAHINKDRKPETLKEHSDLSYSYLMKLCVKKDLSSCLERIENKFFKKDSFLSKNFYREIILNMVYMHDIGKINSSFQFVKMQNKNFKKISLRYTKHSFISSMLYFDYYFEKLKKYDFEEKKILSLFLMINTYTISKHHGVLKSFKEFLFLFKDEFINIKENFKDLFKNNYNLELKSVPKTIEKMVRGVEAYLDDSHIKDNLAIDLYIYSKLMFSIVTSCDFYATSEYNSGNSIDDFGTIDNYNKYYDVLKKSEIYKGMKKYREYLNNNSECPYKENDINRLRTEMSIEAEDAITHNTRKRIFYLEAPTGSGKTVTSINLALKSIELNQSLKKIFYIFPFNTLVEQTKDVFINEIFNSVKDIQKDVVVINSITPIQTEDKEEDNKNVEYCVTKQEIDYDKSLLNRQFLHYPIVLTTNIGFFNYLFGVSREECFPLIHMINSVIILDEIQNYKNEIWKEIILFLEKYADILNIKFIIMSATLPRLNKLGCNDDNFAYLVKNREKFFKNHLFKDRVNISFEMLNSEINDIEEISEKVIEEAEIYNKILIEFIKKSSALKFYKNIKEKLKYKLEDVFLLTGDDNKLERKKIINKIKDMNSVILVATQVVEAGVDIDMDLGFKDISTIDSDEQFLGRINRSCKKLNSKVYFFNLDDASKIYKKDVRKERHLTLNEESNRKIILDKDFEKYYDKIIARIEENKHKHNDKNIEVFIKDIVGNLNFTEVKKWMALIPDLKEYTIFLNTIVKDESGNMIVGSDVWYEYISLLKNDNVEYSEKRVKMSEIMEKLDYFTYKVQKFDNSFNDLVGDIFYIDDGSKYFTEGKFDRSKFNQNEFL

SEQ ID NO: 14742 - protein, 802 aa, Clostridioides difficile
MKNIMQKEILAKSYNLRTNQQEQTLVEHIKDLFEVLESILELNLYSDKDVEILKICCALHDLGKINSIMQQKMEINNKISYSCSEEERKKLESDKKSLKKIARHNIFSGAFLKDILEKMNLSEEDKLYIYKSIMLHHGNYEDYMRLSISKVQEEIYEYIEKGILEKEEFNLKDIESYINSILNVDFKFGEDVLDYDYIDKLSESMFIDSDYNNGQIDDSVLNYRKFKYILYKGMLNLIDHSASSRQKGIKFYNDFTDEEIDNMILNEIYKSQGNLEKNNIEFNTIQKRLRELSGRNVLTVAFTGSGKTAADYRKTFKRKFFLVPNKISAESFYRKNIFQNKNDLDTRSSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDVDFHLMTATLPKSYKEQMINKGIIFQEESNENVTDKGEIVFIESNKEEEICEGKDVKVSFIKEKEIKSIVEDALENKQKILIIKNTIDSVNRTYEFLKENLSDKYGGVDIDVLHSRFKFKDKKEKYSKILNGEGDIWISTQSVEISLDLDFNIIISDLATMDSLIQRMGRCNRNNKYEYGNFYILPSEDKIYDNKLKSTTKNILKDILKTNSIFTMGIRKTILDDYYDNSVVKKYFEENFISCDKEIKNIYGVNKEIFDGLDLIFNFEPYKNIVDSKKEAAKIFRDVDVSYKIILEEDFYKEDRELQQDSIQVSGFIFNRLYYYGLISKVEGYMVLKSSSKFEYNSTVGLILK

SEQ ID NO: 14743 - protein, 802 aa, Clostridioides difficile
MENIMQKKILAKSYNLRTNQQEQTLVEHIKDLFEVLESILELNLYSDKDVEILKICCALHDLGKINSIMQQKMEINNKISSSCSEEERKKLESDKKSLKKIARHNIFSGAFLKDILEKMNLSEEDKLYIYKSIMLHHGNYEDYMRLSTSKVQEEIYDYIEKGILEKEDFNLKDIEIYIKDILDVDFKFSEDVLDYDYIDKLSESMVVDSDYNNGQIEDSVLNYRKFKYILYKGMLNLIDHSASSRQKGIKFYNDFTDEEIDNMILNEIYKSQGNLEKNNIEFNTIQKRLRELSGRNVLTVAFTGSGKTAADYRKAFKRKFFLVPNKISAESFYRKNIFQNKNDLDTRNSNDYIGLLHGDINLYSENEYNGEHDFVLTLRDIDLSINFCKPCVISTVDQLLLSMFKFPGYEKIFAAVKNASITVDEVHLLEPKMFLILIYFMQFACKYLDVDFHLMTATLPKSYKEQMINKGIIFQEESNENVTDKGEIVFIESNKEEEICEGKDVKVSFIKEKEIKSIVEGALENKQKILIIKNTIDSVNRTYEFLKENLSDKYGGVDIDVLHSRFKFKDKKEKYSKILNGEGDIWISTQSVEISLDLDFNIIISDLATMDSLIQRMGRCNRNNKYEYGNFYILPSEDKIYDNKLKNTTKNILKDILKTNSIFTMGIRKTILDDYYDNSVVKKYFEENFISCDKEIKNIYGINKEIFDGLDLIFNFEPYKNIVDSKKEAAKIFRDVDVSYKIILEEDFYKEDRELQQDSIQVSGFIFNRLYYYGLISKVEGYMVLKSSSKFEYNSTVGLILK

SEQ ID NO: 14744 - protein, 773 aa, Clostridioides difficile
MLYAKSNPVETLREHTDELLKQMNMLRECYGTNINSLNFLEVERFWQLLDFVIEFHDIGKAFSPFQKLIRSRMDIEVNEPKIVTHLENNIGHNYLSPAFIDYRYIDRKKDRELRAVLIQVIVYHHERDVFIDKDFRNLIQKILDEDLINKGYELQHEFKVRYPIRTEELSNTYLQSVIKRIDKNHKYYNLYIMLKGILHRLDHSASAHEIVECNSNMNIGEYTEKHLVKEFGSLREVQSFAKSNRNKNIILIASTGMGKTETALIWIDKDKAFFTLPLRVSINALFDRAKNIIGVGEANDTFLGLLHSTAIDYLEESNQENSNEIVDLAKLLSCKLTFSTIDQIFKFPFLYRGYEKVYSTLAYSKVVIDEIQAYSPEIAAVLVKGIEMIHKIGGKFMIMTATMPTIYIDELKKRDVIDSNLADLTCNTEKIRHCVSIVENSIDENLDKIIQSGMNKKVLVIVNTVKSAVEKYELIEEIVKTKGVDVNLNLLHSMYIQEDRAKLEKYIKEFANSDRNGIWITTQLVEASLDIDFDELHTENSTLDSLFQRFGRCYRSRGYEENSPNIFIYTEKATGIGSIYDKDIVEKGLELLKTFINGKECVKMKEKYKVEMVKILYSKESLEGTAFEKRFTSALNILDTITPYSLGSKDAQNILRNIEGYTVIPEDIYNKIEKTLLKDYEALGKELTEAYSNEDRESINEIKSKRKKARREIIKKSVNIPIYKVKQNIEDINIKGLEDLKILLYKYDIHENKHTKQIFGKGVLISNEIDQFI

SEQ ID NO: 14745 - protein, 798 aa, Clostridioides difficile
MQKEILAKSYNLRTNQQEQTLVEHIKDLFEVLESILELNLYSDKDVEILKICCALHDLGKINSIMQQKMEINNKISYSCSEEERKKLESDKKSLKKIARHNIFSGAFLKDILEKMNLSEEDKLYIYKSIMLHHGNYEDYMRLSISKVQEEIYEYIEKGILEKEEFNLKDIESYINNILNVDFKFGEDVLDYDYIDKLSESMFIDSDYNNGQIDDSVLNYRKFKYILYKGMLNLIDHSASSRQKGIKFYNDFTDEEIDNMILNEIYKSQGNLEKNNIEFNTIQKRLRELSGRNVLTVAFTGSGKTAADYRKTFKRKFFLVPNKISAESFYRKNIFQNKNDLDTRSSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDVDFHLMTATLPKSYKEQMINKGIIFQEESNKNVTDKGEIVFIESNKEEEICEGKDVKVSFIKEKEIKSIVEDALENKQKILIIKNTIDSVNRTYEFLKENLSDKYGGVDIDVLHSRFKFKDKKEKYSKILNGEGDIWISTQSVEISLDLDFNIIISDLATMDSLIQRMGRCNRNNKYEYGNFYILPSEDKIYDNKLKNTTKNILKDILKTNSIFTMGIRKTILDDYYDNSVVKKYFEENFISCDKEIKNIYGINKEIFDGLDLIFNFEPYKNIVDSKKEAAKIFRDIDVSYKIILEEDFYKEDRELQQDSIQVSGFIFNRLYYYGLISKVEGYMVLKSSSKFEYNSTVGLILK

SEQ ID NO: 14746 - protein, 656 aa, Clostridioides difficile
MKNIMQKEILAKSYNLRTNQQEQTLVEHIKDLFEVLESILELNLYSDKDVEILKICCALHDLGKINSIMQQKMEINNKISYSCSEEERKKLESDKKSLKKIARHNIFSGAFLKDILEKMNLSEEDKLYIYKSIMLHHGNYEDYMRLSISKVQEEIYEYIEKGILEKEEFNLKDIESYINSILNVDFKFGEDVLDYDYIDKLSESMFIDSDYNNGQIDDSVLNYRKFKYILYKGMLNLIDHSASSRQKGIKFYNDFTDEEIDNMILNEIYKSQGNLEKNNIEFNTIQKRLRELSGRNVLTVAFTGSGKTAADYRKTFKRKFFLVPNKISAESFYRKNIFQNKNDLDTRSSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDVDFHLMTATLPKSYKEQMINKGIIFQEESNENVTDKGEIVFIESNKEEEICEGKDVKVSFIKEKEIKSIVEDALENKQKILIIKNTIDSVNRTYEFLKENLSDKYGGVDIDVLHSRFKFKDKKEKYSKILNGEGDIWISTQSVEISLDLDFNIIISDLATMDSLIQRMGRCNRNNKYEYGNFYILPSEDKIYDNKLKNTTKNILKDI

SEQ ID NO: 14747 - protein, 632 aa, Clostridioides difficile
ILDEDLINKVYELQHEFKVRYPIKTERLSKVYLQSVEKRIDKNHKYYNLYIMLKGILHRLDHSASAHEVVECNNVINIGEQTENYLMKEFGSLREAQSFAKSNRNKNIILIASTGMGKTETALIWIDKDKAFFTLPLRVSINALFDRAKNIVGVGESNDTFLGLLHSTAIDYLEESNQENSSEIVDLAKLLSCKLTFSTIDQIFKFPFLYRGYEKVYSTLAYSKVVIDEIQAYSPEIAAVLVKGIEMIHKIGGRFMIMTATMPTIYIDELKKRGVMNSNLADLTCNTEKIRHCVSIVENSIDENLGKIIQSGMNKKVLVIVNTVKSAVEKYELIEEIVKPKGIDVNLNLLHSMYIQEDRAKLEKYIKEFADSDSNGIWITTQLVEASLDIDFDELHTENSTLDSLFQRFGRCYRSREYEENSPNIFIYTEKATGIGSIYDKDIVEKGLELLKTFINGKECVKMKEKYKVEMVKILYSKESLEGTAFEKRFTSALNILDTITPYSLGSKDAQNILRNIEGYTVIPEDIYNKIEETLIKDYEELGQELINAYSNDDRQLINKIKSKRKKARREIIKKTVNLPIYKAKQNVIDIQVKGLEDLKILLYKYDIHENKHTKQIFGKGVLISNEIDQFI

SEQ ID NO: 14748 - protein, 773 aa, Clostridioides difficile
MLYAKSNPVETLREHTNELLEQRNLLKYCYNTSINKLDFLGKEKFWEWLDFVIEFHDVGKAFSPFQKLIRSRMDIEINEPEIITNLENNIGHNFISPAFINYGYLDIEDDWDLMDVLNQIIVYHHERDIFIDEDFKDLVQKVLDKDLINKVHELQNEFNIRYPIKTKKLSNIYLQGIEKRIDKNHKYYNLYIMLKGILHRLDHSASAHEIVECNSNMNIGEYTEKHLVKEFGSLREVQSFAKSNRNKNIILIASTGMGKTETALIWIDKDKAFFTLPLRVSINALFDRAKNIVGVGESNDTFLGLLHSTAIDYLEESNQENSNEIVDLAKLLSCKLTFSTIDQIFKFPFLYRGYEKVYSTLAYSKVVIDEIQAYSPEIAAVLVKGIEMIHKIGGRFMIMTATMPTIYIDELKKRGVIDSNLADLTCNTEKIRHCVSIVENSIDENLEQIIQSGMNKKVLVIVNTVKSAIEKYELIEEIVKSKGIDVNVNLLHSMYIQEDRAKLEKYIKEFADSDSNGIWITTQLVEASLDIDFDELHTENSTLDSLFQRFGRCYRSREYEKNSPNIFIYIEKATGIGSIYDKEIVEKGLEILKNHMNGKECFKMKEKHKVQMVEILYSKESLKCTDFEKKFTRALDILDTITPYSLGSNEAQNILRNIEGYTVIPEDIYSEIEKTLIKDYEELGQELKDAYRNDDRQLINEIKSKRKKARREIIKKTVNLPIYKAKQNIVDIQVKGLEDLKILLYKYDIHENEHTKQIFGKGVIIGKEIDQFI

SEQ ID NO: 14749 - protein, 660 aa, Clostridioides difficile
MNSLDKYKAKSDGISIDKHNEDMNYIMNQLVSIYNISYDMRNDLHEAIVCHDVGKVVKSFQDNIENTIRRVRHELLSASIKHLKRGQKLAILTHHKDIEYLVSQITNSIYEIELNELKEILDVEVEDIRPFIKEISRARNDDTRKLENILLKGYLQYCDHIASAGIKSIDKGFNSIKDFSLPKGVSYNSIQEKVLNMDKNEDIMIMAMTGLGKTATSLYWSDIAQNEGKSKRIYYILPYTASINSLYENLHNRNISVSMLHSKAPYFLNKISDEEDIKQLYQIYKKSVKQINVCTIFQLVKSIFSCKRFEMLLSQLKDSIFIVDEIHCFDTRVLCYTLEFLKYLKENLNVQICIMSASIPTCLKKLIQERLKISTIIEPDKNDLINRHKLNRINKSILDGLDKIENDMIQGKRVLICVNSVDLAQELYRKLQSYNPKLIHGRFNTRDREQAEEGIDKSFLLIGTQSIEVSLDISYDVLYTELAPFDSLLQRFGRVNRKGENKELSNVYIYDYDMNLNIYDYDIVNRTDIVISEIIHKDNSIVNESKVSFYLDNVYLDIDMDKYNKHKTTLEIIIRNMRVGVWNKSASIDMLNNDSISVIPESLIDEYKLFLNQKMYLEASSLFVNVSVKRYNSNRNMFYEDNDVIVTSYSYDNKLGLEFD

SEQ ID NO: 14750 - protein, 798 aa, Clostridioides difficile
MQKEILAKSYNLRTNQQEQTLVEHIKDLFEVLESILELNLYSDKDVEILKICCVLHDLGKINSIMQQKMEINNKISYSCSEEERKKLESDKKSLKKIARHNIFSGAFLKDILEKMNLSEEDKLYIYKSIMLHHGNYEDYMRLSTSKVQEEIYEYIEKGILEKEEFNLKDIESYINDILNVDFKFDEDVLDYDYIDKLSESMFIDSDYNNGQIDDSVLNYRKFKYILYKGMLNLIDHSASSRQKGIKFYNDFTDEEIDNMILSEIYKSQGNLEKNNIKFNTIQKRLRELSGRNVLTVAFTGSGKTAADYRKTFKRKFFLVPNKISAESFYRKNIFQNKNDLDTRSSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDVDFHLMTATLPKSYKEQMINKGIIFQEESNENVTDKGEIVFIESNKEEEICEGKDVKVSFIKEKEIKSIVEDALENKQKILIIKNTIDSVNRTYEFLKENLSDKYGGVDIDVLHSRFKFKDKKEKYSKILNGEGDIWISTQSVEISLDLDFNIIISDLATMDSLIQRMGRCNRNNKYEYGNFYILPSEDKIYDNKLKNTTKSILNKIIKTNSIFTMGIRKIILADYYDNSVVKKYFEENFISCDKEIKNIYGINKEIFDGLDLIFNFEPYKNIVDSKKEAAKIFRDVDVSYKIILEEDFYKEDRELQQDSIQVSGFIFNRLYYYGLISKVEGYMVLKSSSKFEYNSTVGLILK

SEQ ID NO: 14751 - protein, 802 aa, Clostridioides difficile
MKNIMQKEILAKSYNLRTNQQEQTLVEHIKDLFEVLESILELNLYSDKDVEILKICCALHDLGKINSIMQQKMEINNKISYSCSEEERKKLESDKKSLKKIARHNIFSGAFLKDILEKMNLSEEDKLYIYKSIMLHHGNYEDYMRLSISKVQEEIYEYIEKGILEKEEFNLKDIESYINSILNVDFKFGEDVLDYDYIDKLSESMFIDSDYNNGQIDDSVLNYRKFKYILYKGMLNLIDHSASSRQKGIKFYNDFTDEEIDNMILNEIYKSQGNLEKNNIEFNTIQKRLRELSGRNVLTVAFTGSGKTAADYRKTFKRKFFLVPNKISAESFYRKNIFQNKNDLDTRSSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDIDFHLMTATLPKSYKEQMINKGIIFQEESNENVTDKGEIVFIESNKEEEICEGKDVKVSFIKEKEIKSIVEDALENKQKILIIKNTIDSVNRTYEFLKENLSDKYGGVDIDVLHSRFKFKDKKEKYSKILNGEGDIWISTQSVEISLDLDFNIIISDLATMDSLIQRMGRCNRNNKYEYGNFYILPSEDKIYDNKLKNTTKNILKDILKTNSIFTMGIRKTILDDYYDNSVVKKYFEENFISCDKEIKNIYGVNKEIFDGLDLIFNFEPYKNIVDSKKEAAKIFRDVDVSYKIILEEDFYKEDRELQQDSIQVSGFIFNRLYYYGLISKVEGYMVLKSSSKFEYNSTVGLILK

SEQ ID NO: 14752 - protein, 546 aa, Clostridioides difficile
MKEFGSLREAQSFAKSNRNKNIILIASTGMGKTETALIWIDKDKAFFTLPLRVSINALFDRAKNIVGVGESNDTFLGLLHSTAIDYLEESNQENSSEIVDLAKLLSCKLTFSTIDQIFKFPFLYRGYEKVYSTLAYSKVVIDEIQAYSPEIAAVLVKGIEMIHKIGGRFMIMTATMPTIYIDELKKRGVMNSNLADLTCNTEKIRHCVSIVENSIDENLGKIIQSGMNKKVLVIVNTVKSAVEKYELIEEIVKPKGIDVNLNLLHSMYIQEDRAKLEKYIKEFADSDSNGIWITTQLVEASLDIDFDELHTENSTLDSLFQRFGRCYRSREYEENSPNIFIYTEKATGIGSIYDKDIVEKGLELLKTFINGKECVKMKEKYKVEMVKILYSKESLEGTAFEKRFTSALNILDTITPYSLGSKDAQNILRNIEGYTVIPEDIYNKIEETLIKDYEELGQELINAYSNDDRQLINKIKSKRKKARREIIKKTVNLPIYKAKQNVIDIQVKGLEDLKILLYKYDIHENKHTKQIFGKGVLISNEIDQFI

SEQ ID NO: 14753 - protein, 773 aa, Clostridioides difficile
MLYAKSNPVETLREHTDELLKQMNVLRESYGKNINSLDFLEEEIFWQLLDFVIEFHDIGKAFSPFQELIKSRMDTKINEPKIVTHLENNVGHNYLSPAFIDYSYIDRKKNKELRAVLNQVIVYHHERDIFIDKDFKNLIQKILDEDLINKVYELQHEFKVRYPIKTEKLSKVYLQSVEKRIDKNHKYYNLYIMLKGILHRLDHSASAHEIVECNSNMNIGEYTEKHLVKEFGSLREVQSFAKSNRNKNIILIASTGMGKTETALIWIDKDKAFFTLPLRVSINALFDRAKNIIGVGEANDTFLGLLHSTAIDYLEESNQENSNEIVDLAKLLSCKLTFSTIDQIFKFPFLYRGYEKVYSTLAYSKVVIDEIQAYSPEIAAVLVKGIEMIHKIGGRFMIMTATMPTIYIDELKKRGVMNSNLADLTCNTEKIRHCVSIVENSIDENLGKIIQSGMNKKVLVIVNTVKSAVEKYELIEEIVKPKGIDVNLNLLHSMYIQEDRAKLEKYIKEFADSDSNGIWITTQLVEASLDIDFDELHTENSTLDSLFQRFGRCYRSREYEENSPNIFIYTEKATGIGSIYDKDIVEKGLELLKTFINGKECVKMKEKYKVEMVKILYSKESLEGTAFEKRFTSALNILDTITPYSLGSKDAQNILRNIEGYTVIPEDIYNKIEETLIKDYEELGQELINAYSNDDRQLINKIKSKRKKARREIVKKTVNLPIYKAKQNVIDIQVKGLEDLKILLYKYDIYENKHTKQIFGKGVLISNEIDQFI

SEQ ID NO: 14754 - protein, 802 aa, Clostridioides difficile; identical to SEQ ID NO: 12184

SEQ ID NO: 14755 - protein, 773 aa, Clostridioides difficile
MLYAKSNPVETLREHTDELLKQMNVLRESYGKNINSLDFLEEEIFWQLLDFVIEFHDIGKAFSPFQELIKSRMDTKINEPKIVTHLENNVGHNYLSPAFIDYSYIDRKKNKELRAVLNQVIVYHHERDIFIDKDFKNLIQKILDEDLINKVYELQHEFKVRYPIKTEKLSKVYLQSVEKRIDKNHKYYNLYIMLKGILHRLDHSASAHEIVECNSNMNIGEYTEKHLVKEFGSLREVQSFAKSNRNKNIILIASTGMGKTETALIWIDKDKAFFTLPLRVSINALFDRAKNIIGVGEANDTFLGLLHSTAIDYLEESNQENSNEIVDLAKLLSCKLTFSTIDQIFKFPFLYRGYEKVYSTLAYSKVVIDEIQAYSPEIAAVLVKGIEIIHKIGGRFMIMTATMPTIYIDELKKRGVMNSNLADLTCNTEKIRHCVSIVENSIDENLGKIIQNGMNKKVLVIVNTVKSAVEKYELIEEIVKPKGIDVNLNLLHSMYIQEDRAKLEKYIKEFADSDSNGIWITTQLVEASLDIDFDELHTENSTLDSLFQRFGRCYRSREYEENSPNIFIYTEKATGIGSIYDKDIVEKGLELLKTFINGKECVKMKEKYKVEMVKILYSKESLEGTAFEKRFTSALNILDTITPYSLGSKDAQNILRNIEGYTVIPEDIYNKIEETLIKDYEELGQELINAYSNDDRQLINKIKSKRKKARREIIKKTVNLPIYKAKQNVIDIQVKGLEDLKILLYKYDIYENKHTKQIFGKGVLISNEIDQFI

SEQ ID NO: 14756 - protein, 512 aa, Clostridioides difficile
MRELSGRNVLTVAFTGSGKTAADYRKTFKRILVPNKISAESFYRKNIFQNKNDLDTRSSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDVDFHLMTATLPKSYKEQMINKGIIFQEESNENVTDKGEIVFIESNKEEEICEGKDVKVSFIKEKEIKSIVEDALENKQKILIIKNTIDSVNRTYEFLKENLSDKYGGVDIDVLHSRFKFKDKKEKYSKILNGEGDVWISTQSVEISLDLDFNIIISDLATMDSLIQRMGRCNRNNKYEYGNFYILPSEDKIYDNKLKSTTKNILKDILKTNSIFTMGIRKTILDDYYDNSVVKKYFEENFISCDKEIKNIYGINKEIFDGLDLIFNFEPYKNIVDSKKEAAKIFRDVDVSYKIILEEDFYKEDRELQQDSIQVSGFIFNRLYYYGLISKVEGYMVLKSSSKFEYNSTVGLILK

SEQ ID NO: 14757 - protein, 802 aa, Clostridioides difficile
MKNIMQKEILAKSYNLRTNQQEQTLVEHIKDLFEVLESILELNLYSDKDVEILKICCALHDLGKINSIMQQKMEINNKISYSCSEEERKKLESDKKSLKKIARHNIFSGAFLKDILEKMNLSEEDKLYIYKSIMLHHGNYEDYMRLSTSKVQKEIYDYIEKGILEKEDFNLEDIESYINNILNVDFKFGEDVLDYDYIDKLSESMFIDSDYNKGQIDDSVLNYRKFKYILYKGMLNLIDHSASSRQKGIKFYNDFTDEEIDDMILNEIYKSQGNLDKNNIEFNTIQKRLRELSGRNVLTVAFTGSGKTAADYRKTFKRKFFLVPNKISAESFYRKNIFQNKNDLDTRSSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDVDFHLMTATLPKSYKEQMINKGIVFQEESNENVTDKGEIVFIESNKEEEICEGKDVKVSFIKEKEIKSIVEGALENKQKILIIKNTIDSVNRTYEFLKENLSDKYGGVDIDVLHSRFKFKDKKEKYSKILNGEGDIWISTQSVEISLDLDFNIIISDLATMDSLIQRMGRCNRNNKYEYGNFYILPSEDKIYDNKLKNTTKNILKDILKTKSIFTMGIRKTILDDYYDNSVVKKYFEENFISCDKEIKNIYGINKEIFDGLDLIFNFEPYKNIVDSKKEAAKIFRDVDVSYKIILEEDFYKEDRELQQDSIQVSGFIFNRLYYYGLISKVEGYMVLKSSSKFEYNSTVGLILK

SEQ ID NO: 14758 - protein, 773 aa, Clostridioides difficile; identical to SEQ ID NO: 12202

SEQ ID NO: 14759 - protein, 798 aa, Clostridioides difficile
MQKEILAKSYNLRTNQQEQTLVEHIKDLFEVLESILELNLYSDKDVEILKICCALHDLGKINSIMQQKMEINNKISYSCSEEERKKLESDKKSLKKIARHNIFSGAFLKNILEKMNLSEEDKLYIYKSIMLHHGNYEDYMRLSTSKVQKEIYDYIEKGILEKEDFNLEDIEDYIKEILYVDFKFNEDVLDYDYIDKLSESMVIDSDYNNGQIEDSVLNYRKFKYILYKGMLNLIDHSASSRQKGIKFYNDFTDEEIDNMILSEIYKSQGNLEKNNIEFNTIQKRLRELSGRNVLTVAFTGSGKTAADYRKTFKRKFFLVPNKISAESFYRKNIFQNKNDLDTRSSNDYIGLLHGDINLYSENEDNGENDFVLTLRDIDLSINFCKPCVIATVDQLLLSMFKFPGYEKIFAAVKNASITVDEVHLLEPKMFLILIYFMQFACKYLDVDFHLMTATLPKSYKEQMINKGIIFQEESNENVTDKGEIVFIESNKEEEICEGKDVKVSFIKEKEIKSIVEDALENKQKILIIKNTIDSVNRTYEFLKENLSDKYGGVDIDVLHSRFKFKDKKEKYSKILNGEGDIWISTQSVEISLDLDFNIIISDLATMDSLIQRMGRCNRNNKYEYGNFYILPSEDKIYDNKLKSTTKNILKDILKTKSIFTMGIRKTILDDYYDNSVVKKYFEENFISCDKEIKNIYGINKEIFDGLDLIFNFEPYKNIVDSKKEAAKIFRDVDVSYKIILEEDFYKEDRELQQDSIQVSGFIFNRLYYYGLISKVEGYMVLKSSSKFEYNSTVGLILK

SEQ ID NO: 14760 - protein, 773 aa, Clostridioides difficile
MLYAKSNPVETLREHTDELLKQMNVLRESYGKNINSLDFLEEEIFWQLLDFVIEFHDIGKAFSPFQELIKSRMDTKINEPKIVTYLENNVGHNYLSPAFIDYSYIGRKKNKELRAVLNQVIVYHHERDIFIDKDFKNLIQKILDEDLINKVYELQHEFKVRYPIKTEKLSKVYLQSVEKRIDKNHKYYNLYIMLKGILHRLDHSASAHEVVECNNVINIGEQTENYLMKEFGSLREAQSFAKSNRNKNIILIASTGMGKTETALIWIDKDKAFFTLPLRVSINALFDRAKNIVGVGESNDTFLGLLHSTAIDYLEESNQENSSEIVDLAKLLSCKLTFSTIDQIFKFPFLYRGYEKVYSTLAYSKVVIDEIQAYSPEIAAVLVKGIEMIHKIGGRFMIMTATMPTIYIDELKKRGVMNSNLAELTCNTEKIRHCVSIVENSIDENLGKIIQSGMNKKVLVIVNTVKSAVEKYELIEEIVKPKGIDVNLNLLHSMYIQEDRAKLEKYIKEFANSDRNGIWITTQLVEASLDIDFDELHTENSTLDSLFQRFGRCYRSREYEENSPNIFIYTEKATGIGSIYDKDIVEKGLELLKTFINGKECVKMKEKYKVEMVKILYSKESLEGTAFEKRFTSALNILDTITPYSLGSKDAQNILRNIEGYTVIPEDIYNKIEETLIKDYEELGQELINAYSNDDRQLINKIKSKRKKARREIIKKTVNLPIYKAKQNVIDIQVKGLEDLKILLYKYDIYENKHTKQIFGKGVLISNEIDQFI

SEQ ID NO: 14761 - protein, 802 aa, Clostridioides difficile; identical to SEQ ID NO: 12186

SEQ ID NO: 14762 - protein, 773 aa, Clostridioides difficile; identical to SEQ ID NO: 12187

SEQ ID NO: 14763 - protein, 798 aa, Clostridioides difficile
MQKEILAKSYNLRTNQQEQTLVEHIKDLFEVLESILELNLYSDKDVEILKICCALHDLGKINSIMQQKMEINNKISYSCSEEERKKLESDKKSLKKIARHNIFSGAFLKDILEKMNLSEEDKLYIYKSIMLHHGNYEDYMRLSISKVQKEIYDYIEKGILEKEDFNLEDIEDYIKEILDVDFKFNEDVLDYDYIDKLSESMFIDSDYNNGQIDDSVLNYRKFKYILYKGMLNLIDHSASSRQKGIKFYNDFTDEEIDNMILNEIYKSQGNLEKNNIEFNTIQKRLRELSGRNVLTVAFTGSGKTAADYRKTFKRKFFLVPNKISAESFYRKNIFQNKNDLDTRSSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDVDFHLMTATLPKSYKEQMINKGIIFQEESNENVTDKGEIVFIESNKEEEICEGKDVKVSFIKEKEIKSIVEDALENKQKILIIKNTIDSVNRTYEFLKENLSDKYGGVDIDVLHSRFKFKDKKEKYSKILNGEGDIWISTQSVEISLDLDFNIIISDLATMDSLIQRMGRCNRNNKYEYGNFYILPSEDKIYDNKLKNTTKNILKDILKTNSIFTMGIRKTILDDYYDNSVVKKYFEENFISCDKEIKNIYGINKEIFDGLDLIFNFEPYKNIVDSKKEAAKIFRDVDVSYKIILEEDFYKEDRELQQDSIQVSGFIFNRLYYYGLISKVEGYMVLKSSSKFEYNSTVGLILK

SEQ ID NO: 14764 - protein, 802 aa, Clostridioides difficile
MKNIMQKEILAKSYNLRTNQQEQTLVEHIKDLFEVLESILELNLYSDKDVEILKICCALHDLGKINSIMQQKMEINNKISYSCSEEERKKLESDKKSLKKIARHNIFSGAFLKDILEKMNLSEEDKLYIYKSIMLHHGNYEDYMRLSISKVQEEIYEYIEKGILEKEEFNLKDIESYINSILNVDFKFGEDVLDYDYIDKLSESMFIDSDYNNGQIDDSVLNYRKFKYILYKGMLNLIDHSASSRQKGIKFYNDFTDEEIDNMILNEIYKSQGNLEKNNIEFNTIQKRLRELSGRNVLTVAFTGSGKTAADYRKTFKRKFFLVPNKISAESFYRKNIFQNKNDLDTRSSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDVDFHLMTATLPKSYKEQMINKGIIFQEESNENVTDKGEIVFIESNKEEEICEGKDVKVSFIKEKEIKSIVEDALENKQKILIIKNTIDSVNRTYEFLKENLSDKYGGVDIDVLHSRFKFKDKKEKYSKILNGEGDIWISTQSVEISLDLDFNIIISDLATMDSLTQRMGRCNRNNKYEYGNFYILPSEDKIYDNKLKSTTKNILKDILKTNSIFTMGIRKTILDDYYDNSVVKKYFEENFISCDKEIKNIYGVNKEIFDGLDLIFNFEPYKNIVDSKKEAAKIFRDVDVSYKIILEEDFYKEDRELQQDSIQVSGFIFNRLYYYGLISKVEGYMVLKSSSKFEYNSTVGLILK

SEQ ID NO: 14765 - protein, 798 aa, Clostridioides difficile
MQKEILAKSYNLRTNQQEQTLVEHIKDLFEVLESILELNLYSDKDVEILKICCALHDLGKINSIMQQKMEINNKISYSCSEEERKKLESDKKSLKKIARHNIFSGAFLKDILEKMNLSEEDKLYIYKSIMLHHGNYEDYMRLSTSKVQKEIYDYIEKGILEKEDFNLEDIESYINNILNVDFKFGEDVLDYDYIDKLSESMFIDSDYNKGQIDDSVLNYRKFKYILYKGMLNLIDHSASSRQKGIKFYNDFTDEEIDDMILNEIYKSQGNLDKNNIEFNTIQKRLRELSGRNVLTVAFTGSGKTAADYRKTFKRKFFLVPNKISAESFYRKNIFQNKNDLDTRSSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDVDFHLMTATLPKSYKEQMINKGIVFQEESNENVTDKGEIVFIESNKEEEICEGKDVKVSFIKEKEIKSIVEGALENKQKILIIKNTIDSVNRTYEFLKENLSDKYGGVDIDVLHSRFKFKDKKEKYSKILNGEGDIWISTQSVEISLDLDFNIIISDLATMDSLIQRMGRCNRNNKYEYGNFYILPSEDKIYDNKLKNTTKNILKDILKTKSIFTMGIRKTILDDYYDNSVVKKYFEENFISCDKEIKNIYGINKEIFDGLDLIFNFEPYKNIVDSKKEAAKIFRDVDVSYKIILEEDFYKEDRELQQDSIQVSGFIFNRLYYYGLISKVEGYMVLKSSSKFEYNSTVGLILK

SEQ ID NO: 14766 - protein, 802 aa, Clostridioides difficile
MKNIMQKEILAKSYNLRTNQQEQTLVEHIKDLFEVLESILELNLYSDKDVEILKICCALHDLGKINSIMQQKMEINNKISYSCSEEERKKLESDKKSLKKIARHNIFSGAFLKNILEKMNLSEEDKLYIYKSIMLHHGNYEDYMRLSTSKVQKEIYDYIEKGILEKEDFNLEDIEDYIKEILYVDFKFNEDVLDYDYIDKLSESMVIDSDYNNGQIEDSVLNYRKFKYILYKGMLNLIDHSASSRQKGIKFYNDFTDEEIDNMILSEIYKSQGNLEKNNIEFNTIQKRLRELSGRNVLTVAFTGSGKTAADYRKTFKRKFFLVPNKISAESFYRKNIFQNKNDLDTRSSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDVDFHLMTATLPKSYKEQMINKGIIFQEESNENVTDKGEIVFIESNKEEEICEGKDVKVSFIKEKEIKSIVEDALENKQKILIIKNTIDSVNRTYEFLKENLSDKYGGVDIDVLHSRFKFKDKKEKYSKILNGEGDIWISTQSVEISLDLDFNIIISDLATMDSLIQRMGRCNRNNKYEYGNFYILPSEDKIYDNKLKSTTKNILKDILKTNSIFTMGIRKTILDDYYDNSVVKKYFEENFISCDKEIKNIYGINKEIFDGLDLIFNFEPYKNIVDSKKEAAKIFRDVDVSYKIILEEDFYKEDRELQQDSIQVSGFIFNRLYYYGLISKVEGYMVLKSSSKFEYNSTVGLILK

SEQ ID NO: 14767 - protein, 798 aa, Clostridioides difficile
MQKEILAKSYNLRTNQQEQTLVEHIKDLFEVLESILELNLYSDKDVEILKICCALHDLGKINSIMQQKMEINNKISYSCSEEERKKLESDKKSLKKIARHNIFSGAFLKNILEKMNLSEEDKLYIYKSIMLHHGNYEDYMRLSTSKVQKEIYDYIEKGILEKEDFNLEDIEDYIKEILYVDFKFNEDVLDYDYIDKLSESMVIYSDYNNGQIEDSVLNYRKFKYILYKGMLNLIDHSASSRQKGIKFYNDFTDEEIDNMILNEIYKSQGNLEKNNIEFNTIQKRLRELSGRNVLTVAFTGSGKTAADYRKTFKRKFFLVPNKISAESFYRKNIFQNKNDLDTRSSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDVDFHLMTATLPKSYKEQMINKGIIFQEESNENVTDKGEIVFIESNKEEEICEGKDVKVSFIKEKEIKSIVEDALENKQKILIIKNTIDSVNRTYEFLKENLSDKYGGVDIDVLHSRFKFKDKKEKYSKILNGEGDIWISTQSVEISLDLDFNIIISDLATMDSLIQRMGRCNRNNKYEYGNFYILPSEDKIYDNKLKSTTKNILKDILKTNSIFTMGIRKTILDDYYDNSVVKKYFEENFISCDKEIKNIYGVNKEIFDGLDLIFNFEPYKNIVDSKKEAAKIFRDVDVSYKIILEEDFYKEDRELQQDSIQVSGFIFNRLYYYGLISKVEGYMVLKSSSKFEYNSTVGLILK

SEQ ID NO: 14768 - protein, 798 aa, Clostridioides difficile
MQKEILAKSYNLRTNQQEQTLVEHIKDLFEVLESILELNLYSDKDVEILKICCALHDLGKINSIMQQKMEINNKISYSCSEEERKKLESDKKSLKKIARHNIFSGAFLKDILEKMNLSEEDKLYIYKSIMLHHGNYEDYMRLSISKVQEEIYEYIEKGILEKEEFNLKDIESYINNILNVDFKFGEDVLDYDYIDKLSESMFIDSDYNNGQIDDSVLNYRKFKYILYKGMLNLIDHSASSRQKGIKFYNDFTDEEIDNMILNEIYKSQGNLEKNNIEFNTIQKRLRELSGRNVLTVAFTGSGKTAADYRKTFKRKFFLVPNKISAESFYRKNIFQNKNDLDTRSSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDVDFHLMTATLPKSYKEQMINKGIIFQEESNKNVTDKGEIVFIESNKEEEICEGKDVKVSFIKEKEIKSIVEDVLENKQKILIIKNTIDSVNRTYEFLKENLSDKYGGVDIDVLHSRFKFKDKKEKYSKILNGEGDIWISTQSVEISLDLDFNIIISDLATVDSLIQRMGRCNRNNKYEYGNFYILPSEDKIYDNKLKNTTKNILKDILKTNSIFTMGIRKTILDDYYDNSVVKKYFEENFISCDKEIKNIYGINKEIFDGLDLIFNFEPYKNIVDSKKEAAKIFRDIDVSYKIILEEDFYKEDRELQQDSIQVSGFIFNRLYYYGLISKVEGYMVLKSSSKFEYNSTVGLILK

SEQ ID NO: 14769 - protein, 798 aa, Clostridioides difficile
MQKEILAKSYNLRTNQQEQTLVEHIKDLFEVLESILELNLYSDKDVEILKICCALHDLGKINSIMQQKMEINNKISYSCSEEERKKLESDKKSLKKIARHNIFSGAFLKDILEKMNLLEEDKLYIYKSIMLHHGNYEDYMRLSTSKVQEEIYDYIEKGILEKEEFNLKDIESYINDILNVDFKFGEDVLDYDYIDKLSESMFIDSDYNNGQIDDSVLNYRKFKYILYKGMLNLIDHSASSRQKGIKFYNDFTDEEIDDMILNEIYKSQGNLEKNNIEFNTIQKRLRELSGRNVLTVAFTGSGKTAADYRKTFKRKFFLVPNKISAESFYRKNIFQNKNDLDTRSSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDVDFHLMTATLPKSYKEQMINKGIIFQEESNENVTDKGEIVFIESNKEEEICEGKDVKVSFIKEKEIKSIVEGALENKQKILIIKNTIDSVNRTYEFLKENLSDKYGGVDIDVLHSRFKFKDKKEKYSKILNGEGDIWISTQSVEISLDLDFNIIISDLATMDSLIQRMGRCNRNNKYEYGNFYILPSEDKIYDNKLKNTTKNILKDILKTNSIFTMGIRKTILDDYYDNSVVKNYFEENFISCDKEIKNIYGINKEIFDGLDLIFNFEPYKNIVDSKKEAAKIFRDVDVSYKIILEEDFYKEDRELQQDSIQVSGFIFNRLYYYGLISKVEGYMVLKSSSKFEYNSTVGLILK

SEQ ID NO: 14770 - protein, 802 aa, Clostridioides difficile
MKNIMQKEILAKSYNLRTNQQEQTLVEHIKDLFEVLESILELNLYSDKDVEILKICCALHDLGKINSIMQQKMEINNKISYSCSEEERKKLESDKKSLKKIARHNIFSGAFLKNILEKMNLSEEDKLYIYKSIMLHHGNYEDYMRLSTSKVQKEIYDYIEKGILEKEDFNLEDIEDYIKEILYVDFKFNEDVLDYDYIDKLSESMVIDSDYNNGQIEDSVLNYRKFKYILYKGMLNLIDHSASSRQKGIKFYNDFTDEEIDNMILNEIYKSQGNLEKNNIEFNTIQKRLRELSGRNVLTVAFTGSGKTAADYRKTFKRKFFLVPNKISAESFYRKNIFQNKNDLDTRSSNDYIGLLHGDINLYSENEDNGENDFVLTLRDIDLSINFCKPCVIATVDQLLLSMFKFPGYEKIFAAVKNASITVDEVHLLEPKMFLILIYFMQFACKYLDVDFHLMTATLPKSYKEQMINKGIIFQEESNENVTDKGEIVFIESNKEEEICEGKDVKVSFIKEKEIKSIVEDALENKQKILIIKNTIDSVNRTYEFLKENLSDKYGGVDIDVLHSRFKFKDKKEKYSKILNGEGDIWISTQSVEISLDLDFNIIISDLATMDSLIQRMGRCNRNNKYEYGNFYILPSEDKIYDNKLKNTTKSILKDILKTNSIFTMGIRKTILDDYYDNSVVKKYFEENFISCDKEIKNIYGINKEIFDGLDLIFNFEPYKNIVDSKKEAAKIFRDVDVSYKIILEEDFYKEDRELQQDSIQVSGFIFNRLYYYGLISKVEGYMVLKSSSKFEYNSTVGLILK

SEQ ID NO: 14771 - protein, 802 aa, Clostridioides difficile
MKNIMQKEILAKSYNLRTNQQEQTLVEHIKDLFEVLESILELNLYSDKDVEILKICCALHDLGKINSIMQQKMEINNKISYSCSEEERKKLESDKKSLKKIARHNIFSGAFLKDILEKMNLPEEDKLYIYKSIMLHHGNYEDYMRLSISKVQKEIYDYIEKGILEKEDFNLEDIEDYIKEILDVDFKFNEDVLDYDYIDKLSESMFIDSDYNKGQIDDSVLNYRKFKYILYKGMLNLIDHSASSRQKGIKFYNDFTDEEIDDMILNEIYKSQGNLEKNNIEFNTIQKRLRELSGRNVLTVAFTGSGKTAADYRKTFKRKFFLVPNKISAESFYRKNIFQNKNDLDTRSSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDVDFHLMTATLPKSYKEQMINKGIIFQEESNENVTDKGEIVFIESNKEEEICEGKDVKVSFIKEKEIKSIVEDALENKQKILIIKNTIDSVNRTYEFLKENLSDKYGGVDIDVLHSRFKFKDKKEKYSKILNGEGDIWISTQSVEISLDLDFNIIISDLATMDSLIQRMGRCNRNNKYEYGNFYILPSEDKIYDNKLKNTTKSILKDILKTNSIFTMGIRKTILDDYYDNSVVKKYFEENFISCDKEIKNIYGINKEIFDGLDLIFNFEPYKNIVDSKKEAAKIFRDVDVSYKIILEEDFYKEDRELQQDSIQVSGFIFNRLYYYGLISKVEGYMVLKSSSKFEYNSTVGLILK

SEQ ID NO: 14772 - protein, 773 aa, Clostridioides difficile
MLYAKSNPVETLREHTDELLKQMNVLRESYGKNINSLDFLEEEIFWQLLDFVIEFHDIGKAFSPFQELIKSRMDTKINEPKIVTHLENNVGHNYLSPAFIDYSYIDRKKNKELRAVLNQVIVYHHERDIFIDKDFKNLIQKILDEDLINKVYELQHEFKVRYPIKTEKLSKVYLQSVEKRIDKNHKYYNLYIMLKGILHRLDHSASAHEVVECNNVINIGEQTENYLMKEFGSLREAQSFAKSNRNKNIILIAPTGMGKTETALIWIDKDKAFFTLPLRVSINALFDRAKNIVGVGESNDTFLGLLHSTAIDYLEESNQENSSEIVDLAKLLSCKLTFSTIDQIFKFPFLYRGYEKVYSTLAYSKVVIDEIQAYSPEIAAVLVKGIEMIHKIGGRFMIMTATMPTIYIDELKKRGVMNSNLAELTCNTEKIRHCVSIVENSIDENLGKIIQSGMNKKVLVIVNTVKSAVEKYELIEEIVKPKGIDVNLNLLHSMYIQEDRAKLEKYIKEFADSDSNGIWITTQLVEASLDIDFDELHTENSTLDSLFQRFGRCYRSREYEENSPNIFIYTEKATGIGSIYDKDIVEKGLELLKTFINGKECVKMKEKYKVEMVKILYSKESLEGTAFEKRFTSALNILDTITPYSLGSKDAQNILRNIEGYTVIPEDIYNKIEETLIKDYEELGQELINAYSNDDRQLINKIKSKRKKARREIIKKTVNLPIYKAKQNVIDIQVKGLEDLKILLYKYDIHENKHTKQIFGKGVLISNEIDQFI

SEQ ID NO: 14773 - protein, 660 aa, Clostridioides difficile
MNSLDKYKAKSDGISINKHNEDMNYIMNQLVCIYNISDDMRNDLHEAIVCHDVGKVVKSFQDNIENTIRRVRHELLSASIKHLKRGQKLAILTHHKDIKFLEGQITNSIYEIELNELKEILDVEVEDIRPFIKEISRARNDDTRKLENILLKGYLQYCDHIASAGIKSIDKGFNSIKDFSLPKGVSYNSIQEKVLNMDKNEDIMIMAMTGLGKTATSLYWSDIAQNEGKSKRIYYILPYTASINSLYENLHNRNISVSMLHSKAPYFLNKISDEEDIKQLYQIYKKSVKQINVCTIFQLVKSIFSCKRFEMLLSQLKDSIFIVDEIHCFDTRVLCYTLEFLKYLKENLNIQICIMSASIPTCLKKLIQEILKISTIIEPDKNDLINRHKLNRINKSILDSLDKIENDMIQGKRVLICVNSVDLAQELYRKLQSYNPKLIHGRFNTRDREQAEEGIEKSFLLIGTQSIEVSLDISYDVLYTELAPFDSLLQRFGRVNRKGEKKELSNVYIYNYDMNLNIYDYDIVNRTDTIISEIIHKDNSIVNESKVSFYLDNVYLDIDMDKYNKHKTTLEIIIRNMRVGIWNKSASIDMLNNDSISVIPESLIDEYKLFLNQKMYLEASSLFVNVSVKRYNSNRNMFYEDNDVIVTRYSYDNKLGLEFD

SEQ ID NO: 14774 - protein, 780 aa, Clostridioides difficile
MQKEILAKSYNLRTNQQEQTLVEHIKDLFEVLESILELNLYSDKDVEILKICCALHDLGKINSIMQQKMEINNKISYSCSEEERKKLESDKKSLKKIARHNIFSGAFLKDILEKMNLSEEDKLYIYKSIMLHHGNYEDYMRLSTSKVQKEIYDYIEKGILEKEDFNLEDIEDYIKEILDVDFKFNEDVLDYDYIDKLSESMFIDSDYNNGQIDDSVLNYRKFKYILYKGMLNLIDHSASSRQKGIKFYNDFTDEEIDNMILNEIYKSQGNLEKNNIEFNTIQKRLRELSGRNVLTVAFTGSGKTAADYRKTFKRKFFLVPNKISAESFYRKNIFQNKNDLDTRSSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDVDFHLMTATLPKSYKEQMINKGIVFQEESNENVTDKGEIVFIESNKEEEICEGKDVKVSFIKEKEIKSIVEGALENKQKILIIKNTIDSVNRTYEFLKENLSDKYGGVDIDVLHSRFKFKDKKEKYSKILNGEGDIWISTQSVEISLDLDFNIIISDLATMDSLIQRMGRCNRNNKYEYGNFYILPSEDKIYDNKLKNTTKNILKDILKTKSIFTMGIRKTILDDYYDNSVVKKYFEENFISCDKEIKNIYGINKEIFDGLDLIFNFEPYKNIVDSKKEAAKIFRDVDVSYKIILEEDFYKEDRELQQDSIQVSGFIFNRLYYYGLISKVEGSWY

SEQ ID NO: 14775 - protein, 547 aa, Clostridioides difficile
MNELKEILDVEVEDIRPFINEISRARNDDTRKLENILLKGYLQYCDHIASAGIKSIDKGFNSIKDFSLPKGVSYNSIQEKVLNMDKNEDIMIMAMTGLGKTATSLYWSDIAQNEGKSKRIYYILPYTASINSLYENLYNRNISVSMLHSKAPYFLNKISDEEDIKQLYQIYKKSVKQINVCTIFQLVKSIFSCKRFEMLLSQLKDSIFIVDEIHCFDTRVLCYTLEFLKYLKENLNIQICIMSASIPTCLKKLIQERLKISTIIEPDKNDLINRHKLNRINKSILDSLDKIENDMIQGKRVLICVNSVDLAQELYRKLQSYNPKLIHGRFNTRDREQAEEGIEKSFLLIGTQSIEVSLDISYDVLYTELAPFDSLLQRFGRVNRKGENKELSNVYIYDYDMNLNIYDYDIVNRTDTIISEIIHKDNSIVNESKVSFYLDNVYLDIDMDKYNKHKTTLEIIIRNMRVGIWNKSASIDMLNNDSISVIPESLIDEYKLFLNQKMYLEASSLFVNVSVKRYNSNRNMFYEDNDVIVTSYSYDNKLGLEFD

SEQ ID NO: 14776 - protein, 798 aa, Clostridioides difficile
MQKEILAKSYNLRTNQQEQTLVEHIKDLFEVLESILELNLYSDKDVEILKICCALHDLGKINSIMQQKMEINNKISYSCSEEERKKLESDKKSLKKIARHNIFSGAFLKDILEKMNLSEEDKLYIYKSIMLHHGNYEDYMRLSISKVQEEIYEYIEKGILEKEEFNLKDIESYINSILNVDFKFGEDVLDYDYIDKLSESMFIDSDYNNGQIDDSVLNYRKFKYILYKGMLNLIDHSASSRQKGIKFYNDFTDEEIDNMILNEIYKSQGNLEKNNIEFNTIQKRLRELSGRNVLTVAFTGSGKTAADYRKTFKRKFFLVPNKISAESFYRKNIFQNKNDLDTRSSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDVDFHLMTATLPKSYKEQMINKGIIFQEESNENVTDKGEIVFIESNKEEEICEGKDVKVSFIKEKEIKSIVEDALENKQKILIIKNTIDSVNRTYEFLKENLSDKYGGVDIDVLHSRFKFKDKKEKYSKILNGEGDIWISTQSVEISLDLDFNIIISDLATMDSLIQRMGRCNRNNKYEYGNFYILPSEDKIYDNKLKSTTKNILKDILKTNSIFTMGIRKTILDDYYDNSVVKKYFEENFISCDKEIKNIYGVNKEIFDGLDLIFNFEPYKNIVDSKKEAAKIFRDVDVSYKIILEEDFYKEDRELQQDSIQVSGFIFNRLYYYGLISKVEGYMVLKSSSKFEYNSTVGLILK

SEQ ID NO: 14777 - protein, 798 aa, Clostridioides difficile
MQKEILAKSYNLRTNQQEQTLVEHIKDLFEVLESILELNLYSDKDVEILKICCALHDLGKINSIMQQKMEINNKISYSCSEEERKKLESDKKSLKKIARHNIFSGAFLKDILEKMNLPEEDKLYIYKSIMLHHGNYEDYMRLSISKVQKEIYDYIEKGILEKEDFNLEDIEDYIKEILDVDFKFNEDVLDYDYIDKLSESMFIDSDYNKGQIDDSVLNYRKFKYILYKGMLNLIDHSASSRQKGIKFYNDFTDEEIDDMILNEIYKSQGNLEKNNIEFNTIQKRLRELSGRNVLTVAFTGSGKTAADYRKTFKRKFFLVPNKISAESFYRKNIFQNKNDLDTRSSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDVDFHLMTATLPKSYKEQMINKGIIFQEESNENVTDKGEIVFIESNKEEEICEGKDVKVSFIKEKEIKSIVEDALENKQKILIIKNTIDSVNRTYEFLKENLSDKYGGVDIDVLHSRFKFKDKKEKYSKILNGEGDIWISTQSVEISLDLDFNIIISDLATMDSLIQRMGRCNRNNKYEYGNFYILPSEDKIYDNKLKNTTKSILKDILKTNSIFTMGIRKTILDDYYDNSVVKKYFEENFISCDKEIKNIYGINKEIFDGLDLIFNFEPYKNIVDSKKEAAKIFRDVDVSYKIILEEDFYKEDRELQQDSIQVSGFIFNRLYYYGLISKVEGYMVLKSSSKFEYNSTVGLILK

SEQ ID NO: 14778 - protein, 773 aa, Clostridioides difficile
MLYAKSNPVETLRKHTDELLKQMNVLRESYGKNINSLDFLEEEIFWQLLDFVIEFHDIGKAFSPFQELIKSRMDTKINEPKIVTHLENNVGHNYLSPAFIDYSYIDRKKNKELRAVLNQVIVYHHERDIFIDKDFKNLIQKILDEDLINKVYELQHEFKVRYPIKTERLSKVYLQSVEKRIDKNHKYYNLYIMLKGILHRLDHSASAHEVVECNNVINIGEQTENYLMKEFGSLREAQSFAKSNRNKNIILIASTGMGKTETALIWIDKDKAFFTLPLRVSINALFDRAKNIVGVGESNDTFLGLLHSTAIDYLEESNQENSSEIVDLAKLLSCKLTFSTIDQIFKFPFLYRGYEKVYSTLAYSKVVIDEIQAYSPEIAAVLVKGIEMIHKIGGRFMIMTATMPTIYIDELKKRGVMNSNLAELTCNTEKIRHCVSIVENSIDENLGKIIQSGMNKKVLVIVNTVKSAVEKYELIEEIVKPKGIDVNLNLLHSMYIQEDRAKLEKYIKEFANSDRNGIWITTQLVEASLDIDFDELHTENSTLDSLFQRFGRCYRSREYEENSPNIFIYTEKATGIGSIYDKDIVEKGLELLKTFINGKECVKMKEKYKVEMVKILYSKESLEGTAFEKRFTSALNILDTITPYSLGSKDAQNILRNIEGYTVIPEDIYNKIEETLIKDYEELGQELINAYSNDDRQLINKIKSKRKKARREIIKKTVNLPIYKAKQNVIDIQVKGLEDLKILLYKYDIYENKHTKQIFGKGVLISNEIDQFI

SEQ ID NO: 14779 - protein, 802 aa, Clostridioides difficile
MKNIMQKEILAKSYNLRTNQQEQTLVEHIKDLFEVLESILELNLYSDKDVEILKICCALHDLGKINSIMQQKMEINNKISYSCSEEERKKLESDKKSLKKIARHNIFSGAFLKDILEKMNLSEEDKLYIYKSIMLHHGNYEDYMRLSISKVQKEIYDYIEKGILEKEDFNLEDIEDYIKEILDVDFKFNEDVLDYDYIDKLSESMFIDSDYNNGQIDDSVLNYRKFKYILYKGMLNLIDHSASSRQKGIKFYNDFTDEEIDNMILNEIYKSQGNLEKNNIEFNTIQKRLRELSGRNVLTVAFTGSGKTAADYRKTFKRKFFLVPNKISAESFYRKNIFQNKNDLDTRSSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDVDFHLMTATLPKSYKEQMINKGIIFQEESNENVTDKGEIVFIESNKEEEICEGKDVKVSFIKEKEIKSIVEDALENKQKILIIKNTIDSVNRTYEFLKENLSDKYGGVDIDVLHSRFKFKDKKEKYSKILNGEGDIWISTQSVEISLDLDFNIIISDLATMDSLIQRMGRCNRNNKYEYGNFYILPSEDKIYDNKLKNTTKNILKDILKTNSIFTMGIRKTILDDYYDNSVVKKYFEENFISCDKEIKNIYGINKEIFDGLDLIFNFEPYKNIVDSKKEAAKIFRDVDVSYKIILEEDFYKEDRELQQDSIQVSGFIFNRLYYYGLISKVEGYMVLKSSSKFEYNSTVGLILK

SEQ ID NO: 14780 - protein, 802 aa, Clostridioides difficile
MKNIMQKEILAKSYNLRTNQQEQTLVEHIKDLFEVLESILELNLYSDKDVEILKICCALHDLGKINSIMQQKMEINNKISYSCSEEERKKLESDKKSLKKIARHNIFSGAFLKDILEKMNLSEEDKLYIYKSIMLHHGNYEDYMRLSISKVQEEIYEYIEKGILEKEEFNLKDIESYINSILNVDFKFGEDVLDYDYIDKLSESMFIDSDYNNGQIDDSVLNYRKFKYILYKGMLNLIDHSASSRQKGIKFYNDFTDEEIDNMILNEIYKSQGNLEKNNIEFNTIQKRLRELSGRNVLTVAFTGLGKTAADYRKTFKRKFFLVPNKISAESFYRKNIFQNKNDLDTRSSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDVDFHLMTATLPKSYKEQMINKGIIFQEESNENVTDKGEIVFIESNKEEEICEGKDVKVSFIKEKEIKSIVEDALENKQKILIIKNTIDSVNRTYEFLKENLSDKYGGVDIDVLHSRFKFKDKKEKYSKILNGEGDIWISTQSVEISLDLDFNIIISDLATMDSLIQRMGRCNRNNKYEYGNFYILPSEDKIYDNKLKNTTKNILKDILKTNSIFTMGIRKTILDDYYDNSVVKKYFEENFISCDKEIKNIYGINKEIFDGLDLIFNFEPYKNIVDSKKEAAKIFRDVDVSYKIILEEDFYKEDRELQQDSIQVSGFIFNRLYYYGLISKVEGYMVLKSSSKFEYNSTVGLILK

SEQ ID NO: 14781 - protein, 802 aa, Clostridioides difficile
MKNIMQKEILAKSYNLRTNQQEQTLVEHIKDLFEVLESILELNLYSDKDVEILKICCALHDLGKINSIMQQKMEINNKISYSCSEEERKKLESDKKSLKKIARHNIFSGAFLKDILEKMNLLEEDKLYIYKSIMLHHGNYEDYMRLSTSKVQEEIYDYIEKGILEKEEFNLKDIESYINDILNVDFKFGEDVLDYDYIDKLSESMFIDSDYNNGQIDDSVLNYRKFKYILYKGMLNLIDHSASSRQKGIKFYNDFTDEEIDDMILNEIYKSQGNLEKNNIEFNTIQKRLRELSGRNVLTVAFTGSGKTAADYRKTFKRKFFLVPNKISAESFYRKNIFQNKNDLDTRSSNDYIGLLHGDINLYSENEDNGEHDFVLTLRDIDLSINFCKPCVIATVDQLLLSMFKFPGYEKIFAAVKNASITVDEVHLLEPKMFLILIYFMQFACKYLDVDFHLMTATLPKSYKEQIINKGIIFQEESNENVTDKGEIVFIESNKEEEICEGKDVKVSFIKEKEIKSIVEGALENKQKILIIKNTIDSVNRTYEFLKENLSDKYGGVDIDVLHSRFKFKDKKEKYSKILNGEGDIWISTQSVEISLDLDFNIIISDLATMDSLIQRMGRCNRNNKYEYGNFYILPSEDKIYDNKLKNTTKNILKDILKTNSIFTMGIRKTILDDYYDNSVVKNYFEENFISCDKEIKNIYGINKEIFDGLDLIFNFEPYKNIVDSKKEAAKIFRDVDVSYKIILEEDFYKEDRELQQDSIQVSGFIFNRLYYYGLISKVEGYMVLKSSSKFEYNSTVGLILK

SEQ ID NO: 14782 - protein, 660 aa, Clostridioides difficile
MNSLDKYKAKSDGISIDKHNEDMNYIMNQLVCIYNISDDMRNDLHEAIVCHDVGKVVKSFQDNIENTIRMVRHELLSASIKHLKRGQKLAILTHHKDIKFLEGQITNSIYEIELNELKEILDVEVEDIRPFIKEISRARNDDTRKLENILLKGYLQYCDHIASAGIKSIDKGFNSIKDFSLPKGVSYNSIQEKVLNMDKNEDIMIMAMTGLGKTATSLYWSDIAQNEGKSKRIYYILPYTASINSLYENLHNRNISVSMLHSKAPYFLNKISDEEDIKQLYQIYKKSVKQINVCTIFQLVKSIFSCKRFEMLLSQLKDSIFIVDEIHCFDTRVLCYTLEFLKYLKENLNIQICIMSASIPTCLKKLIQERLKISTIIEPDKNDLINRHKLNRINKSILDGLDKIENDMIQGKRVLICVNSVNLAQELYRKLQSYNPKLIHGRFNTRDREQAEEGIDKSFLLIGTQSIEVSLDISYDVLYTELAPFDSLLQRFGRVNRKGEKKELSNVYIYNYDMNLNIYDSDIVNRTDTIISEIIHKDNSIVNESKVSFYLDNVYLDIDMDKYNKHKTTLEIIIRNMRVGIWNKSASIDMLNNDSISVIPESLIDEYKLFLNQKMYLEASSLFVNVSVKRYNSNRNMFYEDNDVIVTRYSYDNKLGLEFD

SEQ ID NO: 14783 - protein, 647 aa, Clostridioides difficile
MLYAKSNPVETLREHTDELLKQMNVLRESYGKNINSLDFLEEEIFWQLLDFVIEFHDIGKAFSPFQELIKSRMDTKINEPKIVTHLENNVGHNYLSPAFIDYSYIDRKKNKELRAVLNQVIVYHHERDIFIDKDFKNLIQKILDEDLINKVYELQHEFKVRYPIKTERLSKVYLQSVEKRIDKNHKYYNLYIMLKGILHRLDHSASAHEVVECNNVINIGEQTENYLMKEFGSLREAQSFAKSNRNKNIILIASTGMGKTETALIWIDKDKAFFTLPLRVSINALFDRAKNIVGVGESNDTFLGLLHSTAIDYLEESNQENSSEIVDLAKLLSCKLTFSTIDQIFKFPFLYRGYEKVYSTLAYSKVVIDEIQAYSPEIAAVLVKGIEMIHKIGGRFMIMTATMPTIYIDELKKRGVMNSNLAELTCNTEKIRHCVSIVENSIDENLGKIIQSGMNKKVLVIVNTVKSAVEKYELIEEIVKPKGIDVNLNLLHSMYIQEDRAKLEKYIKEFANSDRNGIWITTQLVEASLDIDFDELHTENSTLDSLFQRFGRCYRSREYEENSPNIFIYTEKATGIGSIYDKDIVEKGLELLKTFINGKECVKMKEKYKVEMVKILYSKEISLLILQFNSSKIGLSSRLLPLFKLRR

SEQ ID NO: 14784 - protein, 682 aa, Gallibacterium anatis; identical to SEQ ID NO: 13181

SEQ ID NO: 14785 - protein, 990 aa, Actinomyces graevenitzii; identical to SEQ ID NO: 13184

SEQ ID NO: 14786 - protein, 939 aa, Actinomyces sp. oral taxon 172; identical to SEQ ID NO: 13185

SEQ ID NO: 14787 - protein, 763 aa, Aggregatibacter sp. oral taxon 458; identical to SEQ ID NO: 13187

SEQ ID NO: 14788 - protein, 823 aa, Aggregatibacter sp. oral taxon 458; identical to SEQ ID NO: 13186

SEQ ID NO: 14789 - protein, 695 aa, Aneurinibacillus aneurinilyticus; identical to SEQ ID NO: 13190

SEQ ID NO: 14790 - protein, 802 aa, Atopobium sp. oral taxon 810; identical to SEQ ID NO: 13189

SEQ ID NO: 14791 - protein, 801 aa, Clostridium sp. KLE 1755; identical to SEQ ID NO: 13191

SEQ ID NO: 14792 - protein, 774 aa, Clostridium  symbiosum; identical to SEQ ID NO: 13192

SEQ ID NO: 14793 - protein, 718 aa, Clostridiales bacterium oral taxon 876; identical to SEQ ID NO: 13193

SEQ ID NO: 14794 - protein, 818 aa, Clostridiales; identical to SEQ ID NO: 13194

SEQ ID NO: 14795 - protein, 706 aa, Porphyromonas gingivalis; identical to SEQ ID NO: 13202

SEQ ID NO: 14796 - protein, 706 aa, Porphyromonas gingivalis; identical to SEQ ID NO: 13200

SEQ ID NO: 14797 - protein, 710 aa, Porphyromonas gingivalis; identical to SEQ ID NO: 13201

SEQ ID NO: 14798 - protein, 776 aa, Porphyromonas sp. oral taxon 278; identical to SEQ ID NO: 13203

SEQ ID NO: 14799 - protein, 927 aa, Streptococcus sobrinus; identical to SEQ ID NO: 13204

SEQ ID NO: 14800 - protein, 932 aa, Peptostreptococcaceae bacterium oral taxon 113; identical to SEQ ID NO: 13206

SEQ ID NO: 14801 - protein, 706 aa, Porphyromonas gingivalis; identical to SEQ ID NO: 13205

SEQ ID NO: 14802 - protein, 767 aa, Porphyromonas gingivalis; identical to SEQ ID NO: 13207

SEQ ID NO: 14803 - protein, 825 aa, Selenomonas sp. oral taxon 892; identical to SEQ ID NO: 13208

SEQ ID NO: 14804 - protein, 766 aa, Treponema lecithinolyticum; identical to SEQ ID NO: 13210

SEQ ID NO: 14805 - protein, 716 aa, Oscillibacter; identical to SEQ ID NO: 13213

SEQ ID NO: 14806 - protein, 749 aa, Desulfovibrio gigas
MSMPSAFEQLDRRLQRWIWRQGWPGLRPVQEEAVAAILPADADVLIAAATAGGKTEAAFLPVLSAVAGRGDHDGNPGGGPGIQVLALSPLKALINDQHRRLEELAEVVGMRCHRWHGDVPGARKSALLKHPEGILYITPESLEALFVRHGTGLRRLFGALAFVVVDELHAFIGSVRGKQLQSLLHRVERVAGRTIPRVALSATLGDMQLAATFLRPDGALPCRLLEAAGGERTLLLQLKGVEVRAPRLDNLSREEKAKARDEAENEAVTNIARHLYATLRGTHNMVFANAKRDVEALADALRMESLAARVPNEFFPHHGSLSKEFREDAEARLRDKQRPATAVCTNTLELGIDVGSVTGIVQMECPPSVAALRQRLGRSGRRQGEPSILRAFCREEAITSTSTLRDRLRGGLVQACAMLELLLQHWYEPPDLERLHLSTLVQQLLSAIAQHGGLTAMAAWKLLCAEGPFHQLTQGQFVSLLRALGEQEILAQAGDGALLPGAFGEKLINHYTFYAAFSTPEEYRLEHNGKTVGMLPVISVVRPNDFLIFAGRRWLVLDVDAERKVISLKRASSGRAPAFLGDGFIIHDRVVETIRLCYGMPEPPRYLDATGRHLFLQGQATFQDLGLVSQQVVVQPSGVTLFPWAGTLALQTLRMLLQDQGLKVEELRIALDVLAPPEAVREALAHLAAQTTVDPIALAAGVPLKAREKYDAFLGEALLNVEFASRALRIPKALALARTLADDTGWAKH

SEQ ID NO: 14807 - protein, 839 aa, Lactobacillus fermentum
LGKATPVFQSNKKSYNGDQDLDDQLMEQLIQVGFDHLGDLILASPRESPHALAGEALLEQFGIDKTVGAIIGGHHGKPQSKVPRTEIDDHTKNYWQVDNLVKAREGNWLKVQRELFSFCLQECGYQSVADVPANLTQPQAILLEGLLIMADWLASTEYLGDDRSKPLFPLIPLHNSMEDLDLGARFQRAILTWWVEDQWFPEQITDIDEQFQKRWGFKPRPVQRQMDQVIQDATDLGIIIIELEPGAGKTEIALEAVEQLAYTNGEQGLFFGLPTQATSNAMFDRVTDWLAKVAKDDDAKLGIKLMHSKAEFNPTYADLKIPQAHNVEGEGSVTVNSWFSGKKSILEEFSIGTIDHLLLMGLKQKHLFLRHLGMSGKVVVIDEVHAYDAYMDSYLTKALEWLGAYHVPVIALSATLPIATRSALIEAYCKGKYGKKKVEGAPSWDKNQAYPLISMLDGKRLVQKSDFTRNTKGHAIAIERLTVEDIDLIKAVLEAVEDGGVAGVIVNTVKRAQMIASQIPKGIPKLILHSAFLAPDRAEIETKLQGLIGKYGKRPKKMIIIGTQVLEQSLDIDFDIMFTDIAPMDLLIQRIGRLHRHDIQRPSKLVTPQVKIMGINDYGDYGSANEAIYSKYLLMKTDQYLPEQLTIPDDISPLVQATYRDDGEMEPDLREAKRVFDVKHKEELDKAEKFQIKSPKQRKSLHGWLDSELVDANKDEVRAQAAVRDIQETLEVLMVKQVKGDYYLLDGQQLEEVDSKTIAQQLIRIPAAVTPRIDKSIELLETQTAKSFPDWQADPWLKGALVVVLDEQNSVELGNWRIHYSRKFGLSYEKADDDEKQAF

SEQ ID NO: 14808 - protein, 713 aa, Escherichia coli; identical to SEQ ID NO: 13178

SEQ ID NO: 14809 - protein, 699 aa, Prevotella salivae; identical to SEQ ID NO: 13211

SEQ ID NO: 14810 - protein, 925 aa, Crocosphaera watsonii; identical to SEQ ID NO: 12221

SEQ ID NO: 14811 - protein, 731 aa, Firmicutes bacterium CAG:555; identical to SEQ ID NO: 12233

SEQ ID NO: 14812 - protein, 898 aa, Clostridium; identical to SEQ ID NO: 12235

SEQ ID NO: 14813 - protein, 722 aa, Clostridium chauvoei; identical to SEQ ID NO: 12291

SEQ ID NO: 14814 - protein, 735 aa, Firmicutes bacterium CAG:124; identical to SEQ ID NO: 12236

SEQ ID NO: 14815 - protein, 776 aa, Brachyspira aalborgi; identical to SEQ ID NO: 12238

SEQ ID NO: 14816 - protein, 896 aa, Culturomica massiliensis; identical to SEQ ID NO: 12239

SEQ ID NO: 14817 - protein, 712 aa, Firmicutes bacterium CAG:646; identical to SEQ ID NO: 12240

SEQ ID NO: 14818 - protein, 1247 aa, Clostridium hathewayi CAG:224; identical to SEQ ID NO: 12241

SEQ ID NO: 14819 - protein, 808 aa, Clostridium hathewayi CAG:224; identical to SEQ ID NO: 12242

SEQ ID NO: 14820 - protein, 725 aa, Roseburia sp. CAG:18; identical to SEQ ID NO: 12243

SEQ ID NO: 14821 - protein, 896 aa, Odoribacter laneus CAG:561; identical to SEQ ID NO: 12244

SEQ ID NO: 14822 - protein, 743 aa, Firmicutes bacterium CAG:631
MKSIFEKYAPFIQDFIYQSQWESLRAIQVAAGEAIFNTDEHVLLLGSTASGKTEAAFFPILSLFYQKMPQSIGAIYIGPLKALINDQFMRLTELCEQAHIPVWHWHGDVSYAHKQKMIQNPSGILQITPESLEALLLHKHGMITKLFSDLQFIVIDEVHSLLRNDRGGQTLCLIERLSKIAKVEPRRIGLSATLGNPKEVGELLSLGTNKRTLIPQIVASPVKWRLSLQHFYVQNETLSDEEKAKGLPCLDQKSDQAPAFADPGLGYIFEHTKGKKCLVFTNSREECEMVTSTLRHYCEVQHEPDRFLIHHGNLSASYRETAEEIMKDETQFQTTVTTATLELGIDIGRLQRAFQIDAPAMVSSFLQRMGRTGRRNLPPEMWFVIREELPTTREMLPATIPWKLIQAIALIQLYIEEKWIEPLRVSSHPYSLLYHQTMSILASNGELTPSFLASKVLSLAYFRFVSLEDYQDLLRHLVQIDHIQKTENGGLIIGLAGERIIHSFKFYAVFQENEEYVVRCHSQELGSIVKPPPVGDKIALAGKVWTVEEIDYKKHVIYCEEAKGQVPAYFGLCPGDIHTKVLEKMYQILNEKTIYPYLMNQAIVRLNEGRKIASSASLMEDPLICLGGDMYALFPWLGTYSFLALERFLKIKCASRLGLKKMDVSRPYFMQFTMKVSFQEFYEILLDESKKPIEPLDLVYPKEVPLFEKYDEYVPVNLIKKGFAYGVLDIQGMLKRIQNWKKR

SEQ ID NO: 14823 - protein, 318 aa, Firmicutes bacterium CAG:631; identical to SEQ ID NO: 12245

SEQ ID NO: 14824 - protein, 752 aa, Fusobacterium sp. CAG:649; identical to SEQ ID NO: 12246

SEQ ID NO: 14825 - protein, 757 aa, Clostridium bartlettii CAG:1329; identical to SEQ ID NO: 12247

SEQ ID NO: 14826 - protein, 682 aa, Clostridium bartlettii CAG:1329; identical to SEQ ID NO: 12248

SEQ ID NO: 14827 - protein, 713 aa, Prevotella sp. CAG:5226; identical to SEQ ID NO: 12249

SEQ ID NO: 14828 - protein, 712 aa, Clostridium sp. CAG:138; identical to SEQ ID NO: 12250

SEQ ID NO: 14829 - protein, 725 aa, Faecalicatena fissicatena; identical to SEQ ID NO: 12251

SEQ ID NO: 14830 - protein, 736 aa, Ruminococcus sp. CAG:579; identical to SEQ ID NO: 12252

SEQ ID NO: 14831 - protein, 787 aa, Ruminococcus sp. CAG:563; identical to SEQ ID NO: 12253

SEQ ID NO: 14832 - protein, 896 aa, Odoribacter splanchnicus CAG:14; identical to SEQ ID NO: 12254

SEQ ID NO: 14833 - protein, 770 aa, Clostridium sp. CAG:221; identical to SEQ ID NO: 12255

SEQ ID NO: 14834 - protein, 729 aa, Oscillibacter sp. CAG:241; identical to SEQ ID NO: 12256

SEQ ID NO: 14835 - protein, 725 aa, Oscillibacter sp. CAG:241; identical to SEQ ID NO: 12257

SEQ ID NO: 14836 - protein, 686 aa, Megamonas funiformis CAG:377; identical to SEQ ID NO: 12258

SEQ ID NO: 14837 - protein, 714 aa, Firmicutes bacterium CAG:41; identical to SEQ ID NO: 12259

SEQ ID NO: 14838 - protein, 757 aa, Bacteroides sp. CAG:443; identical to SEQ ID NO: 12260

SEQ ID NO: 14839 - protein, 784 aa, Clostridium sp. CAG:413; identical to SEQ ID NO: 12261

SEQ ID NO: 14840 - protein, 720 aa, Eubacterium sp. CAG:274; identical to SEQ ID NO: 12262

SEQ ID NO: 14841 - protein, 768 aa, Faecalibacterium sp. CAG:82; identical to SEQ ID NO: 12263

SEQ ID NO: 14842 - protein, 792 aa, Clostridium sp. CAG:352; identical to SEQ ID NO: 12265

SEQ ID NO: 14843 - protein, 884 aa, Eubacterium siraeum CAG:80; identical to SEQ ID NO: 12266

SEQ ID NO: 14844 - protein, 808 aa, Clostridium sp. CAG:58; identical to SEQ ID NO: 12267

SEQ ID NO: 14845 - protein, 649 aa, Clostridium sp. CAG:448
MAMAGFFKAVSDRDCIDRLFASAVGEISSKIRLIDTVSKYPDESCFYLSLLTRLITSALIDADRTDTSLFMSPDEHGERRTLTPEILKAVTESCNSRLSGFACVTPIQAARHELSALCFRAASKPGGVFRLNLPTGAGKTLSGLRYALRHAEVFGKERIFFISPLLSILEQNAREIRNAVGDDSLVLEHHSDIMTDGLSDGELNRYELLCDSWDSPIVITTFVQFLNTLFSGKTACIRRFHSLANSVIVIDEVQTVPLKMLSLFDSAVNFLCAVCNTTVVLCSATQPELAGIFHPLVGCEDLIAPESVKKYAAVFKRNAITYKGKKRLAEIPSLISELLGQYSSVLVICNKKDQASTLFDLTEGVCDNRYHLSAGMCTAHRKNVLSEMTASLNTKQEKPLLCISTQVIEAGVDISFEAVIRLCAGLDSIVQAAGRCNRNGERNSDAPVWIVDCCDENLSVLKDIYDAKDATESLIYAFEREADRFDFDLSSDKSVKFFYERLYQSKSKDFFDFVNKGYPSIYSMLSQNVGYTGKEGERFFLHQAFKTAGSLFEVFDQAQTSILVQWGDGEKIAQKLISSGERVSKALYDAAKPYTVPVFSYQRERLSECAAITAVGDGRILILSKDYYSHNTGMIIPKKGEEICDTLIW

SEQ ID NO: 14846 - protein, 535 aa, Ruminococcus sp. CAG:57; identical to SEQ ID NO: 12268

SEQ ID NO: 14847 - protein, 733 aa, Clostridium sp. CAG:964; identical to SEQ ID NO: 12269

SEQ ID NO: 14848 - protein, 804 aa, Firmicutes bacterium CAG:227; identical to SEQ ID NO: 12271

SEQ ID NO: 14849 - protein, 730 aa, Clostridium sp. CAG:356; identical to SEQ ID NO: 12272

SEQ ID NO: 14850 - protein, 724 aa, Ruminococcus sp. CAG:379; identical to SEQ ID NO: 12273

SEQ ID NO: 14851 - protein, 708 aa, Bacteroides pectinophilus CAG:437; identical to SEQ ID NO: 12274

SEQ ID NO: 14852 - protein, 548 aa, Eggerthella sp. CAG:298; identical to SEQ ID NO: 12275

SEQ ID NO: 14853 - protein, 926 aa, Clostridium sp. CAG:62; identical to SEQ ID NO: 12276

SEQ ID NO: 14854 - protein, 817 aa, Roseburia sp. CAG:471; identical to SEQ ID NO: 12278

SEQ ID NO: 14855 - protein, 741 aa, Anaerotruncus sp. CAG:390; identical to SEQ ID NO: 12279

SEQ ID NO: 14856 - protein, 801 aa, Ruminococcus sp. CAG:330
MEIAAHIRETDGREQSVAEHAKGVATLAERYGAVVSLSNFGKLLGLFHDAGKLNADFNRYIHGVGNFRRGEIDHCYAGAKYLCTFSDENFPKRKNPSRLAARVILSHHGLHDWLTEEGEDYFTRRTGKTERYGEISENLPDMLAELGNTTESLKDLMQCVIAEYTAVVEKIKAILPPKGQDGKPDSHAFETKCFYFGMLERLLESVLMDADRVDTADFMHNCQTEQHFDTEPLWEQMAQNLEKKLAQFADRTDPVSKQRQDISERCFRFADRAAEPVGACRLIVPTGGGKTLSSLRFAIHECRKFKMEKIVYVAPFMSILEQNSKDIREIAGAENFLEHHSNVLAQKKSAEELQAYELRTEKWDVPVLATTMVQFLQALFDGKNTSVRRMHRLCRSVIILDEVQSIPMKCTHLLNLAVNFLTKICGCTVVLCSATQPLLENSEYPMLLDENSSMTGAYQKDFEVLRRTELIPVSGTFSYDAAAEFCWEKFLEHQSLLVVVNTKASAQELFQRLQMEQEQSGQPMQLIHLSTHMCPAHRNKVIEQMRKALKQHRPILCVTTQLIEAGVDVSFGCVVRSMAGLSNAAQAAGRCNRNGELKQLAPVYLLELSEEKLGSLAEISLAQSVTRTILDSGNFADLLSVEAMFAYFRKLHHDFEKDHKLSYPVGKHGEVTLLELLSTDRSRVRKPYPCSKYALQAFATAGAAFQVIDDTAETVIVPYDDSAEEMILRLNGDISFAEMHQLLRQVQQYTISVYAGERKKLEESGGLYPLRCGALALEKRFYDTAALGLQIEGGTHEFLGL

SEQ ID NO: 14857 - protein, 378 aa, Catenibacterium sp. CAG:290
MKCPVCGNEDENYISYINKRPYCRKCIAFGRTYLDEVYPIHKTPLIMTDASYHLSFRLSSRQQFISDQLITNYENATNSIVLAVCGSGKTEISYAIIKHVIENGGRVCFTIPRRQLCIELHERIQKDFPHLTIGLLYGGYQENSNAPLIICTTHQLYRFVSSPFDLIIMDEADAFPFYGDDVLNSIFYHASKRYIKLSATLLEEDIHDECVMIMNRRYHGHDLPVPHIYIIPQFLWLISLKYWIKKLLETHQKVLVYVPRKSDAQYYADLLKDTYKVQGVSSESPYLNEYTKDFKEGLLEVLITTTILERGITIEDVQVIVLEAGDRIFDERTLIQIAGRVGRKIGYEDGRILLIDNHYSKAMKGCIKTIQKLNRMSV

SEQ ID NO: 14858 - protein, 854 aa, Eubacterium sp. CAG:38; identical to SEQ ID NO: 12280

SEQ ID NO: 14859 - protein, 882 aa, Sutterella sp. CAG:351; identical to SEQ ID NO: 12282

SEQ ID NO: 14860 - protein, 748 aa, Faecalibacterium sp. CAG:74; identical to SEQ ID NO: 12281

SEQ ID NO: 14861 - protein, 741 aa, Ruminococcus sp. CAG:353; identical to SEQ ID NO: 12283

SEQ ID NO: 14862 - protein, 728 aa, Clostridium sp. CAG:273; identical to SEQ ID NO: 12284

SEQ ID NO: 14863 - protein, 730 aa, Clostridium sp. CAG:389; identical to SEQ ID NO: 12285

SEQ ID NO: 14864 - protein, 749 aa, Acidaminococcus fermentans; identical to SEQ ID NO: 12286

SEQ ID NO: 14865 - protein, 751 aa, Ruminococcus sp. CAG:624; identical to SEQ ID NO: 12287

SEQ ID NO: 14866 - protein, 734 aa, Megasphaera elsdenii CAG:570; identical to SEQ ID NO: 12288

SEQ ID NO: 14867 - protein, 736 aa, Eubacterium sp. CAG:76; identical to SEQ ID NO: 12289

SEQ ID NO: 14868 - protein, 803 aa, Bacteroides sp. CAG:98; identical to SEQ ID NO: 12290

SEQ ID NO: 14869 - protein, 798 aa, Lactobacillus shenzhenensis; identical to SEQ ID NO: 13216

SEQ ID NO: 14870 - protein, 777 aa, Caldanaerobacter subterraneus; identical to SEQ ID NO: 13222

SEQ ID NO: 14871 - protein, 748 aa, Chitinivibrio alkaliphilus; identical to SEQ ID NO: 13224

SEQ ID NO: 14872 - protein, 745 aa, Aquaspirillum serpens
MKPFFAHSGSDKNKTDWQLLHEHLQSVGQLAAERAAPFGGQQLAQIAGLLHDIGKYTDEFQRRINGDLIRVDHSTRGAMLAVERYGPVVGRLLAYGIAGHHAGLANGRDLGKRSTLEERLKGKDLPVLVDQWQEEISLPDKSQLKFPPVNPRKERVVFQQAFLARMLFSCLVDADFLDTEAFYNRIEHRSSLRSHQPPALTELRAALDDYLAGFRADSSVNRIRADILAHVRQQAECPPGLFSLTVPTGGGKTLASLAFALDHAIRHGLRRIIYVIPFTSIVEQNAAVFQQALGQFGEQAVLEHHSAFNDDRSKDRQARDKLRLAMENWDFPIIVTTAVQFFESLFADRPSRCRKLHNIAGSVIILDEAQTLPLKLLRPCMTVIDELALNYRCSPVLCTATQPALQAPQFKGGLQGVRELAPNPPQLFQQLARVQIRQVGILSDEALQQQMAAREQVLCIVNNRRHARALYESIAGLEGARHLTTLMCARHRSEVLAEVRQRLRDGLPCRLVATSLIEAGVDVDFPCVLRAEAGLDSIAQAAGRCNREGKRALEASEVLVFQTENPDWKAPQELQQFAQAAREVLRNTCGDPLAPEAITRYFQQLYWQKGERELDKADLLAQIESQRLEGIPFEMLADKFRMIDSVQCPVIIPFDEMANAVLKDIRSPKDGGELPLVLARQLQSYIVQLPRQGYEALLKVGAIQPVAPERYGEQFMVLDSIDIYHNQCGLSWDNPTFKCNESTCW

SEQ ID NO: 14873 - protein, 769 aa, Desulfovibrio sp. Dsv1
MLYAHSLPDQEVSHWQSLEDHLRKSAQLAEAFGRVFGAGEWAALATRLHDLGKASPEFQTYISGQNGRRRIDHSTAGARLLLRRWKAWGKPGKYRALWLAYCIAGHHGGLPDLGDGASDTGSLRSRLDPAYVIPDYSAGLDLAALADIPQPDALRFPFRLAREHAAFSVSFFVRMLFSCLTDADFLDTEHFYAPENCRQRGRWPSLETLRKRLCDFLSAKGFLRATPDDSPIVAARKEILGHCLDAAALPPGAFTLTVPTGGGKTLSSLTFALEHARRHQLDRIILVAPYTSIIEQNARVLRDALGEDSVLEHHSSYVHPSEQTDQAGESAADQGRAVLPFRLAAENWDAPVVVTTAVQFFESLFSSRPSRCRKLHNMARSVVILDEAQMLPVPLLEPSVLALRELTEHYGASLVLCTATQPALRRDGPLKNGFARDSLRELIPIPQVAELFSTFTAQRRMCVSLLGKLGNEELGRRLRQEHQALCIVNSRAQARAAYERLGNDDAHFHLSARMTPRHRMFVLDTVRQRLRRGLPCRVVSTSLIECGVDISFPCVYRAQCGLDSVAQAAGRCNRSGELSSGSLSVYTPEQPLSPAQTDLYLRACFFGQVAEKHADIFAPAAVEDYFNALYGFEDLDKERLLAMLREKNAAFPHAFDFRWMDTRYHFIKEGMAPVIITHGTKDGGDLAEQSHALVHRLETEYPPSRLTLRLLQGFSVQVYPYELERLRAAGTLETLHGCFDVLRNGAGYNPKLGLLVDDPTRQAPEDCLR

SEQ ID NO: 14874 - protein, 831 aa, Desulfovibrio desulfuricans
MSNLPDCCVAHVYCPENGAPVRIQPLSEHLRNVAALTSSAAAKVGLPLTGHLVGLLHDFGKYSKEFQNYILSAAGCITPGEPGYTDPITCKGKINHAFAGGQLLWKGLQGNDTKKAIARMIALCILSHHSGLKDCITPDGKDAFTQNYMARPEEKTHREQCVERCDQAFLEEIENEISNALLSEVRAVLMKLRDRVMSKQPASADINDQRDCANSRDFQLGLLARFLFSCLIDADRTDSADFEDRKGAKIRRSVVRRPWNVLVPRFEAALAQKTPQHAIDHIRGDISAHCAQRAQDAPGMFTLTVPTGGGKTLASLRFALLHAQKHQMDRIIYVIPYTSIIDQNAAVARKILEQGEAPGSIVLEHHSNFFPDEDSDAEEVVSRWEKLSENWDAPVVFTTMVQFLESLFGAGTSSARRMHNLARSVIVFDEVQTVPVRCLRMFCNAVDFLTGQCGSTAVLCTATQPRLGNLPRPLSGSFDIKPDMEIVPDVPALFTCLKRTVFFDHCHTGMSAENVAALAQEEQQTHGSCLVVCNTKRTAENIYALCAEHEGVNRYYLSTNLCPAHRMEKLEAMRADLKKGRPVLCVSTQLIECGVDISFRSVIRMAAGLDSILQAAGRCNRHGEKEPGRVHIVLVEADAENLAWLKDIKDGRDIFLDTVRIKYEQELLESGYDFTMPQLVATYFDHYFYRKGAALSYAAGDCNSLLDMLGSNQFAVINNPFPTLGQSFSTAAKIFKSIDSTSKSILVPYKDGGGIIAALCSTDLLYKKYELLRKAQRFSVNIFPHTERELIQKNALYPIQDSGMFALRPNFYCNDQGVSAQSGQKLSFCNY

SEQ ID NO: 14875 - protein, 897 aa, Desulfovibrio longus
MSNKTSDHSTLFWGKTVAGEGYHHLACHCLDVAAVTHVLLDMDSLFRARLMHLSSMDEAGTLALLRFFASVHDLGKFSLPFQNMVPELARRLGIPEWRAEGGPHHTELGMGLWSEVAPQVRIMLRAENKRCLSPLAAAAFGHHGEPVSACSNVKRFFKGTECEAQAFVKDMADLFLGGVSLDGVGENGLCRLSWLAAGLFVLSDWVGSNSEWFEARAEVGDVSEYWGYAVDRARIAVAETGVLSASPSGRLSFHEYFPGLPDDASPHPLQRYVLDLPDPDGPELLILEDQTGGGKTEAAILAAHRHMRAGTSAGVFVGLPTMATSNAMYARLAQSYRRLFADEKASLVLAHGGRALKEDYLESIGLEAIRPASVGGEGGFWEGGAACSAWIADNRKKALLAPCGVGTLDQALLGVLPSRHQCLRLLGLSRSTLVADEIHSYDEYTGTLACSLLSFHAALGGSVVLLSATMTRELREKLVRAWVRGRELAGGTTLPEMTVRETAFPLATRVMDTCLTETPVAASRRLDVAVTPVSDEDAMFAALADAHRAGACACWVRNTVGDALAARRRLVEEYGVPAGDALLFHARFAGCDRQEIESQVLATFGKESRPEERGGKILISTQVVEQSLDLDFDVLLSDLAPMELLIQRAGRCHRHQARTGRPEGYRSARMLVLMPEPVEDADAEWYGRVFPSGRYVYPRPDVLWRTARLLADRGRLLLPEDARALVEGAYAGDVPEALLDEALQELGKEYADKAFAENNRLRFEAGYHRRSSGTVWDRDQKTPTRLGQTTRQVRLVRVREGQLALWGAARPDDASMRACLRSEVRLSAYKLAEMVVPPELQTALDVLTERMPDKGRWSLLVPLVEREPGRWFGAGRNEKGQVVEVRYVEGEGAEIDG

SEQ ID NO: 14876 - protein, 742 aa, Sandarakinorhabdus limnophila
MAHVMGAMHDIGKCSAAYQAYIRQPVGAGAARGPDHSTAGAKEVVQLFGNGPIGRLMAYGIAAHHGGLMDGADLSGRLDKQVEDYTGWQEEAGSLPLLAQLLSMPIGRGVNGIDRSFSLAFLGRMAFSCLVDADFLETERFYAEAHGSEPPRRGGVIMAQHRDTLRAFLKDHRRVDTELNRLRSAILDHANAKAALSPGLFTLTVPTGGGKTLTSLSFALEHAAAHGLRRVVYVIPFTSIIEQTAAVFRDKVGLGAGAVLEHHSSFDWDQNPPSTGNDTEAEGVQGLAKLRRDAENWDAPVVVTTAVQFFESLFAARPSRCRKLHNLAKSVIVLDEVQSIPVHLLRPCMAAMDELAKNYGATVILCTATQPALRRDDKALPQSEQMKRTGEREGLDIPPERELALEPVELYQKLKRVRVEWLRQPIDDDVIVARFAEQRQMLCIVNSRAHARELFAKLRAEGFEGCRHLTTLMCALHRREVLAKVREDLAAGRPVRLVSTSLIEAGVDVDFPEVWRAAAGLASIAQAAGRCNREGRQAGLGRVVVFETAGRKTPPTIEAFYGPAREVMRRDIDDVLGLDAIRDYHEALYWQQGYEALDAARLPEGEKFAVVPALRHTARTADFPYARIASAFRLIDETMDPVIIPYDDIARDAVRALTFSPVPPAGVQRRLQQYVVSVPPHVRDALLANGQAQVIRPADYGDRFIVLLEGHPGTVPTTYDPDIGLKMDDFSSIRSPENNIFC

SEQ ID NO: 14877 - protein, 732 aa, Lachnospiraceae bacterium 10-1
MHIKRQDKTMIAHINNLGEKQSVKDHLEGTAELAKMFAEEFDCGEIAYYCGILHDIGKCSDEFQKRICDPEHVKKVDHSTAGALEAMKEGNIPVAMAAAGHHSGLMDGGNYNLSMEGDGTFFGRIKKQVPNYSKWKEDITFKNVPLPLFCSKGTKFTMSFFIRMLYSCLVDADYLDTERFMNGGKENRGNYSSINRICSSFDNYINGWLHKTDFTCKDQEELCKRRNFILKNCLEKGKKLNRGLYTLTVPTGGGKTTASLGFALKHMKNNDMRRVIYVIPYTSIIDQNAEVFRDILGDENVLEHHSGISYERTEDQAENFDTYQKALATENWDMPVIVTTAVQFFESLFASKSSKCRKLHNIANSVIIFDEAQTLPMPYLEPCIAAISELVQNYKSTVILCTATQPALDGIFRKYGFHGEIQEICDSVEELYQKFKRTKISNSGVLSFLELSQKIKEKEQVLCIVNKRKTAQELYTNVNKEGTYCLTTLLYPAGRKQQIQEIRYRLDKGMPCRVIATSLVEAGVDLDFPEVYRQETGLDSLIQAAGRCNREGKRKVEDSNVYLYKIDGENNSFNSQNVDALFETLRFYEDPTDLKAITHYFMLYRGLLGKENLDQKKIMDAWERGIDGRLFPFSTVSEKFHLIETQTNTIYIPVDEGESLIGKIYDGQMNRELLRKLGQYSVNIFPDHFKRLVEYGCLEMVSNAIYVLRDMNQYRKDIGLQMDVETGFGFYI

SEQ ID NO: 14878 - protein, 858 aa, Clostridium saccharobutylicum; identical to SEQ ID NO: 12004

SEQ ID NO: 14879 - protein, 863 aa, Clostridium saccharobutylicum; identical to SEQ ID NO: 12005

SEQ ID NO: 14880 - protein, 751 aa, Lachnobacterium bovis
MEKINLNLLAKSNPELTIRQHTDDVIECAKILSDNYKMDKKIRELLFKSCEYHDYGKFNEEFQNRIKNGGKFNDEKELPHNFLSIFFIDKNDFDNEEEYYIVCYSVLYHHSFRNESVNDLVLDKKILKNSLLECVEHFNVKRRDFKKIEAVRNINKTILVKGLLNRCDYAASAGNIVEINNNFLLSKIDGMLNEWKEVNENAKWNNMQEFCMENADKNLMITAATGMGKTEGSLLWLGDNKGFYVLPLRSAINSIFLRVVNDILKGEEIENRVALLHSDNLGFIAKQEEKSLSEIDLKTYKSKSKQFAMPITISTPDQLFDFVFKTDNYEMKLATLANSKVIIDEIQAYDATMLSYLIKGIHDIMELGGKIAIFTATLPPFVKELLMKDCNNNTYDFTIGEFNPDSVRHNLKTLNEELNVDRIVKKANENYLEKKSNKILVICNTVKKAQEVFDSLKESIQNEEIEIKMLHSKFIKKDRTKLEKEIGQDGKTEVSKNVIWVATQIVEASLDIDFDYLYTELSDLNGLFQRLGRCNRKGRKNTNDTNCFVFTEIFENIINRSGDKGFIDGTLYDLSKEAINGWDGSISEKQKVDLINTFFTMDKLKKSNYMKIYRSSEMNLYDMDVNELSSEENAKKFRNIISYTIIPTDVYNSQKDYIDELLQKIKSIKVNNQNDWKEYQKCIDEINELTVDVGLYDMGCFSSEVVETEFDLTHYQKIYVLKCNYDAVRGYSRVSRDESNSSLEDDYGVFI

SEQ ID NO: 14881 - protein, 810 aa, Clostridiales bacterium NK3B98
MDAAIFPAHIRKSGEAWSVQSVADHCRHSAVYAENSARDAGLGQAAYLAALLHDMGKCRKAFRDYITTQTIEGEVWRGERVIHTFQGVHYLMERFHESSYSEEGAEDVSYQNLTAELLAYAVGAHHGQFDCVDEKRNSGFLHRMEAENLQYEQSVQTFLQQCADENEVGTRFQRASEEIATLVQRLDGLISEQDDGGEGCFYLGLTARLLLSAVIEGDRRDTAEFMNGSHSNWNCEAVPWGEYLSRAEQKLSEFPADTAIQQARRQISLQCRQFAQHPGGVYRLNVPTGGGKTLSALRYALAHAAKWGKRRIIFTSPLLSILEQNAKVIRDYLQADELILEHHSNVVRTKEDGMELDGLELRAENWNALMIVTTLVQLLNTLFSGKTTCIRRFQALCNSIIVIDEVQTVPNHMLSLFNLAVNYLAEICQTTIVLCSATQPYLEGVTHPICRECQDIVPYQKELWQAFQRTTIQDMGLKRLEEIPDAALEILKDADSLLIVCNKKGEAEAFYRTLSAAPVRCFHLSASMCMEHRRQTLKELEQSLSLSRAGNGKTVCVSTQVIEAGVDISFERVIRLAAGMDSVVQSAGRCNRNGESAEPATVYLVRCADERLRHLREIQMGRDASLQLLELYRRNPGRFDNALDSHKAIREYYRTLYEAMPKGYQDDTVHKGRRTVTLYDLLSTNTAYCDEDCPAAAQLQLRQAFKLAGSLFTVFDEDTTDVIVPFQKGNELILELGTVDPVHEGDRLAAVLEQAKGYTVSVYEQQRKQLEQAGALIPKCGGAVLVLQEGYYDEKTGLQSIAGTKGYLEV

SEQ ID NO: 14882 - protein, 814 aa, Thermus islandicus
MGEGIGRVFFLAEEVGFQPLSHHQGLVVQLLKAWREGEAPLALSPKTKERLFLAAEHHDDGKRLTFRITEEKGRLTYSFRGHRFRIAQEVKDPYAQALIRGHHDYSTPEVVSAASDFVAEGLAHRFPEDLFLLMMADQLEAELAVRLWEGKAGEVRSFVEFDLFPDGEDGFFLDPWPFREDEVLLDFLAYFHPYRGEEAKVVEGWGRALVEALEEGKEPEGFQRKERRVRLRPWAGGARREEDAEAFYAKFSLKPTPFQKEVFEIARGSPAHLLLAPTGTGKTEAAAFPALARGERLVFVLPTRSLVDDLEERFRRYLKTLAREEGRPQALVVDTGHRQVRFRLGADGQEEATAERHLYHADVILTTLDKLLYRYFGYAAGAKSYTFPRRIHDRRTLFVFDEVHLYEATAWVNFRRLIASLYKAGVRFLVMSATMPNTYTEELLLEGILNHPQQRRPSRVLHYCPQGDLPEIVQKHRGKRILVALEEVKEAVEVYRRLRGEGVFLYHGRLAEGQRRKVFAEVKRRDKDKEPYILITTPAIEVGVDLDAEVLISTLCPPENLMQRLGRVNRRGEGRGEAYVVGQEYPQYLGGLPEGYVELLKELDGTDLAEGGEERLREAIRYPRYLDLRAETLFEALWEYVYGLDLTQEPLHRKGFVATRSWTPSVRLRKGEDEVEVPIDRLIGKKEELTPVEVVERRFTDGEEGNRRWKEVPLRSGELYGRELVVDYPYEYDPELGFVELPKVFLRIRHPDPQRVQLLFAPTRGIGTTSGEVLDSDQISEGGKRVLWYLGESAEVEPVGGGEEAEEEEEEEET

SEQ ID NO: 14883 - protein, 937 aa, Calescamantes bacterium JGI 0000106-G12
  misc_feature (476)..(476): Xaa can be any naturally occurring amino acid
  misc_feature (486)..(486): Xaa can be any naturally occurring amino acid
MVEIWAKSKEITLRCHTKDLLNELKEFREKISNNKKINEKEKLFKSLELLKYAIFFHDLGKVSPKFQKRIGNTNYPDLIEDFPDIRHNILSLFFINKKKVREILREICDDNDESLYSILISSVAFHHWTKHEKEYLLHLNNDLIKACEILLKKDENWKKLEEILKENFKCFKINGKEAEDLISFDKPLAEHIKAEGNLMSVGVIPPYTLTFLPERLRAESEQKIDSNLWIFLSGFLMRLDHFVSFWECEDPNFKGKVEKEIPKTDLKTKLKEKFGENFWQKEFLNLNLNLKDKNIILIAPTGIGKTEFAFLWAEGEKFFYTLPSRVATNQIFDRACLYFNSDGKRDEDKKSDDDPFVNGNVGLLHSDADLFIIDKWETSKDTSWDGEIPKIIEISRHLSLPVIISTGDQIFPSALKYPGYERIYATLGYSKLIIDEVQAYDPRACAIIVKMIEDIVSLGGKFLLMTATLPGFIKEXLKSKKIEYVXIDLYEGKIKNGEEERDTIIKIKDIARHKIELKEKDIEDDVDEIIKKANIGKRILVVLNTVEKAESIYEKIKDSGKFKGFLELLHSRFTLNERKKKEKKLEEEFKNPKPENENSPKILVATQVVEASLDIDADYLFTEIAPIDSLIQRMGRVMRRVDSLSGKIKNSGKEFKYEDEEFYPSGGANIIVYFKHKEGEKEYLESGKGHVYKKDILVLTLEKLCDLDGKETDNKTKTKKKKDEKEEYKDKEKYKKKLEEILNRSKEKVRRESNGIIELNESKKNRYVEEVYGSLNEKFSSYLQNFYETLKALDSGYVSENKEEAHNIFREIYTVQIIDKAKIDKAKVEDDVGDKIVKIVNKISDKINKANNITWLWFKKEIIAEYVINENMWRYKEYELNSLWDEIKDKIKWDEIKDKIKDDDIKKKDNIKKKLKNYCSGIYVVKSGVSMKSSIIE

SEQ ID NO: 14884 - protein, 732 aa, Candidatus Calescibacterium nevadense
MRITEEKLQSLLEECWAKDDGTTIREHTDKLLENLEKLKCYYKKDIEELIPKELTCELRYRFWEILELACEYHDYGKIHCMFQKKVENKNIKLIKGLPEVKHNLLSPAFVNVEDELTKKIVRLLVLHHHPVERVSTEDVERVLKEEFGFEKSPISFLLKKGEMDYLRDDIARKFGLPEEKLIKYYRLLKGLLLRIDHASSSKQAQDVEEKPPDDTLSFVDEFFKGANINLNEMQIFIKENRDKNLVVIAPTGSGKTEAGFIYLQRKGFFMLPYRVSANSIYTRAEKIFGNCAGLLHSSALNYVLERDERNEDIKNNKEDAVFLNYFLSRNFAKPIIVCTPDQLMHFVFRYKGFEKYYATALYSKLVIDELQSYDPITLAFIVKALEVLAQNGGKFLVMTATFPKFLKERFKGMGVEFKEFSLQQNPYHNVEIIQHTIDSGIKKIIKLSQKAKVLVVVNTVRKAIELKGEIPNAELLHSRFILKDRKEKEKEIKEFFDGRENGVWITTQLAEVSLDLDADYLFTELSTADSLIQRMGRCNRRGKKSTEKPNVFVFTKDCSGIGPVYYKDLHEKTLHNLENGAWDWEFKWELMEKVYSEDALRNTKYLDNFKKAYCYITNLWEGTDSFTISKSQAKELFRDIDAVQVIPKEFEKEVKELLQKWEEAKGNLSERVKLLSQILEYSFSLPVWSLNKLEKQSIHDKLSIYYVEGNYSKDTGFELISSADTEWKENII

SEQ ID NO: 14885 - protein, 570 aa, Calescamantes bacterium SCGC AAA471-M6
  misc_feature (116)..(116): Xaa can be any naturally occurring amino acid
MLREYYHRALHALGYKTERKFISEAIERIETSWGEKNLFVIEAPTGYGKTTITASLALMSSEEAGKLIVAYPLRTLLEDQYSKLRNVVDEQRLGKRYMHEESSPYLIKPITLTTVXTLSLTMFGLAPEDLNVVVRGWEEDRFVNTSRGHYLFSWSSVMMSDIVLDEVHLVAEESKSLTFLVAMLEHIISHDQRVVFMTATMPTRFKELILGSLRRFRDRVEWMEFRSTAVDDEYIASCLEKRPEIRIQQLSSDTKFDVIKSWLDDALERGFSRVLVVFNTVGEAVSFYRTLDGYENRLLIHSRFTESDKLAKHERLQRLKSEGKYIVVATQVVEAGLDLSSNALITDLAPMCSIIQRFGRLLRYEDEREGVAYVWYESDLGRDRQLYKVYDRGLSAATLDALREAERGNVSLHVPSGERGYKRLLDKVYQDADLRINYREIEEMLSVFTNLDDISKAVDLFFKMEGSFVRESALVPVRCPEMKEEVSVEMRVFERLLKEGLVKGHIVGNGEEEICELPDWLSIGSKIQQRSLARKVIKHIHTAGVKAFIVEGSYNSEYGLEIEEALREHV

SEQ ID NO: 14886 - protein, 629 aa, Candidatus Poribacteria bacterium WGA-3G
MQSAIEAYQNLAKFKPNPMQEELFDYIAPKEQNPALLLKAPTGSGKTEAVLIPSLNAERRLFLIFPSRSLVDDQISRCKEYLQRASEKTGKSYALVIDTGAESVRTVFQEGKVLEKGRRHLYDGDVILTTFDKFLYRFFGFGEPNKSYIFPFRIHHSQRQNLFCFDEAHAYDQVAFVNFQRLIKALYKANLDMVVMTATMPETYQKELNFLDAVDYITGENQLKLERWQEKEQNRQYPNKAIKHIDAKPKEVRNEIGTYVSKQYEPDKRTIVTIETIEDLIPVYQYMKERDRGNNIFLYHGRLTNPQRKRVYRNLKTLEKQDKGYLLFTTSAIEVGCDLDAHLLVTELCNPDSLIQRAGRCNRKGNIADAEIVVVGNRIPSFLSILSAEKTEKYLEKLQQQSGANFNPGALLELMEYAPHSDYRAEVLFDMLYEYVYEARLENKPLHDRGLVITRSFEPSITLTTKIPEEGAKHRPENAVNVSTRSCIAKGGDGESVNPDFKVYHRFYDKYSEEFKFVQLNRSGSIYFKELFVEVPESYFSEELGYVKPPKVFEDRGTRGYRRSFVYHTIEDGKPKEIWLHYLKDFEKPQPEDEIQPTSPEPLKTEHSEPTEAVLSSQDENEQLRLFEH

SEQ ID NO: 14887 - protein, 791 aa, Fusobacterium russii
MYKKYLAKSNGETIQEHTDKLIEKMEDFNNLYPNVLNTKILKYLLHNACLYHDIGKVNENFQAIMRREKPNSINIPHGFLSLAYIDVKKFLSEIEEILKDELEKERNIEKFGAIISPKKYLNVLINAIAYHHERQIKIELEDIENEIGRLGNIKDFHYEKINIPKKLKLPNERYFSLDRRLIPRDDEQEFELVLLNYILIKGLLNKIDYCASSETDIEIEVQNDFLEESLKTLLKKWKKTNSEACWNELQQFMLENKDENVISIAQTGMGKTEAGLLWIGDQKGFFVLPIRTAINAIYQRIINEIVEEENIKKIGLLHSETYERYIEAYEEEGGEALNKYYLETKQLSLPFTVCTLDQLFDFVYMYGGSEVKLATLSYSKIVLDEIQMYSWNLLSYIINGLKSITKLGGKFAILTATFPPFIEDLLRENGIEFKKSKAYVKQDLMLRHSIKLIENEINVEIIRKLYNKNKILVICNTIKAAQRIYDELRIEIDEDELNLFHSKYIRRDKNKKEKEILEIGNKKSQKYGIWVTTQVVEASLDIDFDLLFTELSDLNGLFQRMGRCYRNREYDEKYKYNCYVYIEEENKKCSGIGAVIDDEIFYLSKELLKEKFLKSNENGEIKRKIYEDEKMKYVEELYSTNNLKSTNYYQQLKNSLDYISYLSPFEMEKKDAKQKFRDIIAFPVIPKNIYEENKDYIDELLNKNEFIRLNLKGNLEKEEKIELKIELRKNKNLIKDLSLNLEDKYFRNIEKVKEIILDKYQSISICECDYSNKYGFKANQKNKKWDSDNFI

SEQ ID NO: 14888 - protein, 754 aa, Salisaeta longa
MPNRPMPEILAKTDGTTLKAHTRHVVDEARRWLDAFPFLEKKYQIQTGEALRPQVLHAAEVHDKGKMHPTWQRACRKDAEQGGGRHLMQAHLRHELASLDWAKKHGVELTLPEKTAIAAHHGKLSYRHKHRWLEDANGQFEELWTAFYQTARRWTFRPPDNLTEEALNERFRLTGVRTLLQLADTRASIQEKSGWVPDPTTDLTFDYTFPYDAPRGVQRVIEEAWNEPAMILRAPTGSGKTDAALLWAQHQIDADRADRCVIAMPTRFTSNALALDVNKNVSETGLYHSSAWYARYKKGNNAQEGADVDPNAKHHAREMHRMARLLATPVTVCTIDHLCIALTGTREDHHSIFYHLCNSCVIIDEADFYDSFVQANLQVLLQVLRQFEVPVLIMSATVPDAAKEFYCIDVLVEDTSDLDRTRCTFVDAGAAETPGDISDVLRPIANMETPTAIIYANTVKRALAYYDWFCEQDTRPILYHSRFTESDKKDIEGQLIDALGQEAWAEDKADGIAILTQIGEMSLNISAPVMVSDLCPYDRLAQRAGRAGRFEGMEVGVLHVVTPMKDGELYPAPYGTYDRDENTWHPGLPLRETQETLRYKPHAAQDFIDAVDQLYSTPDDFAPMDTRIEQNSARLRKHLAQDWLIVNARHVDEDSGATDDWQSRDIPPQVTVLTQRPHRFDSYADFRQFAQDCGVSVPRYQVAIGQKIGRVPQEKLRFRVGDEEETAWYAPVYSSTEGLILDLNRQRSYQDRCV

SEQ ID NO: 14889 - protein, 859 aa, Salisaeta longa
MITHPWAKLKREDDQDKTSPVVDWHPLVAHSAEVAACLEMLLRHTKIGTRMAHLMKQDALTETQIQRFGALAALHDAGKMNQGFQNRAFGKQPTCDHVTPMVGMLDSEEHWNTIEAALQLSDMYSWFGDMWDTMGWLRTTWSHHGSLVEIKPPKKGLWPPKAMTRLSEVGSWAREWYPKAFGDALPFTQTEVQHLFNGALTLADWIGSDTTFFGFDATRIDPATAIEDAREEALMAFSELGLVLNTDVDASLSTILGGYEPYEVQEEVQCLPTSTDGTLSILESATGSGKTEAALGRYARLLKEGLVDSMYFAVPTRAAAKQLHERVKDARNVMFGTDHPPVHLAVPGYLKVDSTEGTRFGWQVRWDEDVDNRGWAVESSKRYMASPIAVGTIDQVLLTTLRVRHAHLRLAGLTRSFLVVDEVHASSTYMNELLHNVLTLHQQMGGHALLMSATLGSRARVAFTGEDPIPFKEAKKQHYPLVSHVNGGAIIDPKKPAPPTGDEKQVALDLVPLMRAPEAIARRAEAAASDGAHVLIIRNTVSECQRVFGEIDSQYVFTIPTENGPVHAPHHSRYCAHDRELLDEQIEHVYGKNEVDDRPTRPHDGGIITVATQTVEQSLDIDADLLITDLCPMDVLLQRIGRLHRHSRQGQRPEGYQAAQCVVLTPSQRSIAKTIDPKTGTGHPGPGLGSVYDDLRIVEATWRALEERNTISIPRDNRTLVEEATHPDVLSQIEQCDPRWEAHVTYLRTGRREEILGAKNAKLSWEKPFVDDANGFSGERFTTRLGEQDIVVALPAPMQTPFGQTVEEMTLSPYLFGPDQRPENGMATHVHPVPKGFGFTFADTPFTYTNCGIQKQSST

SEQ ID NO: 14890 - protein, 796 aa, Candidatus Marinimicrobia
MFQFRLFSHPDRLLKDHIQGVWEIARNKYDQQVTTSFPNFAPDVLRTILQVACLFHDFGKSTPWFQSYIKNLAGKYSAEERYLRRHGLISALMVFGILRNLFPHDLFLAALGFMIVRRHHGNLQSFQDFFTLTDEEFELCSKQIEKIDYQEYAQIVAPWEFDRYVQKDFISQVFIEIKSGSLKRFRPIRALKLNCDCYFAVNLLYSILLDADKTDAIFHSALDLQSPILESRHVDSFRQNLAQAKTTDINATRNHIFQSIDSSINRITNETIRIFSINTPTGSGKTIASLYASLKLREKFNLNHIIYCLPFTSIIDQNYEVFDNICKFAGIGHQEGVLLKHHHLAEIRYRKNSAEEEIEYQPEQALHLIEGWESRIIVTTFVQFIYSLITNDNASLRKFNRFSNAVIILDEVQSIPYAYWSLINKSLIKLTQLLNSYIILVTATMPLIFSEEQAEIIELIPEKQDIFKKSSRIKLDLTNLQSDNWDWASFCDYVKQTASHNSDKNIMVVVNTIRCARELYHYLNECDLHHRLIYLSSHVIPVERAKRIQIIKNKKSPKPLLVISTQLIEAGVDIDLEIVIRDFAPLDSIFQACGRCNREGLSKDPGIVKIISIKDAKGQKPAELIYDKFLLEKTMRVLAGKNLIDESDFYQLAQTYYSELSKSASQAKSQEIISAMETLAYEDTEGKPINAKMKLIDQDYDFSIFVEIDQTASQYWNEYTNLFLTEYNFAKKTTLKKIMRRLNDYIINAPRNCLRNLPEYGIYHLKNSLVAQYYHPVTGFNPDISLSEEHSTLFLG

SEQ ID NO: 14891 - protein, 769 aa, Desulfurobacterium sp. TC5-1
MSSTLKRPEKTFTCLLSHPNKCLKDHLKKTQNLVEKYFPYNDNTAKELAAYAARFHDAGKATSFFQEYIKGNGKWSKEKNHSLLSAVILYYYLRKIRGISPLQAFLSFLAVKKHHSFPEDTFENGGIINDTELIKKQLNAISKDNIKELGIPVTVQELKESINDIIKELKYFRSLRRFKRNFGEIENFSIYTTFLSIYSSLLFSDRKDAVDAPEVSFPDIPYEKFKNLIDSIPLKRPIDEKRQEAKEFVLSKEFNLKQRIYSINLPTGLGKTYTGFLQALKMKKILKEKTGKSFRIIYALPFISIIDQNFEVLKEKLEQIIDSTDSRLILKHHHLSNFEYLTNNSEILPFDIAKVLTEGWESEITITTIVQIFNAIFPKNRSQALRFSRLQNTIIILDEIQTIPVKYWKIFNEIIEDLSKKLDFYIIFMTATKPAIFTNHTELAGGKFFTGLNRYEIEIDLKERTIEEFLEKIDINIEKSHLFILNTVKSSQEVYKKLSETINGEIEYLSRAITPFERRERLKKIREGKVKYLISTQIVEAGVDIDFDVVIRDFAPFDSLNQSAGRCNRNGEKAGLFKIIKLIDENNQRPYWSYIYDPILSSATMEILKDKHRLTEEEFIKLTEKYFNLVKDRATDEAKTVKPFFEAVKYLRFQPMENYRCKENEKFICDMNLIEEDCGEEIFVQLNEEAVEIWNKMIEIVTKLKKGNREAFKDYLRIKHKFYDFVIKVNLNKKIPIPISKELGFYFIPIEELDNYYDKTGLKEPNLIW

SEQ ID NO: 14892 - protein, 774 aa, Thermodesulfatator atlanticus
MKEMATSSQVPIDSEIIKLTGLFHDIGKYTEYFQEHLLEGKSFGGKERHSFISALIAYEFLGNIYPNAKQELFGAFTAIRHHHSDPQDFGVELNDTEPVWYQNVRHVKAQVDSLLKASDEIRAIYPQEIVEAISSLKSTHNIDEILEKLRNVLFSGNISLYFTTNFLLGMLVDADIRAVIGLKANEKRHEIPEDIVDRYINNLPKNSPIYPLRQEFYRTVINNIQRLGLENKFLSLTAPTGIGKTFAGFSAAVRLRSMINKETGRLPRIIYVLPFTSIIDQNFDEIAKVIKHAGLPKNVLLKHHFRASPSESISGLKAEDAWKLLEEESLLRERDAQKLIKHYEQAHTRVETWDGEVVVTTFVRFYETLFTNRRSEMRRLHRLAGSIVILDEVQNIPVEYWEATEEALKFLAEKWDARFILMTATRPAFVPEAYELTEPRKKHFFKILSRTALYVENNPYDYRDIESWLLPKIDGVQSFMVVMNTVRAAQDVYQMLKEASDFDLCFLSASLIPKHREARIKDIRKSLKNGARIGLVATQVVEAGVDLDFDLVVRDLAPFDSIVQAAGRCNRNARGENKGRVFLVKLINPEEHGRRLATYIYDSVLIGTTEELLQNQGIIPEKEYLRQVEEYFHKLRMEGRKAQDKNLLLSLKTMKYDEVAMFDLLSQKIFQVPVFVELDEEAEALIDKLKELEGLPTKTYDDRLKRRAMFKAIAPEIWGYVINIPLKVAQGAGLEALPYAASFLWLRRERLDFGDLYREETGFVRKIEHGAFFL

SEQ ID NO: 14893 - protein, 742 aa, Thermodesulfobacterium thermophilum
MQRILAKSNPEKELYEHTLEVIQCAEREIYNLRLLGLNIDNTMEKAIKICCFAHDLGKVSRAFQDSLSGSRKYIPHNLLSVAFLKTIFDQISDIPDQLKNKIIYAVGFHHKNFLELSDFINDSKRAGTDGLEDELIDIETNRLHLLKPMQELFKEYFNADIKFSIDYSIIDKLKDIIFDLNPFDKEIVHLKGILHRADHIASAGINEESKIYLNSEAYKTLKLKITPKKFQEEIVNKGESLLLIAPTGSGKTEAALCWAGNRKGKIIFTLPTRASVNAAFRKLQKYYGDDVGILHGEAGRFIYSTLRREYDETEALEESIYEVNLCKNLLKPIVVTTIDQIFSFALRVHQYEKVLMGLYGANIVLDEIDSYSPYTIEILKQSLKIARQFDINFLIMSATIPDILKEELKKEGIVSEEYIPEWEEIELKNESNHEIQIINDDIINCYKTIKDLSNGERESILIVCNTIKKAVYVYEKLKDLSPKLYHSLFTFDDREIKEAEIAQADHNGRSTGIWITTQVVEVSLDLDFDVLITEAAPVNALIQRMGRCYRKRKGVGKVFIYSKSINDNSNREFYPYGELAIKESLKAFEGNNGVLTWQEKLKILNNYFKKYWQSKKIIDEKTRAKNIVGAFLSSDLTMLETVSNNEVSRFLRDSGVLFNVIPVSKLEDSEIEKLNGNYKWRDRDEKLTFLYQIRGKIISVPIYSLLKFRSFFEETRYGMFLAHLDYNSETGLNLKTLPSNFG

SEQ ID NO: 14894 - protein, 548 aa, Thermodesulfobacterium thermophilum
MQNISLNVRDFYKKYFQIDEPYEFQERIWDLILQGKNPLLVRAPTGSGKTEAVIAPFLAQFINNDFIIAPRLIYVLPMRVLVNGIAQRIKKYAERISPNISVEIQHGDIPDSPFFIADIIVTTLDQFLYGFARASRQVGYHIDVPAGSIASSMVVFDEAHMYRDGFTFSIMRALMEILYRSNIPFVVMTATMPKTLEESLFERIKVTEEQKIFADISFSSKIDIKLHDDPLISNEDINLSDELLEKIKTKRTLIVLNQVKRTQKVYEKIRSRLELNDEQIVLLHSRFTKADRIEHEGKAFSLIPHKENRGIIIPEGTGIVVSTQVLEAGIDFSAELLLTELAPADSLVQRSGRCARYNGQKGEMYIFPVEEENKGYLPYEKKCLEKTWEWLKNNPDFDIKDFNQVCNFVDFTLDYKANDYEAADTLIDLYECVLYADTEPRNIQLRDGKAITLVVVDFSSGKGKKKEDRIKDAIRKTNIRENSINVDIGVGRWLLEKGILKLMLSYDCDKKEWNLKEINDISPFGYYVLESNYYNKQKGVTPDESIFI

SEQ ID NO: 14895 - protein, 773 aa, Thermodesulfobacterium thermophilum
MCSSNLYSHPGRPLEGHLINVSKLVEIFISEKPKELKKNYTQLCKILGLLHDVGKATEFFQRYLLTTDEKEKNSLKNLPETKHSFFSALCGYYVIKELNLSDEFLSLFAFVVIRRHHGDLIDISDEVIVEEKDCENLYKQIESIDNKKFSILVDKLCEAGLPLRLEKDLIKKWIGSFPQELKYFKKCIRNLNNNIERFVTLNFIYSLLLDADKSDVVGLRLSEFAERVNISADIVERYKKVFPFQKSPINKLREKAYYEVLEQPLDPNHRIYSLNLPTGLGKTLISLAFALKLREKLGGKHRIIYALPFLSIIDQNASIFESIIKENGLPPYTNILLKHHHLSEIFYKKDDNEFEHNEAKILVEGWNSEIIVTTFVQVFHSMISNKNRSLRKFHRFANSIIILDEVQAIPVKYWLLLREILSVLSKKFNSYILLVTATEPLIFNQEDVKQLIEKDYYFKNLNRIKLIPLLDKDLTLTELYEYFNLMDGRTYLFVFNTISAARDFYIMIKKQTNLPATYLSTHLIPKERLKRIKEIKEKKYKVVVSTQLVEAGVDIDFDVVVRDIAPFDSIMQSAGRCNRNSLKETEKGETYIVSLRDERNRLYSSYIYDPTLLDITRKILKDYKEIKENELINLIEEYYIKVSERKTQSVSKEIIEAVSKLRYDTEDEKISVATFQLIEQSYFEVDVFIELDEEAKNIWQQYLELKRVKDFFERKKKFDLIKANFYQYVISVPVNVKNKPPIVEGIGYVGHETINDYYDLDTGYITKESTIIW

SEQ ID NO: 14896 - protein, 1067 aa, Bifidobacterium minimum
MAHRHELFEDGIPRDLSNTARAVWAKSNMQDPTDRHYLRLWQHLEDTASTASLIWGDFVTSDVKRLLADDLGGEDLARWIYLFLASIHDVGKASPAFQVQCSWQADRVRETGMHIDPVLAANERRHLYRHELVGYQTILEWMRTKGFSTGTHSLAYGLASIVAGHHGSAIDLNKVKFLDQWDASIFIGGTEWSSIRNELMDWTARATGFLDVAHEREGRPIPPRSQILLTALVIMADWMASNSYLFPLNEPLEDNAGGNDSWNETHFNSTSRAESAWRKINLPGPWRPALETSDPDRLFTSRFAIPNAKLRPMQRDVVDLAMTMPEPGLIIVEGNMGDGKTEAALLAAEVLAQRFGCGGVEYALPGQATANAMFGRVLSWIAHLPTGSQEKFTSLFLAHGKRELNPDFERLRQRWFNDDDPSALDAGITTVFDGDEKSRGRGSSTLVLNPAVNSWLSGRKRGNLSDFVVGTIDQVLMGALRSRHVVLRHLSFAGKVVILDEIHSNTAYMNVYMETMLSWLGAYHAPVIMLSATLPQSRREAFLKAYRQGALAENAIADSGGVDDYAYSNDSHDLDDLEDPEEADEAVTPAGDMNARGEISQSANSMVGETNGEISDESKLDYRYPLISTSSALVEPSSKTSAVSGRTTAIATGVIDDDDETLIALLTDKLRDGGCAVVIRNTVSRAQHAFDVLSEAFDIDVILDHSRFIACDRASIDRDLISRFGKDGSAEDRNAIVVATQVVEQSLDVDFDVMVSDIAPIDLILQRAGRLHRHRRGDNEMERPNPVRQAQLYIAGIQEWRDGGAPVFDRGCENIYTRFQLLRSLAVLDLCNRGSHTVVTVPDDIPRLVQPAYAHIPLGPDSWQDDLTKAEQQFDQKRQESEDKARHYRIPWPDDQREGGIKECDLSGWLTNALRDPESAKSGSKNGFVSTGVREGDDSFEVIVLERDSDGQIRLPQWSGFSSEPLPIGVGLLSAEQIHDILTCTISLGRSALKYVDMDAAIAAIENSAPDVWFDYQQQSSLLRGQLMLLLDSQGKTSLTIDDPSWKGHATVMTIHYSTTKGWEVSQ

SEQ ID NO: 14897 - protein, 767 aa, Enterorhabdus caecimuris
MTTILLSRIVRTKMFLAHIAEDGREEAVEDHLCAVAERAADFAARFGSEGWAYNMGVLHDIGKYTDAFQRRIKENGPRVDHSTAGASIMADSGDLGALLAYAIAGHHAGLPDGCPTGENIQRETQDSTLTKRLERFRAENSSGATWLNRASFKRLGLRGSPGTPTPLVGAQKSGGYGAGFWVRMMFSCLVDADFLATEEFMQGHERKSLPSASAAELRDTLEDRLSMFYPPRTPLNELRCRILDDCRAAATGQPGFYALTVPTGGGKTLGSLRFALNQAALSGHLGAKVIYAVPYTSIIEQNADVIRGMIGREQVLEHHSGFDFDSVDEKPEGQEHVVAHNRERPTGLGDALRLAAENWDAPVVVTTNVQLFESLHSNRTSKCRKLHNLAKSVIVLDEAQMLPVEYLKPCLAALEELVAHYGCTVVFCTATQPALDGIIEDLPRPVEISQAGLDSFEKLRRVTYCLEGELDDARLAERLRNEKQVLCILDNRKQTRVVFESLDDDGTYHLSTLMHPEHRRTVISEIRQRLKEGLPCRVISTSLVEAGVDLDFPVVYRAMSGLDSIVQAAGRCNRNDGRSSSESLVHIFEPDDSYRRPREVSQRAAVGRSVLRSVGYADGGGGLIEIDLGSPEIMREYFARLYDIRRDGMDKGGAYKKLANDRGGWGSYPFKSVAEEFKLIESADCSVIVPSEAIEEEIELLREGVAGRNAMRRLRQYSVNVYRANLPSLAGSVEQVAEDAFLLVNADRYSSACGLDLTDRHGEGLMW

SEQ ID NO: 14898 - protein, 719 aa, Dielma fastidiosa
MSLLARSAGDRNQEQTYSDHIREVVTKSLDNLHALAFYVGEDRTELYEEILWNAAEYHDLGKLNAQNQEVLHEKNRAKKLPINHRDAGLKFLLDKDSERIEATLVYAHHRPGLPDLVREEVKDSPFRFTDCMSDSEAHLEEYLQMHNQELGNSILKTKKTKRSKTKRSSMEYRMLLSCLVDGDYTSAQGYVEPLSVSTRWSERIGKLDQYITNLSNEKENNQRNQMRKNMYYACRDADTDNPIEYCGSPVGTGKTTAVMAHMLKVAEKYKLRHIIVVLPYTNIITQTVKTLRDAVVLEDEQGKEQEVVAELHHQVDFDNSKYKYLATTWRAPIIVTTAVEFFETLASNQPAKLRKLHQLTGSAIILDEYHTMLPLKLMLPAWQWLNDLTSEWGCHICMSSATPIEFWKIKKFKKKSNQSVSSLLPPEINKQLSEFERKRVTHNILSEKLSLYKSVMELKEHVEKFYGSKIVLFNTIQNAAYFANYLKANGCDVLHLSTALKPEDQKEIIKEVKHRLENKVEYQNWYLVVTSGVECGLDISFHYGFCELNSLQNLLQLLGRICRESDFEDSFLEVFKISDDHFVPNSSFEISIEIYEEMMKLDELKDCSDNELVSIAFKEECKKSDELSEEICDGDLSCEFETVASKFKVIDEDTVTVLADKKLAEKIRSGKFVSATELQMGSVNMRRSVQKKLGLRDNDIMFLSDKQYDNFIGYMKSLV

SEQ ID NO: 14899 - protein, 739 aa, Methylohalobius crimeensis
MKFFAHSTDNVDQSDWQPLSSHLTAVGKLAAEKAERFGAADYARIAGLLHDLGKYTEAFQKRLTGDFPKVDHSTWGACVACQRYDQIGKLLAYSIAGHHAGLADGRESGKRGSLAERLKAKGLPELLPDWQQEIELPSADSLLSPKGFRPHRKRQIFQLAFLTRMIFSCLVDADFLDTEAFYRKLDGKRNLRDVEVPDLTELREALKHHLSQFKPDTAVNEIRADILRHVQANAILEPGIFSLTVPTGGGKTLTSLAFALDHAIRHGLRRVIYVIPFTSIVEQNAAVFREALGELGEQAVLEHHSAFIDDDRKKPESREKLKLAMENWDAPIVVTTAVQFFESLFADRPAKCRKLHNIAGSVVILDEAQVLPLKLLRPCVTALDELACNYHTSIVLCTATQPALKSPKFKDGFEEVHELAPEPERIFRRLERVQVRHVGLKSDAELAEAMADHEQVLCIVNNRRHARALYESISDLAGTYHLTTLMCAKHRSQVLSEIKRKLVQGKPCRLVATSLIEAGVDVDFPTVLRAEAGLDSIAQAAGRCNREGKRPVETSEVLIFSTGDEWKPPLELKQFAQAGREIFRHHADGPLSLQAVENYFQMLYWQKGEQALDGHDLLGRFKEGNIDGLPFETVASKFRMIENTQMPVVVPFDQTARTALRDLEYAEHAGAIARDLQPYIVQLPRQGYDALRMAGAIQPVAEAKFGEQFMRLVNESLYDKRVGLTWDDPVFIRAEKLVF

SEQ ID NO: 14900 - protein, 881 aa, Methylohalobius crimeensis
MTTIENLKCIFWGKFQKNGPSCLPLAAHCLDVAMTFHKLVELAGIRRSLELAAGRALCGLDFERLAVFAMLHDVGKANLGFQFKVFDPKSRRAGHIRELAPLFEEQTLNHRFAQALDIEALFPWVDTDHPEILESLLLATWSHHGQPLCFKGEQTGNYFLAKTEWWQPKRGWNPFTEVANLMEQARKVFPRAFAPSGIPLPAEPRFHHLFAGLVMLADWLGSHPAHFPIQRMDPVKRSYQNREIIPGMLKGIGLDTTYLQHHLAKGPCTFEDRFRFPPRPLQKRLHELDPHDPTTCLLIAESETGSGKTEAALDWFCTLFSAGLVDGLYFALPTRVAARELYGRVNETLARWFPEPDNRPVTVLAVPGYAQVDGLPPEHILPDVDAANLWQDDEDLRRRERIWAAEHPKRFLAATVAVGTVDQALLSCVQSKHAHLRSVCLGRSLLVVDEVHASDIYMTALLRHLLNHHLAVGGRALLLSATLGSHARTDLLQMDGDKSKHLSLEAAEAIDYPALTLGSGQTLSCGPIRESNHKTVEFELVPHAFIPEAIGERIASALDGGAKVLVVMNTVSRAIALQRILEEQMDSSHLFRCHGIVCPHHGRFAPEDRLILDKSVSMCLGRDSSPDALLLIGTQTLEQSLDIDADLLISDLCPADVLLQRVGRLHRHQRTRPSGFETPRCLVLIPEHEDLENALDNHGNVFGNYKGLGYGSVYADLRTLELTQRVLAASPAVQIPTDNRRLVEAITHPESLKSLTSNRWLRHAQNVEGEGLAKELSGNMVLLPFNQLFGEFEYHEANSKVATRLGVGNLEIMLDRKVTGPFGQALTKLVIPGHLAPEKPVETLSVTSASAKEICVSLRDQRTGKDWRYRYTRFGLEKEDS

SEQ ID NO: 14901 - protein, 947 aa, Corynebacterium; identical to SEQ ID NO: 13226

SEQ ID NO: 14902 - protein, 926 aa, Corynebacterium; identical to SEQ ID NO: 13227

SEQ ID NO: 14903 - protein, 845 aa, Fusobacterium nucleatum; identical to SEQ ID NO: 13232

SEQ ID NO: 14904 - protein, 845 aa, Fusobacterium nucleatum; identical to SEQ ID NO: 13233

SEQ ID NO: 14905 - protein, 845 aa, Fusobacterium nucleatum; identical to SEQ ID NO: 13234

SEQ ID NO: 14906 - protein, 915 aa, Peptoniphilus sp. BV3AC2; identical to SEQ ID NO: 13235

SEQ ID NO: 14907 - protein, 800 aa, Hungateiclostridium thermocellum; identical to SEQ ID NO: 12293

SEQ ID NO: 14908 - protein, 893 aa, Lyngbya aestuarii; identical to SEQ ID NO: 13231

SEQ ID NO: 14909 - protein, 744 aa, Pseudomonas aeruginosa; identical to SEQ ID NO: 13236

SEQ ID NO: 14910 - protein, 744 aa, Pseudomonas aeruginosa; identical to SEQ ID NO: 13237

SEQ ID NO: 14911 - protein, 748 aa, Salmonella enterica; identical to SEQ ID NO: 13239

SEQ ID NO: 14912 - protein, 746 aa, Youngiibacter fragilis; identical to SEQ ID NO: 13246

SEQ ID NO: 14913 - protein, 623 aa, Candidatus Halobonum tyrrellensis; identical to SEQ ID NO: 13240

SEQ ID NO: 14914 - protein, 759 aa, Clostridium tetani; identical to SEQ ID NO: 12300

SEQ ID NO: 14915 - protein, 875 aa, Asticcacaulis sp. AC402; identical to SEQ ID NO: 13241

SEQ ID NO: 14916 - protein, 656 aa, Escherichia coli; identical to SEQ ID NO: 13242

SEQ ID NO: 14917 - protein, 733 aa, Vagococcus lutrae; identical to SEQ ID NO: 13243

SEQ ID NO: 14918 - protein, 762 aa, Mesorhizobium sp. LNHC209A00
MTPKAERTTSLQPSAFDTLSEPVRRWIWQRKWPSLRDVQEKAIPAILAGGDVVISARTAAGKTEAAFLPLLTRHAEHAGSADGFAILYVSPLKALINDQHRRLESLCEGSGVLLHKWHGDVSADAKTRARKRPSGIVLITPESLEALLVRRGGEVAQIFSRLDAVVIDELHAFIGTERGMQLQSILNRIEVATARDRIDRIGLSATLGDMTLAAEALRPGKGASVTIVEGEDEGNGVRLQIRGYLLDGIALGDLTATTDDGHPPRKSAEPFEQPTVPAALAADLFRLLRGQSNLLFAGSRANVEVYADMLRSMCDEASFPNEFFPHHGNLARAMREGVEARLRDDPRPTTAVATTTLELGIDIGEVETIAQIGPGSSVASLRQRLGRSGRRAGKPATLRMFVIEPPIGKGRHPIDRLRLDLVQSIAMVECLRAGWCEPPLQAGLHLSTLLHQVMALIVQTGGVSPTVAWKLLCERGPFRAVDRTLFAELLRCMATPENQLLEQSPEGLLMIGETGEKITESYEFYAVFATEREYRIIHDARTLGTYPLGSPLARGETIIFAGRRWQVIEIDDRARVIMVKPTRAGKPPHFNGKGAAIHDHVVATMRTVLASDGAYPYLDPAANRLLDEARSSFLDLQLDSRSIVAHGEGVLIFPWVGTRKLQTLTLALLAREFKASHFGHAIELQECEAGKAMETLQDIAGSPAPDGEELAARLAQPALAKFDSFLSDHLMTLVTMVERISAKDLPLIAANALENHTMRRVI

SEQ ID NO: 14919 - protein, 794 aa, Methanolobus tindarius; identical to SEQ ID NO: 13245

SEQ ID NO: 14920 - protein, 732 aa, Xanthomonas hortorum; identical to SEQ ID NO: 13248

SEQ ID NO: 14921 - protein, 754 aa, Rhodobacter capsulatus; identical to SEQ ID NO: 13249

SEQ ID NO: 14922 - protein, 754 aa, Rhodobacter capsulatus; identical to SEQ ID NO: 13253

SEQ ID NO: 14923 - protein, 715 aa, Ruminococcus  lactaris; identical to SEQ ID NO: 13250

SEQ ID NO: 14924 - protein, 712 aa, Porphyromonas crevioricanis; identical to SEQ ID NO: 13283

SEQ ID NO: 14925 - protein, 889 aa, Gluconobacter frateurii
MTDLAQFWAKTDMQTGALHPMHPVLAHCLDVAAVAISLPESMLPLINHQPLDRRLLGFLASLHDIGKLGATFQFLRPDLWPAALGHTPAALPPGPRHDAGGLQLLGQLSTHPVLRTLFPDWSVTKKLRIFAGVAGHHGKPVSRAYQRPANLTSLEEKNLEAAQSFLTVMASLFQPPPFPEDTTEAAIDSLAWRLAEYLPIADWIGSNRTWFPYISPQDLTDPSAYFWNKALPQAQKAVLQAGLGSVRTAPFQTAKTLLPHLEKYTLSPLQHWAETVPLPNGPTLIVIEDMTGSGKTEAALILSHRLIARGHASGLFLALPTMATANAMFDRVAAAYGKMFHPLDRPSLALAHGKARLSERFTQTILSEKPSFSTPEHQKQPGESACSEWLASENRRALLAQVGIGTIDQALMAVLPVRYTTVRRQGLSNKILCCDEIHSFDPYMTEEMKELLTLHASRGGSVILLSATLSHALRTTLVNAFRKGLGLPGTTLQDTHYPLTTLVSTASSPMETPCAPRPGLGRTVTINRLSDPDEAEARIMNLASTGAAIAWIRNTVDDAIASAEALRAKGVKVQLFHARFAMVDRLAIEQDILRKFGKQSSPEKRTGVLVSSQILEQSLDVDFDALITDLAPADLLIQRAGRLWRHHRSNRPLSSPQLDIISPPPISDPDANWIRRVLPGTAAVYRDPSLLWRTARALFSRSMLRTPEDVRPIIEEVADTTSPDSVPAALEKEMLTTQGKNIGAQGLGRQTVLKTGEPYDPGTGQWDTDLQARTRLETDPTVVVRLALLKNGTIHPYADDDDPARAWALSEIRVARTRLTSCPPPEGLQIAIETARACWPRWEREAVNDILVLVLFAAEEGEFEGVGRDKDGNALALRYHKVTGLMFAA

SEQ ID NO: 14926 - protein, 827 aa, Paenibacillus polymyxa; identical to SEQ ID NO: 12011

SEQ ID NO: 14927 - protein, 809 aa, Methanobacterium sp. MB1; identical to SEQ ID NO: 12294

SEQ ID NO: 14928 - protein, 720 aa, Escherichia coli; identical to SEQ ID NO: 13255

SEQ ID NO: 14929 - protein, 707 aa, Pseudomonas sp. TKP; identical to SEQ ID NO: 12012

SEQ ID NO: 14930 - protein, 589 aa, Sulfolobus acidocaldarius; identical to SEQ ID NO: 12013

SEQ ID NO: 14931 - protein, 753 aa, Dickeya dianthicola
MAERLSFIAHVKRNNDGDWSTPHYLDAHLREVAELAAAIAPTALSDWARLAGRWHDLGKYRPPFQDYLRKASGYDAENAHIEQAPGRVSHSIAGARYAITALGKGLGHILAYAISGHHAGLPNGRGDAGSLYNRLTTGDDEYQQAREQAIPADILQAIPVSLPPLSEENIALWLRMLFSCLVDADFLDTERYMSPENAARREKTASLTLASLQPRYQSHMHTLAGRNPQSPLHQLRQSILDETRQAAALAPGLFSLTVPTGGGKTLASLGFALDHALRHGKKRIIYAIPYTSIIEQNAAVFRQALGEEAVIEHHCNLDNSDDARARLACENWDAPVIVTTNVQLFESLHAARPSRCRKLHNLADSVIILDEAQQLPRDFHAPITQVMQQLTELFGVSWLLCTATQPVLEAQRNPFGQLLMPGLAQVREIIARPSQLADVLRRVDVRFSLTPCDWQTLAAELAAQPCVLCIVNTRGDARTLYQRLADDPDVLHLSAQMCAEHRSQVITQIKQRLAARQQGDSRPLRVISTQLVEAGVDLDFPTVWRAIAGLDAIAQAAGRCNREGKLTRPGIVQVFMPPALPPAGALRQAAQCTLEMVNAGLLTDPLSPAAFRDYFTRFNSKGERDRHGIGRLLRAEPDSEIGLALCFRDAAEKFRLIDDTGVAVIVPWQPDDEEPSPVEYWLQCLESDAGAHWVYRKLQRYSVNVPQTLAARLQALGALQPRAGLLVLLESHYCRNTGVKLPEALLSAEDSVI

SEQ ID NO: 14932 - protein, 871 aa, Dickeya dianthicola
MRRLTKTPSQTDNTAPAMHFDNCPAKTRKLSNGTVVQGRSVLSHCQIVGEIARYLISRFPESLRNHLFPSGSEMAAGSHDIGKVSPTFVAKILLACGIDYKTMPALAGVNPELEKQWGGHAGVSQATAEDIGVPKYVAEILGQHHGFNPMVDDKRGNADIFGGPHWFDERKKLVAALKECLQADWPTFDSAAQARIVAGLTSVADWIGSGEFFENPDEDWRPNIIAALNNAGFIKPVIRNGLSFAEVFDPVNLAMQLREPQSLFVEQVSGPGVYILEAQMGMGKTEAALYAAYQLLVQEKATGIYFALPTQLTSNKIYERFNAFLEQIVSAQTPKRGLLLHSSAWLLDTEIGEEGSPGGSWFNQNKRGLLAPFAVGTIDQALMAVMNVKHGFVRAFGLAGKVVILDEVHSYDLYTGTILNELVAFLRQIDCTVIILSATLSQSRRAALLQQTATSTAYPLITAVPAAMENNTPLEVGVPTVESDPVTLQLCHESEPALEEALRRAAQGQQVLWIENTVAEAQQRYLDIASRATEAGCEIGLLHSRFTPQRRAINEDRWVALYGRVGWPQRANCGRILVGTQVLEQSLDIDADFLVTRFAPTDMLLQRIGRLWRHTDTPRHASAKPECWLLAPELEHALALPHSAFGKSAVVYSPYVLCRSLEVWKDMKSIRLPSGIRPLIDQTYAERTETGQWASLLHELKNGSRFRTGEQAQQALAKLTLSKGGKTLPEHKAETRYSDQDTHDLLLLRSLRSQDGTTTIRLLDGTELTLPHGRHRLTKAEWRQLAVALNQQLVRVNPAYCPPKTAKHELEKLHLNEVFYLGRPEDDEALLRVAIVSHVGELLTLDGYPAGDKYLLEYREDLGLRAISNKE

SEQ ID NO: 14933 - protein, 761 aa, Thermosynechococcus sp. NK55a; identical to SEQ ID NO: 12009

SEQ ID NO: 14934 - protein, 710 aa, Escherichia coli
MTFFDFWGKTRRGEKDGGDDYHLLCWHSLDVAAMGYLMVKRNCFGLADYFRQLGISDKEQAAQFFAWLLCWHDIGKFARSFQQLYLPPELKIQEGARKNYEKISHSTLGYWLWNHYLSECQELLPSSSLSPRKLRRVIEMWMPVTTGHHGRPPDRMDELDNFLPEDKAAARDFLLEIKPLFPLIEIPAFWDDDEGIELIKHLSWYISATVVLADWTGSSTRFFPRVAHPMDIKGYWQKTLIQAQNALTVFPLKAKVAPFNGINTLFPFIENPTPLQQKVLDLDISQQGPQLFILEDVTGAGKTEAALILAHRLIAAGKAQGLFFGLPTMATANAMYDRLVKTWLAFYSPESRPSLVLAHSARTLMDRFNESLWSGDLVGSEEPDEQTFSQGCAAWFADSNKKALLAEIGVGTLDQAMMAVMPFKHNNLRLLGLSNKILLADEIHACDAYMSCILEGLIERQARGGNSVILLSATLSQQQRDKLVAAFARGTEGQQEAPFLEKDDYPWLTHVTKSDVNSHRVATRKDVERSVSVGWLHSEQECIARIESAVSQGKCIAWIRNSVDDAIKVHRQLLARGVIPASSLSLFHSRFAFSDRQRIETETLARFGKYCSLQRASQFIVCTQVIEQSVDIDLDEMISDLAPVDLLIQRAGRLQRHIRDINGQLKRDGKDERSPPELLILASVWDDSPGDEWFGSAMRNSVNRPGNPGD

SEQ ID NO: 14935 - protein, 595 aa, Escherichia coli
LFILEDVTGAGKTEAALILAHRLMAARKAQGLFFGLPTMATANAMYDRLVKTWLAFYSPESRPSLVLAHSARTLMDRFNESLWSGDLVGSEEPDEQTFSQGCAAWFANSNKKALLAEIGVGTLDQAMMAVMPFKHNNLRLLGLSNKILLADEIHACDAYMSCILEGLIERQARGGNSVILLSATLSQQQRDKLVAAFARGTEGQQEAPFLEKDDYPWLTHVTKSDVNSHRVATRKDVERSVSVGWLHSEQESIARIESAVSQGKCIAWIRNSVDDAIKVHRQLLARGVIPASSLSLFHSRFAFSDRQRIEMETLARFGKEDGSQRAGKVLICTQVLEQSVDCDLDEMISDLAPVDLLIQRAGRLQRHIRDINGQLKRDGKDERSPPELLILAPVWDDAPGDEWFGSAMRNSAYVYPDHGRIWLTQRVLREQGAIQMPHAARLLIESVYGEDVVMPEGFARSEQEQVGKYYCDRAMAKKFVLNFKPGYAANINDYLPEKLSTRLAEESVSLWLATCIAGVVKPYATGAHAWEMSVVRVRRSWWKKHRDEFSLLEGEAFRQWCIEQRQDPEMANVILVTDDESCGYSAREGLIGKVD

SEQ ID NO: 14936 - protein, 754 aa, Escherichia coli
MTFFDFWGKTRRGEKDGGDDYHLLCWHSLDVAAMGYLMVKRNCFGLADYFRQLGISDKEQAAQFFAWLLCWHDIGKFARSFQQLYLPPELKIQEGARKNYEKISHSTLGYWLWNHYLSECQELLPSSSLSPRKLRRVIEMWMPVTTGHHGRPPDRMDELDNFLPEDKAAARDFLLEIKPLFPLIEIPAFWDDDEGIELIKHLSWYISATVVLADWTGSSTRFFPRVAHPMDIKGYWQKTLIQAQNALTVFPLKAKVAPFNGINTLFPFIENPTPLQQKVLDLDISQQGPQLFILEDVTGAGKTEAALILAHRLIAAGKAQGLFFGLPTMATANAMYDRLVKTWLAFYSPESRPSLVLAHSARTLMDRFNESLWSGDLVGSEEPDEQTFSQGCAAWFADSNKKALLAEIGVGTLDQAMMAVMPFKHNNLRLLGLSNKILLADEIHACDAYMSCILEGLIERQARGGNSVILLSATLSQQQRDKLVAAFARGTEGLQEAPFLEKDDYPWLTHVTKSDVNSHRVATRKDVERSVSVGWLHSEQECIARIESAVSQGKCIAWIRNSVDDAIKVHRQLLARGVIPASSLSLFHSRFAFSDRQRIETETLARFGKYCSLQRASQVIVCTQVIEQSVDIDLDEMISDLAPVDLLIQRAGRLQRHIRDINGQLKRDGKDERSPPELLILAPVWDDSPGDEWFGSAMRNSAFVYPDHGRIWLTQRVLREQGAIQMPHAARLLIESVYGEDVVMPEGLQRFAKT

SEQ ID NO: 14937 - protein, 730 aa, Escherichia coli
MDELDNFLPEDKAAARDFLLEIKPLFPLIEIPAFWDDDEGIELIKHLSWYISATVVLADWTGSSTRFFPRVAHPMDIKGYWQKTLVQAQNALTVFPLKAKVAPFNGINTLFPFIENPTPLQQKVLDLDISQQGPQLFILEDVTGAGKTEAALILAHRLIAAGKAQGLFFGLPTMATANAMYDRLVKTWLAFYSPESRPSLVLAHSARTLMDRFNESLWSGDLIGSEEPDEQAFSQGCAAWFADSNKKALLAEIGVGTLDQAMMAVMPFKHNNLRLLGLSNKILLADEIHACDAYMSCILEGLIERQARGGNSVILLSATLSQQQRDKLVAAFARGAEGQQEVPLLGKDDYPWLTHVTKTDVHSHRVATRKEVERSVSVGWLHSEQECIARIESAVSQGKCIAWIRNSVDDAIQVYRQLLARGVIPASSLSLFHSRFAFSDRQRIETETLARFGKYCSLQRASQVIVCTQVIEQSVDIDLDEMISDLAPIDLLIQRAGRLQRHIRDINGQLKRDGKDERSPPELLILAPVWDDAPGDEWFGSAMRNSAYVYPDHGRIWLTQRVLREQGAIQMPHAARLLIESVYGEDVVMPEGFARSEQEQVGKYYCDRARAKKYVLNFRPGYAANINDYLPEKLSTRLAEESVSLWLATCIDGVVKPYATGAHAWEMSVVRVRRRWWKKHRDEFSLLEGDAFRQWCVEQRQDPEMANVILVTDDESCGYSAREGLIGKVG

SEQ ID NO: 14938 - protein, 890 aa, Trichomonas vaginalis G3; identical to SEQ ID NO: 12315

SEQ ID NO: 14939 - protein, 1905 aa, Paramecium tetraurelia strain d4-2
MNSKVIINQNTLRDVEMVYEKAIRMISCLKEKHKLITRIRLVDSDKAIFQELAKGMAQLIDNLRKGGDVHLIFQSNLPYFEVQLDLELFIVEPKKMKECLLRKQLRELGLKNIQFKSKECREHIIADDFINLEDEFKKDECAELLKERFDTFKVQDEQAIIEILKKYLKKNLIETYNRELIDIRFYINQDFDIVIEYKINDNQLNLQKKIKRRRWSEIKDAISHFYTYQYLQEITLSMMEQMFYVDEIELMELRQCVQQIVQNCQSSYNENLKYPLSIYKSRFWDILGILPRSLNTHNRFGQCKIIIIQNQSRLFFLNHQKIIENKLIKNDITLFQTYTQLIADSKQRLDLIKKNVSSSNTQSLIKQKRELIEKLLILPELEQEIQGLQILEQWKLNQSNQDNEEDFILQMPEETYDQIKAITDKIAQTKQIYEEYHRVLNKVKNDVINFQGFKTIQQNKIYLTNLYKRVLQEKQRVTQKLPIYFKKRELIDSIQQSQVILLIGATGSGKSTQLVQYVYEEIELRGKIICVEPRMIAARSLAKRVAEEMHTKLGGSVAYLNEYDQLDDDNKIIFTQDRIILNILQKDPLLNDYEVVIIDEAHERNMNTDILLGLLKDIINKRKDLKIIIMSATMDEELFSNYFQCKAFKVEGKLFDVKIKYQNSYSDNYIDQIQSLIQNKIIYKVMNQSYQQRHVLIFLAGIDEIQRLLYLFQDYQDMDEFLFLGLHGQMTQDEQFDVFQETKKIKIIFSTRVAETALTINDVSVVIDIGVDRFSEYDQKRGMQITKISWISQAQANQRAGRAGRTRQGKCYRLYSEQEYQTQMQEHKTPEIQRCCLDLVVLRIKSFNKDPFEFEFIQSPNRQAMKSSQEYLIDIKALDEQGNITVLGKFMSQIQTEPRMSRILIEAYYKNVFRETLSIICVMLNNQSLYLKNTDVSNKIECLNEMGDFFTYSRVYWDFKSLTNSNLSNFQIKQKCFQKGYHYKTLKNCEKAFDEMEKAFSYFDLQLYENQEIKNKILWNSDSTREECVMTCFLTAFYPDLCVYNGNPYIGYTFLKSKRNVRIYGSSTLSLLNHFPKYIICSDLYSSNYFDFCRVAQEVKLEKLKEILKPSQIEEIENFVPDKYQYQQLRNVSSSLLNHLIHTFNQYSYDEQEKRFQYYCNNDQDNGIFEIWSLKPIDLEFYQKDYYEKMKSYLYFRLYGQGMLVYFKHGAQIHVTQQCTSSELVIVQFSSSPFNIEEIQQILDEQHLYYNNLFQINANRFGYCGQIFTNSQEIAYQITYVLNEKAKYRLELQNQQEQQERQRLFTIKPREIRNRVIKSSVELIFYGSENKGFGFIQFKNQEEAEEFFIKTISIVQFKGRPQDLKIYQDQKSKIRISNVPYNANEYELLRYLQDLAQQKNCPKPQSLNLIGKEQTETKDWNHEIHKVFEKYTGEKPLHLDIRSDKNNYRIIVRVMTTTNPIKLEEMRKQINFTNNILGFSSITMKIEYKIIKIISKNILVQNEEKINDIKKELQAKYSEDLLKIFSSGENMIIIGKNPNFVRQASLMLHGVLNGYNLKVNLRKYVFKQVLRDNQFYQDLLSLQDLHGFKFNTKLLQQGAIKVYLNQDSLIEIQNAINSMIKQHVSNNLIVNIRNYSFKPLLTIKDNIMFMLQQKYNVSIDFILQKKQIIIYGNNEQAQKCKDHLLKSLSKSPEAQKQDLCEICYGELTEKYVLALCNHFFCKNCLYESIKAQNNPPYKCPQQSCDNLISLSDLQQILCEIEFSKLLDQSFKRYKDQHADEYIGCLTPDCEEFFKKLTQNKEQFYYCQSCLQSFCFLCKRNAHPQISCEEAKKLFIDGKDLDESELLKMNIKRCPKCQMGVQKNEGCLHLHCTNCENHFCWVCLHQANLSQDIYAHLRSQHGGYFQ

SEQ ID NO: 14940 - protein, 1216 aa, Nasonia vitripennis
MDEVQKLEHLSLVSKICTELENHLGFNDKDLAEFIIDLSEENNTFDSFKAVLIQKGAEFADSFIANLLRIIQHMKPKKVKENKPENSKQNDLAYKFPALALPNEEPANVVDNKNTNISDVVDDMLMQLDAKNLGGSKTSEKNERRSRSLDKDRTERKNRSNDDDSSVRSRKRKSSRSPRRKSSRSPRRRNRSPRRRKSSRSPRRKSSRSPRQRKSSRSPRRRSSRSPRQKRESSRDESHSRKRSYSNTRSNFSEELKELEVGKIYTGKVANVVPFGCFVQLDGLRKRSEGLVHISQLRREGRVVNASDVVTRGEKVFVKVLNITGQKVSLSMKDVDQESGCDLNPNPVLSKREEDEQVLRNPDRPVSLLEFQANNDEDEVYSKKRVQRLSSPEKWEIKQMLAASCIDRSELPEFDTETGVLPREDDEEEDVEIELVEEEPPFLNGHGRALGDLSPVRIVKNPDGSLAQAAMMQSALAKERREQKMLQREQEIDSLPAGQHKNWIDPLPDADNSTSAAASMRGIGLQTQDLPEWKKHVIGGKKSSFGKKTNLSLIEQRQSLPIYKLKDDLVKAVTDNQILIVIGETGSGKTTQITQYLAEMGFTSRGKIGCTQPRRVAAMSVANRVAEEFGCRLGQEVGYTIRFEDCTGPETVIKYMTDGMLLRECLMDLDLKSYSVIMLDEAHERTIHTDVLFGLLKQAVGRRSDLKLIVTSATLDAVKFSQYFFKAPIFTIPGRTFEVEVMYTKEPETDYLDASLITVMQIHLREPPGDILLFLTGQEEIDTACEILYERMKTLGPDVPELIILPVYSALPSEMQTRIFEPAPPGSRKVVIATNIAETSLTIDGIYYVVDPGFVKQKVYNSKTGMDSLIVTPISQAAAKQRAGRAGRTGPGKCYRLYTERAYRDEMLPTPVPEIQRTNLATTVLQLKTMGINDLLHFDFMDAPPVESLIMALESLHSLSALDDEGLLTRLGRRMAEFPLEPNLSKMLIMSVHLQCSDEILTIVSMLSVQNVFYRPKDKQALADQKKAKFNQAEGDHLTLLAVYNSWRNNKFSNAWCYENFVQIRTLKRAQDVRKQLLGIMDRHKLDVVSAAKNTVRVQKAVCSGFFRNAAKKDPQEGYRTLVDSQVVYIHPSSALFNRQPEWVVYHELVQTTKEYMREVTTIDPKWLVEFAPAFFKFSDPTKLSKFKKNQRLEPLYNKYEEPNAWRISRVRRRRN

SEQ ID NO: 14941 - protein, 976 aa, Pyrenophora tritici-repentis Pt-1C-BFP; identical to SEQ ID NO: 12344

SEQ ID NO: 14942 - protein, 682 aa, Acyrthosiphon pisum
MSSFRFKNADEKPGYGEEDSNFESAISSSFVYNPYMSLDLQSQRNKLPITKYRNEVLYLCEKFQTLILVGSTGSGKSTQVSQMLLDSGLCQCDKSIVITEPRKISAITLATRVAQEQKTNLGQLVGYSVRFDNCCQPDTKIKYITEGILLNEMMSNPLLVNYSVIILDEIHERSLMTDILMGLIKKVLKKRPTLRLIILSATLDSSQLKSYFNLNQSNDPVNDTATVLGIEGRSYPTKIYYIKDPTPNYVDESINTVLKIQQGGTSGDILVFLTGKEEIMQAVNTLDDYNIKNSNEKIKLLPIPMHGTLTNDEQLKAFRPAPRGYRKVVFSTNVAETSVTISGIVHVIDCGFVKLKWFNSKFGADSLITVPISKASAIQRAGRAGRERPGKVYRLYTKEAYQNLINATPPEMMRSDLTDVTLQLKAIYINNVLRFPFLSPPPAKNLLYAMEMLKALEAIDKLGNLTDSFGTIMAELPLPAKHSRILLKSAEMGCSSEIISILAMLQLQDAFVRPKYGATIQKAKIQHRNFEVAEGDLLTLLNIYNGFEKNQYSQPWCHRFFINYNELCKARKIRSHLIDLMRTSKIPLKSCKGNTRIIVKSIASGLFKNAAYLHYTGVYRSVGLDEDLFFHPKSVLNYVNQPQWVLYDELLETTKTYIKNLVEITPSLLLEVAPHYFSTPTL

SEQ ID NO: 14943 - protein, 1434 aa, Drosophila grimshawi; identical to SEQ ID NO: 12032

SEQ ID NO: 14944 - protein, 682 aa, Drosophila virilis; identical to SEQ ID NO: 12346

SEQ ID NO: 14945 - protein, 654 aa, Toxoplasma gondii ME49
MLPATLASPAIFSALPPGATSQLSRGVLSAALSLFDGRRPTQRPANPLGSPANSQLQKSTKSRCLPAEWLAFSRAAVAWRRGEEVVALQFFPPRSAAPRSLRRTETLLTEQILGGDADTRAVPAAATGRSEESAALRFQDLLQAGRLSEASFKALSSLLGYDRLTNEQALLLPRLLPHRSADARSASETLSGLQGGDRGVVALSPEDRDRDSLIQARTGTGKTLCFLLAIIERLLLQPPSGVGALVIAPTRELATQILREAEQLVTFHPFDVAALVGGNSRKADELALKRKRPQILVCTPGRLLDHLENTFMFSALLERLQLLVLDEADRLMELGHLEELKQIFSYLPRTRQSLLFSATLPDNVRDLASRLFKQNYRFLNCVAPDEKPTHERVAQSVVMHAAKETATVLFNLLKEEFERRPHSYKIIVFFPTARLTSFFAALFREQFRIGVYEIHRRRESSARAATASRFSRDRAGVLFSSDVSARGVDYPDVSLVIQVCAPLTRELYIHRVGRTGRIEKEGRAVLLLNEAETRFLELIQDLPLQQRDAQSLQQRTAAVNAALSSWDTNAQLHYAATAAYASLLNHYKSGRTRLRVADDGLVIQTALDICASCGLSSQPAVSKKLATLLNLESHPKLKTQEDLDDINVLPEFLN

SEQ ID NO: 14946 - protein, 567 aa, Perkinsus marinus ATCC 50983; identical to SEQ ID NO: 12381

SEQ ID NO: 14947 - protein, 675 aa, Verticillium alfalfae VaMs.102; identical to SEQ ID NO: 12404

SEQ ID NO: 14948 - protein, 608 aa, Encephalitozoon intestinalis ATCC 50506; identical to SEQ ID NO: 11766

SEQ ID NO: 14949 - protein, 1203 aa, Nasonia vitripennis
MDEVQKLEHLSLVSKICTELENHLGFNDKDLAEFIIDLSEENNTFDSFKAVLIQKGAEFADSFIANLLRIIQHMKPKKVKENKPENSKQNDLAYKFPALALPNEEPANVVDNKNTNISDVVDDMLMQLDAKNLGGSKTSEKNERRSRSLDKDRTERKNRSNDDDSSVRSRKRKSSRSPRRKSSRSPRRRKSSRSPRRKQRKSSRSPRRRSSRSPRQKRESSRDESHSRKRSYSNTRSNFSEELKELEVGKIYTGKVANVVPFGCFVQLDGLRKRSEGLVHISQLRREGRVVNASDVVTRGEKVFVKVLNITGQKVSLSMKDVDQESGCDLNPNPVLSKREEDEQVLRNPDRPVSLLEFQANNDEDEVYSKKRVQRLSSPEKWEIKQMLAASCIDRSELPEFDTETGVLPREDDEEEDVEIELVEEEPPFLNGHGRALGDLSPVRIVKNPDGSLAQAAMMQSALAKERREQKMLQREQEIDSLPAGQHKNWIDPLPDADNSTSAAASMRGIGLQTQDLPEWKKHVIGGKKSSFGKKTNLSLIEQRQSLPIYKLKDDLVKAVTDNQILIVIGETGSGKTTQITQYLAEMGFTSRGKIGCTQPRRVAAMSVANRVAEEFGCRLGQEVGYTIRFEDCTGPETVIKYMTDGMLLRECLMDLDLKSYSVIMLDEAHERTIHTDVLFGLLKQAVGRRSDLKLIVTSATLDAVKFSQYFFKAPIFTIPGRTFEVEVMYTKEPETDYLDASLITVMQIHLREPPGDILLFLTGQEEIDTACEILYERMKTLGPDVPELIILPVYSALPSEMQTRIFEPAPPGSRKVVIATNIAETSLTIDGIYYVVDPGFVKQKVYNSKTGMDSLIVTPISQAAAKQRAGRAGRTGPGKCYRLYTERAYRDEMLPTPVPEIQRTNLATTVLQLKTMGINDLLHFDFMDAPPVESLIMALESLHSLSALDDEGLLTRLGRRMAEFPLEPNLSKMLIMSVHLQCSDEILTIVSMLSVQNVFYRPKDKQALADQKKAKFNQAEGDHLTLLAVYNSWRNNKFSNAWCYENFVQIRTLKRAQDVRKQLLGIMDRHKLDVVSAAKNTVRVQKAVCSGFFRNAAKKDPQEGYRTLVDSQVVYIHPSSALFNRQPEWVVYHELVQTTKEYMREVTTIDPKWLVEFAPAFFKFSDPTKLSKFKKNQRLEPLYNKYEEPNAWRISRVRRRRN

SEQ ID NO: 14950 - protein, 528 aa, Glycine max
MAVGQLVPSNLFLNHSAATTLIPTSTPPRHRHLLCISSANHTTATDNDSPFSSFGRVKTLLVHRRRKDQSHRRAVQLEDDNDDDIAPRPRRSQSRSRGGERWDMIPNYTPQSKSATDTKFFSLKSFKEIGCSEYMIESLQKLLLSRPSHVQAMAFAPVISGKTCVIADQSGSGKTLAYLAPIIQLLRLEELEGRSSKSSSQAPRVLVLAPTAELASQVLDNCRSLSKSGVPFKSMVVTGGFRQKTQLENLQQGVDVLIATPGRFLFLIHEGFLQLTNLRCAILDEVDILFGDEDFEVALQSLINSSPVDTQYLFVTATLPKNVYTKLVEVFPDCEMIMGPGMHRISSRLQEIIVDCSGEDGQEKTPDTAFLNKKTALLQLVEENPVPRTIVFCNKIETCRKVENLLKRFDRKGNHVQVLPFHAAMTQESRLASMEEFTRSPSKGVSQFMVCTDRASRGIDFTRVDHVILFDFPRDPSEYVRRVGRTARGAKGVGKAFIFVVGKQVSLARKIMERNQKGHPLHDVPSAY

SEQ ID NO: 14951 - protein, 530 aa, Glycine max; identical to SEQ ID NO: 12006

SEQ ID NO: 14952 - protein, 448 aa, Ichthyophthirius multifiliis; identical to SEQ ID NO: 12512

SEQ ID NO: 14953 - protein, 618 aa, Citrus clementina
MSQFWKPGTEKPRLLDDEEGGVVFLSSSLSSASSIGYGYASIEKQRQRLPVYKYRTAILYLVETHAATIIVGETGSGKTTQIPQYLKEAGWADGGRVIACTQPRRLAVQAVASRVAEEMGVKVGEEVGYTIRFEDFTNKDLTAIKFLTDGVLLREMMDDPLLTKYSVIMVDEAHERSISTDILLGLLKKIQRRRSDLRLIISSATIEAKSMSAFFHARKGRRGLEGVELVPRLEPAILSVEGRGFNVQIHYVEEPVSDYVQAAVSTVLLIHDKEPPGDILVFLTGQDDIDATIQLLTEEARTSKKNSSGLIILPLYSGLSRAEQEQVFSPTPRGKRKVVISTNIAETSLTLEGIVYVVDSGFSKQRFYNPISDIENLVVAPISKASARQRAGRAGRVRPGKCYRLYTEEYFVKEMPAEGIPEMQRSNLVSCVIQLKALGIDNILGFDWPASPPPEAMIRALEVLYSLGVLDDDAKLTSPTGFQVAEIPLEPMISKMILSSNELGCSEEIITISAVLSIQSIWVSGRGAQKELDEAKLRFAAAEGDHVTFLNVYKGFLQSGKSSHWCHKNFINYHAMKKVIEIREQLRRIAQRIGIVMKSCESDMQVSCTKGSYCWVFC

SEQ ID NO: 14954 - protein, 456 aa, Saccoglossus kowalevskii
MATLNDIVCSWENTFNRIKRSYNLHYHLKPEQIDVITHILRNENCLTVLPTGFGKSICYMLPPVLLNETISDKRHYGLIISPLRSLMYDQVRSCNAMGIKSCCITRKKDMDTETIEDIKKGLFTILFMSPEALLFIDSWRPISLQSKIYGDGVCLIAIDECHVLELWGDDFRPTYRMLGELRSHFSCSFLILTATCTNVMKRNILKQLYFGENEMQLVSKVPDRPNISLYYKFGSLSITEEMAWYLRELKSDGITARKAIIYVRTITQCGKVFANFMAYLGNAAYGDGSKVIQNRILEVYHGALASTDQERVVSRFSQDNVLRCIICTVAFGMGVNIPDLNIVVHWGCSNSIVEYWQEVGRARRNGDPAEAHLFPLPRTVLHVEDDMKSLCEQLKHSNIPCLRVHILEHLTIKGMNPHIIDEIKHRKSCDMKCECCVCLNCKCRTACKLKCPCRVN

SEQ ID NO: 14955 - protein, 456 aa, Saccoglossus kowalevskii
MATLNDIVCSWENTFNRIKRSYNLHYHLKPEQIDVITHILRNENCFAVLPTGFGKSICYMLPPVLLNETISDKRHYGLIISPLRSLMYDQVRSCNAMGIKSCCITRKKDMDTETIEGIKKGLFTLLFMSPEALLFIDSWRPILLQSKIYGDGVCLIAIDECHVLELWGDDFRPTYRMLGELRSHFSCSFLILTATCTNVMKRNILKQLYFGENEMQLVSKVPDRPNISLYYKFGSLSITEEMAWYLRELKSDGITARKAIIYVRTITQCGKVFANFMAYLGNAAYGDGSKVIQNRILEVYHGALASTDQERVVSRFSQDNVLRCIICTVAFGMGVNIPDLNIVVHWGCSNSIVEYWQEVGRARRNGDPAEAHLFPLPRTVLHVEDDMKSLCEQLKHSNIPCLRVHILEHLTIKGMNPHIIDEIKHRKSCDMKCECCVCLNCKCRTACKLKCPCRVN

SEQ ID NO: 14956 - protein, 1469 aa, Saccoglossus kowalevskii
MSSLTSDLTLNQIDEWFKIGAPPPKAETIPRSKLQGHYLDPTTGEAYQKRSKSFIPPYKRNPRDNNPKQTEYAQKYLEEERQRELRLMKSDTDLGLPILTTRSPGGLSDLDFATTSDVYETLGFPDQKPLELAAEVYKHYRFDHTYSPDLPITEFQDQIISTIESNQVTVIQGSTGSGKTTQVPQYILDHYASENRYVNIVVTQPRRIAAISIAKRVCAERGWQLGSLVGYQVALDRCITDDTRLTYLTTGVLLQKLINSKNMNMFTHVILDEVHERDQDSDFSLLVVRKLLRSTSRHVKIILMSATIESDLFAGYFSLPVRGKLESAPVVSVEGKAYDVTEYYLEDLRKFGQMPFLERDNPSVSPDAIYLARQLILEFDQLELKEQEERIDGFPANRGTVLVFLPGIYEINETFQALNDDVIRHRLWLLPLHSSITSEEQSQVFLKAEKGRRKIILATNIAESSITVTDIKYVIDFMLIKCLVCDPETNYQSLQLSWASKANATQRKGRAGRVSSGKVYRMITRDFWDRNIHDYGIPEMARCPLELLVLQVKILDLGEPKAILALALTPPNLDDIERTILLLKEVGALSTVTSGILNPHDGDLTFVGRVLASLPVDIKIGKLMVLGHVFGCLEECIIIGASLSLQSFFAQPFREYLNAYRSKMTWANDSFSDCIAMLNAYKMWEGCNWRGEFRRSGSAELTWCRKNMIQLKRIRKVAETVKELKERLANHNIKVPRHGPNLGHQQQQAKTPTNAAQDLLILKLVICGAFYPNYFQCGPPDEAEALRTLSGKDPTSTVMVKNVPPMGHLYKNQIAALFRTCGKGNKLYFEDTRCYIEFERPREIKEQSILPAVYLAVKMRHLRTRLELQLTEISAADQKMLNTHTLRPENKLRTNRLGVLCEDPADGSNKIRLVTDNGNEPKQVDLPAAGNNWIDIFVTEVVDANHFWAHYGDAVTFQNLRNLMDTLNQYDGIHLKPIVDACKGQICLAPYMEDKQKFYRARIDSLHGDAVEVFFVDYGNVDVVPRKNLREVPSDLLKLPFQAFECVLSGIKPYYLLPDSKWMPQAKQKLIEVVSDKIMFAKIYSVVRNCLRIELFDTTRNPQVNINELMIKLEFAEKCEEPYSSRVNHEQREEASIETSIDEQLVEIPQETVLRVIQQGRRKGRVFLHGPFSPYEMNFYPMTQVGRFRCIFLEPGSVNSVALNSEPQDKHERMMVSALVSVNSSGTALMARDTSLMPNIHGLAAIVSMLFAPAIELRTDPQKRRYTGVLCGLGWDPDSNGAALPDHDMEITFDANITTDDISMINGVRMAINIAVGSEDAIAEWGPAAIFRIQKSAREKLLRLIMKRRELVTPYNYERPYRWNMVNPDDILPHELEGTKADCPVLYQLFDAIAVSGDLEASEEDSDRREKMIAHLRDLKERAGRSIASDPVYCQLCEALLHSPKDLLLHMETEKHQTKERHVYHPQCF

SEQ ID NO: 14957 - protein, 1140 aa, Amborella trichopoda; identical to SEQ ID NO: 13223

SEQ ID NO: 14958 - protein, 593 aa, Debaryomyces hansenii CBS767; identical to SEQ ID NO: 12082

SEQ ID NO: 14959 - protein, 901 aa, Plasmodium yoelii yoelii 17XNL; identical to SEQ ID NO: 12305

SEQ ID NO: 14960 - protein, 750 aa, Leptospira interrogans serovar Copenhageni str. Fiocruz L1-130; identical to SEQ ID NO: 11551

SEQ ID NO: 14961 - protein, 834 aa, Methanocorpusculum labreanum Z; identical to SEQ ID NO: 11588

SEQ ID NO: 14962 - protein, 750 aa, Ruminiclostridium thermocellum ATCC 27405; identical to SEQ ID NO: 11589

SEQ ID NO: 14963 - protein, 800 aa, Ruminiclostridium thermocellum ATCC 27405; identical to SEQ ID NO: 11590

SEQ ID NO: 14964 - protein, 577 aa, Staphylothermus marinus F1; identical to SEQ ID NO: 11591

SEQ ID NO: 14965 - protein, 802 aa, Clostridioides difficile 630; identical to SEQ ID NO: 12087

SEQ ID NO: 14966 - protein, 773 aa, Clostridioides difficile 630; identical to SEQ ID NO: 12088

SEQ ID NO: 14967 - protein, 820 aa, Methanococcus maripaludis C5; identical to SEQ ID NO: 11592

SEQ ID NO: 14968 - protein, 783 aa, Desulfotomaculum reducens MI-1; identical to SEQ ID NO: 11593

SEQ ID NO: 14969 - protein, 731 aa, Desulfotomaculum reducens MI-1; identical to SEQ ID NO: 11594

SEQ ID NO: 14970 - protein, 484 aa, Pyrobaculum arsenaticum DSM 13514; identical to SEQ ID NO: 11595

SEQ ID NO: 14971 - protein, 745 aa, Pseudomonas stutzeri A1501; identical to SEQ ID NO: 11598

SEQ ID NO: 14972 - protein, 908 aa, Caldicellulosiruptor saccharolyticus DSM 8903; identical to SEQ ID NO: 11596

SEQ ID NO: 14973 - protein, 777 aa, Caldicellulosiruptor saccharolyticus DSM 8903; identical to SEQ ID NO: 11597

SEQ ID NO: 14974 - protein, 885 aa, Pseudomonas mendocina ymp; identical to SEQ ID NO: 11599

SEQ ID NO: 14975 - protein, 492 aa, Metallosphaera sedula DSM 5348; identical to SEQ ID NO: 11600

SEQ ID NO: 14976 - protein, 805 aa, Pelotomaculum thermopropionicum SI; identical to SEQ ID NO: 12043

SEQ ID NO: 14977 - protein, 738 aa, Pelotomaculum thermopropionicum SI; identical to SEQ ID NO: 12044

SEQ ID NO: 14978 - protein, 701 aa, Acidiphilium cryptum JF-5; identical to SEQ ID NO: 11601

SEQ ID NO: 14979 - protein, 763 aa, Thermotoga petrophila RKU-1; identical to SEQ ID NO: 11602

SEQ ID NO: 14980 - protein, 927 aa, Roseiflexus sp. RS-1; identical to SEQ ID NO: 11603

SEQ ID NO: 14981 - protein, 783 aa, Roseiflexus sp. RS-1; identical to SEQ ID NO: 11604

SEQ ID NO: 14982 - protein, 904 aa, Roseiflexus sp. RS-1; identical to SEQ ID NO: 11605

SEQ ID NO: 14983 - protein, 798 aa, Alkaliphilus metalliredigens QYMF; identical to SEQ ID NO: 11606

SEQ ID NO: 14984 - protein, 743 aa, Alkaliphilus metalliredigens QYMF; identical to SEQ ID NO: 11607

SEQ ID NO: 14985 - protein, 765 aa, Methanococcus vannielii SB; identical to SEQ ID NO: 11608

SEQ ID NO: 14986 - protein, 772 aa, Methanococcus aeolicus Nankai-3; identical to SEQ ID NO: 11609

SEQ ID NO: 14987 - protein, 811 aa, Actinobacillus succinogenes 130Z; identical to SEQ ID NO: 11610

SEQ ID NO: 14988 - protein, 741 aa, Bacillus cytotoxicus NVH 391-98; identical to SEQ ID NO: 11611

SEQ ID NO: 14989 - protein, 792 aa, Campylobacter hominis ATCC BAA-381; identical to SEQ ID NO: 11612

SEQ ID NO: 14990 - protein, 800 aa, Fervidobacterium nodosum Rt17-B1; identical to SEQ ID NO: 11613

SEQ ID NO: 14991 - protein, 859 aa, Roseiflexus castenholzii DSM 13941; identical to SEQ ID NO: 11614

SEQ ID NO: 14992 - protein, 779 aa, Roseiflexus castenholzii DSM 13941; identical to SEQ ID NO: 11615

SEQ ID NO: 14993 - protein, 543 aa, Ignicoccus hospitalis KIN4/I; identical to SEQ ID NO: 11616

SEQ ID NO: 14994 - protein, 733 aa, Campylobacter concisus 13826; identical to SEQ ID NO: 12313

SEQ ID NO: 14995 - protein, 744 aa, Thermotoga lettingae TMO; identical to SEQ ID NO: 11617

SEQ ID NO: 14996 - protein, 733 aa, Acaryochloris marina MBIC11017; identical to SEQ ID NO: 11620

SEQ ID NO: 14997 - protein, 929 aa, Salinispora arenicola CNS-205; identical to SEQ ID NO: 11618

SEQ ID NO: 14998 - protein, 582 aa, Caldivirga maquilingensis IC-167; identical to SEQ ID NO: 11619

SEQ ID NO: 14999 - protein, 804 aa, Herpetosiphon aurantiacus DSM 785; identical to SEQ ID NO: 11621

SEQ ID NO: 15000 - protein, 730 aa, Petrotoga mobilis SJ95; identical to SEQ ID NO: 11623

SEQ ID NO: 15001 - protein, 844 aa, Lactobacillus helveticus DPC 4571; identical to SEQ ID NO: 11622

SEQ ID NO: 15002 - protein, 782 aa, Gluconacetobacter diazotrophicus PA1 5; identical to SEQ ID NO: 11652

SEQ ID NO: 15003 - protein, 899 aa, Gluconacetobacter diazotrophicus PA1 5; identical to SEQ ID NO: 12093

SEQ ID NO: 15004 - protein, 823 aa, Sorangium cellulosum So ce56; identical to SEQ ID NO: 14083

SEQ ID NO: 15005 - protein, 801 aa, Chloroflexus aurantiacus J-10-fl; identical to SEQ ID NO: 11624

SEQ ID NO: 15006 - protein, 784 aa, Chloroflexus aurantiacus J-10-fl; identical to SEQ ID NO: 11625

SEQ ID NO: 15007 - protein, 907 aa, Microcystis aeruginosa NIES-843; identical to SEQ ID NO: 12045

SEQ ID NO: 15008 - protein, 778 aa, Thermoanaerobacter sp. X514; identical to SEQ ID NO: 11626

SEQ ID NO: 15009 - protein, 784 aa, Thermoanaerobacter pseudethanolicus ATCC 33223; identical to SEQ ID NO: 11627

SEQ ID NO: 15010 - protein, 754 aa, Heliobacterium modesticaldum Ice1; identical to SEQ ID NO: 11628

SEQ ID NO: 15011 - protein, 837 aa, Heliobacterium modesticaldum Ice1; identical to SEQ ID NO: 11629

SEQ ID NO: 15012 - protein, 795 aa, Candidatus Desulforudis audaxviator MP104C; identical to SEQ ID NO: 11631

SEQ ID NO: 15013 - protein, 763 aa, Synechococcus sp. PCC 7002; identical to SEQ ID NO: 11632

SEQ ID NO: 15014 - protein, 564 aa, Candidatus Korarchaeum cryptofilum OPF8; identical to SEQ ID NO: 11633

SEQ ID NO: 15015 - protein, 803 aa, Candidatus Cloacimonas acidaminovorans str. Evry; identical to SEQ ID NO: 12091

SEQ ID NO: 15016 - protein, 443 aa, Ureaplasma parvum serovar 3 str. ATCC 27815; identical to SEQ ID NO: 11529

SEQ ID NO: 15017 - protein, 794 aa, Leptothrix cholodnii SP-6; identical to SEQ ID NO: 11634

SEQ ID NO: 15018 - protein, 491 aa, Pyrobaculum neutrophilum V24Sta; identical to SEQ ID NO: 11635

SEQ ID NO: 15019 - protein, 566 aa, Pyrobaculum neutrophilum V24Sta; identical to SEQ ID NO: 11636

SEQ ID NO: 15020 - protein, 773 aa, Exiguobacterium sibiricum 255-15; identical to SEQ ID NO: 11637

SEQ ID NO: 15021 - protein, 722 aa, Xanthomonas oryzae pv. oryzae PXO99A; identical to SEQ ID NO: 11638

SEQ ID NO: 15022 - protein, 706 aa, Porphyromonas gingivalis ATCC 33277; identical to SEQ ID NO: 12046

SEQ ID NO: 15023 - protein, 729 aa, Sulfurihydrogenibium sp. YO3AOP1; identical to SEQ ID NO: 11639

SEQ ID NO: 15024 - protein, 906 aa, Geobacter lovleyi SZ; identical to SEQ ID NO: 11640

SEQ ID NO: 15025 - protein, 594 aa, Chlorobium phaeobacteroides BS1; identical to SEQ ID NO: 11641

SEQ ID NO: 15026 - protein, 634 aa, Fritillary virus Y
SLDEIQNLDDDKKLTIDFDLETSAESSSVSFDVRFEDWWDRQLQQNRVVPHYRSVGEFMEFTRETAAMVANQIAISNSTEFLVRGAAGSGKSTGLPHHLSKKGKVLLLEPTRPLAENVSKQLSGDPFLQNVTLRMRGLSKYGSSNITVMTSGYAFHYYVNNPTQLCNFDYIIIDECHVLDSPTIAFNCALKEYEFPGKLLKVSATPPGRECEFKTQHPVKLKVEEHLSFQHFVQAQGTGSNADMTQHGNNLLVYVASYNEVDQLSKMLTERHFKVTKVDGRTMQMGNVEIITTGSEGKPHFVVATNIIENGVTLDIDCVIDFGLKVVAELDSDNRCVRYAKKPVTYGERIQRLGRVGRCKPGFALRVGHTEKGIEEIPEFIATEAAFLSFSYGLPVTTQGVSTNILSKCTVKQAKVALNFEITPFFTTHFIKYDGSMHPEIHRLMKPYKLRESEMLLSKLAIPYQFTNQWLTAKEYERMGVHLHCDDKVRIPFYVNGIPDKLFETLWDTVCKFKCDAGFGRLSSENAAKISYTLSAESGAIPRTIAIIDHLLSEEMMKKSHYDTLSSSVTGYSCSLAGVVSGFRKRYLRDHTQHNIAILQQARAQLLEFNCSSVDLIKLQNLDGLGILHAVQLQ

SEQ ID NO: 15027 - protein, 723 aa, Chloroherpeton thalassium ATCC 35110; identical to SEQ ID NO: 11642

SEQ ID NO: 15028 - protein, 860 aa, Prosthecochloris aestuarii DSM 271; identical to SEQ ID NO: 11643

SEQ ID NO: 15029 - protein, 888 aa, Anaeromyxobacter sp. K; identical to SEQ ID NO: 11644

SEQ ID NO: 15030 - protein, 828 aa, Borrelia duttonii Ly; identical to SEQ ID NO: 11645

SEQ ID NO: 15031 - protein, 828 aa, Borrelia recurrentis A1; identical to SEQ ID NO: 11646

SEQ ID NO: 15032 - protein, 543 aa, Thermodesulfovibrio yellowstonii DSM 11347; identical to SEQ ID NO: 11650

SEQ ID NO: 15033 - protein, 728 aa, Thermodesulfovibrio yellowstonii DSM 11347; identical to SEQ ID NO: 11649

SEQ ID NO: 15034 - protein, 755 aa, Dictyoglomus thermophilum H-6-12; identical to SEQ ID NO: 11648

SEQ ID NO: 15035 - protein, 801 aa, Dictyoglomus thermophilum H-6-12; identical to SEQ ID NO: 11647

SEQ ID NO: 15036 - protein, 897 aa, Gluconacetobacter diazotrophicus PA1 5; identical to SEQ ID NO: 11651

SEQ ID NO: 15037 - protein, 782 aa, Gluconacetobacter diazotrophicus PA1 5; identical to SEQ ID NO: 11652

SEQ ID NO: 15038 - protein, 726 aa, Anoxybacillus flavithermus WK1; identical to SEQ ID NO: 11653

SEQ ID NO: 15039 - protein, 801 aa, Thermosipho africanus TCF52B; identical to SEQ ID NO: 11654

SEQ ID NO: 15040 - protein, 784 aa, Dictyoglomus turgidum DSM 6724; identical to SEQ ID NO: 11655

SEQ ID NO: 15041 - protein, 876 aa, Thauera sp. MZ1T; identical to SEQ ID NO: 11656

SEQ ID NO: 15042 - protein, 851 aa, Desulfatibacillum alkenivorans AK-01; identical to SEQ ID NO: 11657

SEQ ID NO: 15043 - protein, 740 aa, Desulfovibrio vulgaris str. 'Miyazaki F'; identical to SEQ ID NO: 11658

SEQ ID NO: 15044 - protein, 805 aa, Desulfitobacterium hafniense DCB-2; identical to SEQ ID NO: 11660

SEQ ID NO: 15045 - protein, 781 aa, Chloroflexus aggregans DSM 9485; identical to SEQ ID NO: 11661

SEQ ID NO: 15046 - protein, 799 aa, Chloroflexus aggregans DSM 9485; identical to SEQ ID NO: 11662

SEQ ID NO: 15047 - protein, 892 aa, Methanosphaerula palustris E1-9c
MKTGSDNYYSYWGKAQREGEPEKGAGYHLLVYHCLDVAAVGQKLLEQDPLLMHRFTALTGFNDDQVLHLIPFLLALHDLGKFSDRFQNLKPDLMELLQGNRGSRRYPIRHDSMALYLFEQDIRDLAWKKNWFWMDHDLPYAEDEWFEIFAPLFRAVSGHHGEPPQHDETVSVDSLFLDGDRAAARDFAVQAATLLLGSGSYPPIEYSEGWFEQFSTASWLLAGLVTLSDWLGSNRTFFPFQTEAMDLAVYWKNFAQKGAEDAVRDAGVLPATVSSNCGMAGLFPPDLPPKITSPSPIQTYLSSCSLTPEPRLTIIEETTGGGKTEAALVLAHRLMNYGCGEGIFMGLPTMATADSLYGRIAQTYQRMYTGDQRASVVLATSARDLSDLFKKSVLPPGQWSHEQYKPGEETASATCTIWLAQNRKKALLAQVGVGTIDQALMAVLPFRHQSLRLLGLARNILIVDEVHAYDPYMHTVLCGLLKFQAAFGGSAILLSATLTMAQRQDLTSAFCAGLGRRAKTLTDETYPLITMATAQDVTETPIDSSAARVRTVRVQMVDDSADVLEQIVRAAGDGRCVCWVRNTIDDAINAFNELNTRLESRQVLLFHARFALGDRLDIEKKVLDTFGKESLDPIRRGMVLVATQVVEQSLDLDFDLMITDLAPMDLIIQRAGRLHRHPRGDRGEAVMVVLAPPLTRTPDPDWYKRVFPKGGYVYPNHGQLWLTAQLLDTKGKIVMPDGARDLIEGVFGDGAQIRIPLSLLPREVLVDGKKRGDISIARLNTLEVSDGYRRTPTQWVEEAHVSTRLGQLTSTLVLARWDGTTLTPWYSSNQNAWDLSQVHIAEKKVASAAVFEGELGAAVKRLEDQIPGLGKWLILVPLSCTSAGTWEGPARN

SEQ ID NO: 15048 - protein, 860 aa, Desulfovibrio desulfuricans subsp. desulfuricans str. ATCC 27774; identical to SEQ ID NO: 11663

SEQ ID NO: 15049 - protein, 887 aa, Anaeromyxobacter dehalogenans 2CP-1; identical to SEQ ID NO: 11665

SEQ ID NO: 15050 - protein, 783 aa, Methylobacterium nodulans ORS 2060; identical to SEQ ID NO: 11664

SEQ ID NO: 15051 - protein, 728 aa, Clostridium cellulolyticum H10; identical to SEQ ID NO: 11666

SEQ ID NO: 15052 - protein, 773 aa, Thermomicrobium roseum DSM 5159; identical to SEQ ID NO: 11667

SEQ ID NO: 15053 - protein, 801 aa, Chloroflexus sp. Y-400-fl; identical to SEQ ID NO: 11624

SEQ ID NO: 15054 - protein, 784 aa, Chloroflexus sp. Y-400-fl; identical to SEQ ID NO: 11625

SEQ ID NO: 15055 - protein, 775 aa, Caldicellulosiruptor bescii DSM 6725; identical to SEQ ID NO: 11670

SEQ ID NO: 15056 - protein, 753 aa, Desulfobacterium autotrophicum HRM2; identical to SEQ ID NO: 11671

SEQ ID NO: 15057 - protein, 755 aa, Sulfurihydrogenibium azorense Az-Fu1; identical to SEQ ID NO: 11672

SEQ ID NO: 15058 - protein, 762 aa, Sulfurihydrogenibium azorense Az-Fu1; identical to SEQ ID NO: 11673

SEQ ID NO: 15059 - protein, 771 aa, Acidobacterium capsulatum ATCC 51196; identical to SEQ ID NO: 11674

SEQ ID NO: 15060 - protein, 661 aa, Azotobacter vinelandii DJ; identical to SEQ ID NO: 11675

SEQ ID NO: 15061 - protein, 548 aa, Sulfolobus islandicus M.14.25; identical to SEQ ID NO: 11677

SEQ ID NO: 15062 - protein, 501 aa, Sulfolobus islandicus M.14.25; identical to SEQ ID NO: 11678

SEQ ID NO: 15063 - protein, 501 aa, Sulfolobus islandicus L.S.2.15; identical to SEQ ID NO: 11676

SEQ ID NO: 15064 - protein, 501 aa, Sulfolobus islandicus Y.G.57.14; identical to SEQ ID NO: 11679

SEQ ID NO: 15065 - protein, 501 aa, Sulfolobus islandicus Y.N.15.51; identical to SEQ ID NO: 11680

SEQ ID NO: 15066 - protein, 548 aa, Sulfolobus islandicus M.16.27; identical to SEQ ID NO: 11677

SEQ ID NO: 15067 - protein, 501 aa, Sulfolobus islandicus M.16.27; identical to SEQ ID NO: 11682

SEQ ID NO: 15068 - protein, 472 aa, Exiguobacterium sp. AT1b; identical to SEQ ID NO: 11683

SEQ ID NO: 15069 - protein, 501 aa, Sulfolobus islandicus M.16.4; identical to SEQ ID NO: 11685

SEQ ID NO: 15070 - protein, 704 aa, Eubacterium rectale ATCC 33656; identical to SEQ ID NO: 11686

SEQ ID NO: 15071 - protein, 726 aa, Geobacillus sp. WCH70; identical to SEQ ID NO: 11687

SEQ ID NO: 15072 - protein, 768 aa, Desulfovibrio magneticus RS-1; identical to SEQ ID NO: 12047

SEQ ID NO: 15073 - protein, 667 aa, Thermococcus gammatolerans EJ3; identical to SEQ ID NO: 11688

SEQ ID NO: 15074 - protein, 772 aa, Methylobacterium extorquens AM1; identical to SEQ ID NO: 11689

SEQ ID NO: 15075 - protein, 733 aa, Thermococcus sibiricus MM 739; identical to SEQ ID NO: 11690

SEQ ID NO: 15076 - protein, 871 aa, Dickeya zeae Ech1591; identical to SEQ ID NO: 11693

SEQ ID NO: 15077 - protein, 763 aa, Aggregatibacter aphrophilus NJ8700; identical to SEQ ID NO: 11691

SEQ ID NO: 15078 - protein, 698 aa, Paenibacillus sp. JDR-2; identical to SEQ ID NO: 11692

SEQ ID NO: 15079 - protein, 743 aa, Geobacter sp. M21; identical to SEQ ID NO: 11694

SEQ ID NO: 15080 - protein, 818 aa, Teredinibacter turnerae T7901; identical to SEQ ID NO: 11684

SEQ ID NO: 15081 - protein, 549 aa, Methanocaldococcus fervens AG86; identical to SEQ ID NO: 11697

SEQ ID NO: 15082 - protein, 787 aa, Methanocaldococcus fervens AG86; identical to SEQ ID NO: 11698

SEQ ID NO: 15083 - protein, 832 aa, Saccharomonospora viridis DSM 43017; identical to SEQ ID NO: 11695

SEQ ID NO: 15084 - protein, 914 aa, Cyanothece sp. PCC 8802; identical to SEQ ID NO: 11696

SEQ ID NO: 15085 - protein, 804 aa, Leptotrichia buccalis C-1013-b; identical to SEQ ID NO: 11701

SEQ ID NO: 15086 - protein, 871 aa, Candidatus Accumulibacter phosphatis clade IIA str. UW-1; identical to SEQ ID NO: 11699

SEQ ID NO: 15087 - protein, 711 aa, Candidatus Accumulibacter phosphatis clade IIA str. UW-1; identical to SEQ ID NO: 11700

SEQ ID NO: 15088 - protein, 856 aa, Halomicrobium mukohataei DSM 12286; identical to SEQ ID NO: 11702

SEQ ID NO: 15089 - protein, 1120 aa, Atopobium parvulum DSM 20469; identical to SEQ ID NO: 11703

SEQ ID NO: 15090 - protein, 732 aa, Eggerthella lenta DSM 2243; identical to SEQ ID NO: 11704

SEQ ID NO: 15091 - protein, 801 aa, Desulfotomaculum acetoxidans DSM 771; identical to SEQ ID NO: 11705

SEQ ID NO: 15092 - protein, 762 aa, Desulfotomaculum acetoxidans DSM 771; identical to SEQ ID NO: 11706

SEQ ID NO: 15093 - protein, 836 aa, Desulfotomaculum acetoxidans DSM 771; identical to SEQ ID NO: 11707

SEQ ID NO: 15094 - protein, 802 aa, Peptoclostridium difficile CD196; identical to SEQ ID NO: 12097

SEQ ID NO: 15095 - protein, 773 aa, Peptoclostridium difficile CD196; identical to SEQ ID NO: 12098

SEQ ID NO: 15096 - protein, 661 aa, Peptoclostridium difficile CD196; identical to SEQ ID NO: 12099

SEQ ID NO: 15097 - protein, 802 aa, Clostridioides difficile R20291; identical to SEQ ID NO: 12097

SEQ ID NO: 15098 - protein, 773 aa, Clostridioides difficile R20291; identical to SEQ ID NO: 12098

SEQ ID NO: 15099 - protein, 661 aa, Clostridioides difficile R20291; identical to SEQ ID NO: 12099

SEQ ID NO: 15100 - protein, 746 aa, Zymomonas mobilis subsp. mobilis NCIMB 11163; identical to SEQ ID NO: 11708

SEQ ID NO: 15101 - protein, 821 aa, Ammonifex degensii KC4; identical to SEQ ID NO: 11709

SEQ ID NO: 15102 - protein, 768 aa, Aggregatibacter actinomycetemcomitans D11S-1; identical to SEQ ID NO: 11710

SEQ ID NO: 15103 - protein, 753 aa, Halothiobacillus neapolitanus c2; identical to SEQ ID NO: 11712

SEQ ID NO: 15104 - protein, 791 aa, Rhodothermus marinus DSM 4252; identical to SEQ ID NO: 11713

SEQ ID NO: 15105 - protein, 933 aa, Thermomonospora curvata DSM 43183; identical to SEQ ID NO: 11714

SEQ ID NO: 15106 - protein, 694 aa, Thermomonospora curvata DSM 43183; identical to SEQ ID NO: 11715

SEQ ID NO: 15107 - protein, 965 aa, Thermomonospora curvata DSM 43183; identical to SEQ ID NO: 11716

SEQ ID NO: 15108 - protein, 737 aa, Sulfurospirillum deleyianum DSM 6946; identical to SEQ ID NO: 11717

SEQ ID NO: 15109 - protein, 858 aa, Thermobaculum terrenum ATCC BAA-798; identical to SEQ ID NO: 11718

SEQ ID NO: 15110 - protein, 847 aa, Bifidobacterium dentium Bd1; identical to SEQ ID NO: 11719

SEQ ID NO: 15111 - protein, 763 aa, Xanthomonas albilineans GPE PC73; identical to SEQ ID NO: 12096

SEQ ID NO: 15112 - protein, 762 aa, Spirosoma linguale DSM 74; identical to SEQ ID NO: 11720

SEQ ID NO: 15113 - protein, 728 aa, Acidaminococcus fermentans DSM 20731; identical to SEQ ID NO: 11721

SEQ ID NO: 15114 - protein, 507 aa, Sulfolobus islandicus L.D.8.5; identical to SEQ ID NO: 11722

SEQ ID NO: 15115 - protein, 941 aa, Methanobrevibacter ruminantium M1; identical to SEQ ID NO: 11723

SEQ ID NO: 15116 - protein, 768 aa, Hydrogenobacter thermophilus TK-6; identical to SEQ ID NO: 11770

SEQ ID NO: 15117 - protein, 542 aa, Ferroglobus placidus DSM 10642; identical to SEQ ID NO: 11724

SEQ ID NO: 15118 - protein, 787 aa, Methanocaldococcus sp. FS406-22; identical to SEQ ID NO: 11725

SEQ ID NO: 15119 - protein, 549 aa, Methanocaldococcus sp. FS406-22; identical to SEQ ID NO: 11726

SEQ ID NO: 15120 - protein, 892 aa, Dehalococcoides mccartyi GT; identical to SEQ ID NO: 11727

SEQ ID NO: 15121 - protein, 568 aa, Thermocrinis albus DSM 14484; identical to SEQ ID NO: 11728

SEQ ID NO: 15122 - protein, 778 aa, Deferribacter desulfuricans SSM1; identical to SEQ ID NO: 12049

SEQ ID NO: 15123 - protein, 801 aa, Deferribacter desulfuricans SSM1; identical to SEQ ID NO: 12050

SEQ ID NO: 15124 - protein, 730 aa, Nitrosococcus halophilus Nc 4; identical to SEQ ID NO: 11730

SEQ ID NO: 15125 - protein, 937 aa, Haloferax volcanii DS2; identical to SEQ ID NO: 11729

SEQ ID NO: 15126 - protein, 760 aa, Aminobacterium colombiense DSM 12261; identical to SEQ ID NO: 11731

SEQ ID NO: 15127 - protein, 754 aa, Rhodobacter capsulatus SB 1003; identical to SEQ ID NO: 11732

SEQ ID NO: 15128 - protein, 853 aa, Kyrpidia tusciae DSM 2912; identical to SEQ ID NO: 11733

SEQ ID NO: 15129 - protein, 806 aa, Kyrpidia tusciae DSM 2912; identical to SEQ ID NO: 11734

SEQ ID NO: 15130 - protein, 750 aa, Methanocaldococcus infernus ME; identical to SEQ ID NO: 11735

SEQ ID NO: 15131 - protein, 992 aa, Legionella pneumophila 2300/99 Alcoy; identical to SEQ ID NO: 11736

SEQ ID NO: 15132 - protein, 733 aa, Thiomonas arsenitoxydans; identical to SEQ ID NO: 12095

SEQ ID NO: 15133 - protein, 764 aa, Brachyspira murdochii DSM 12563; identical to SEQ ID NO: 11737

SEQ ID NO: 15134 - protein, 735 aa, Thermincola potens JR; identical to SEQ ID NO: 11738

SEQ ID NO: 15135 - protein, 746 aa, Thermincola potens JR; identical to SEQ ID NO: 11739

SEQ ID NO: 15136 - protein, 604 aa, Thermosphaera aggregans DSM 11486; identical to SEQ ID NO: 11741

SEQ ID NO: 15137 - protein, 968 aa, Thermobispora bispora DSM 43833; identical to SEQ ID NO: 11740

SEQ ID NO: 15138 - protein, 738 aa, Arcobacter nitrofigilis DSM 7299; identical to SEQ ID NO: 11742

SEQ ID NO: 15139 - protein, 725 aa, Geobacillus sp. C56-T3; identical to SEQ ID NO: 11752

SEQ ID NO: 15140 - protein, 777 aa, Thermoanaerobacter mathranii subsp. mathranii str. A3; identical to SEQ ID NO: 11743

SEQ ID NO: 15141 - protein, 784 aa, Thermoanaerobacter mathranii subsp. mathranii str. A3; identical to SEQ ID NO: 11744

SEQ ID NO: 15142 - protein, 1084 aa, Meiothermus silvanus DSM 9946; identical to SEQ ID NO: 11745

SEQ ID NO: 15143 - protein, 850 aa, Meiothermus silvanus DSM 9946; identical to SEQ ID NO: 11746

SEQ ID NO: 15144 - protein, 747 aa, Starkeya novella DSM 506; identical to SEQ ID NO: 11747

SEQ ID NO: 15145 - protein, 881 aa, Arcanobacterium haemolyticum DSM 20595; identical to SEQ ID NO: 11748

SEQ ID NO: 15146 - protein, 760 aa, Syntrophothermus lipocalidus DSM 12680; identical to SEQ ID NO: 11749

SEQ ID NO: 15147 - protein, 724 aa, Syntrophothermus lipocalidus DSM 12680; identical to SEQ ID NO: 11750

SEQ ID NO: 15148 - protein, 772 aa, Truepera radiovictrix DSM 17093; identical to SEQ ID NO: 11751

SEQ ID NO: 15149 - protein, 881 aa, Methanococcus voltae A3; identical to SEQ ID NO: 11753

SEQ ID NO: 15150 - protein, 911 aa, Ralstonia solanacearum CFBP2957; identical to SEQ ID NO: 12104

SEQ ID NO: 15151 - protein, 759 aa, Amycolatopsis mediterranei U32; identical to SEQ ID NO: 11754

SEQ ID NO: 15152 - protein, 425 aa, Leuconostoc gelidum subsp. gasicomitatum LMG 18811; identical to SEQ ID NO: 12112

SEQ ID NO: 15153 - protein, 741 aa, Spirochaeta smaragdinae DSM 11293; identical to SEQ ID NO: 11756

SEQ ID NO: 15154 - protein, 910 aa, gamma proteobacterium HdN1; identical to SEQ ID NO: 12111

SEQ ID NO: 15155 - protein, 811 aa, Thermosediminibacter oceani DSM 16646; identical to SEQ ID NO: 11757

SEQ ID NO: 15156 - protein, 777 aa, Caldicellulosiruptor obsidiansis OB47; identical to SEQ ID NO: 11758

SEQ ID NO: 15157 - protein, 823 aa, Caldicellulosiruptor obsidiansis OB47; identical to SEQ ID NO: 11759

SEQ ID NO: 15158 - protein, 722 aa, Clostridium cellulovorans 743B; identical to SEQ ID NO: 11760

SEQ ID NO: 15159 - protein, 705 aa, Clostridium cellulovorans 743B; identical to SEQ ID NO: 11761

SEQ ID NO: 15160 - protein, 788 aa, Thermoanaerobacterium thermosaccharolyticum DSM 571; identical to SEQ ID NO: 11762

SEQ ID NO: 15161 - protein, 803 aa, Thermoanaerobacterium thermosaccharolyticum DSM 571; identical to SEQ ID NO: 11763

SEQ ID NO: 15162 - protein, 706 aa, Parvularcula bermudensis HTCC2503; identical to SEQ ID NO: 11764

SEQ ID NO: 15163 - protein, 782 aa, Parvularcula bermudensis HTCC2503; identical to SEQ ID NO: 11765

SEQ ID NO: 15164 - protein, 769 aa, Spirochaeta thermophila DSM 6192; identical to SEQ ID NO: 11767

SEQ ID NO: 15165 - protein, 572 aa, Vulcanisaeta distributa DSM 14429; identical to SEQ ID NO: 11768

SEQ ID NO: 15166 - protein, 778 aa, Thermoanaerobacter sp. X513; identical to SEQ ID NO: 11626

SEQ ID NO: 15167 - protein, 810 aa, Gardnerella vaginalis ATCC 14019; identical to SEQ ID NO: 11771

SEQ ID NO: 15168 - protein, 726 aa, Geobacillus sp. Y4.1MC1; identical to SEQ ID NO: 11773

SEQ ID NO: 15169 - protein, 827 aa, Geobacillus sp. Y4.1MC1; identical to SEQ ID NO: 11774

SEQ ID NO: 15170 - protein, 777 aa, Caldicellulosiruptor hydrothermalis 108; identical to SEQ ID NO: 11778

SEQ ID NO: 15171 - protein, 819 aa, Halanaerobium hydrogeniformans; identical to SEQ ID NO: 11779

SEQ ID NO: 15172 - protein, 1070 aa, Bifidobacterium longum subsp. longum BBMN68; identical to SEQ ID NO: 11776

SEQ ID NO: 15173 - protein, 914 aa, Caldicellulosiruptor owensensis OL; identical to SEQ ID NO: 11777

SEQ ID NO: 15174 - protein, 743 aa, Rhodomicrobium vannielii ATCC 17100; identical to SEQ ID NO: 11772

SEQ ID NO: 15175 - protein, 912 aa, Caldicellulosiruptor kronotskyensis 2002; identical to SEQ ID NO: 11782

SEQ ID NO: 15176 - protein, 777 aa, Caldicellulosiruptor kristjanssonii I77R1B; identical to SEQ ID NO: 11780

SEQ ID NO: 15177 - protein, 822 aa, Caldicellulosiruptor kristjanssonii I77R1B; identical to SEQ ID NO: 11781

SEQ ID NO: 15178 - protein, 761 aa, Neisseria lactamica 020-06; identical to SEQ ID NO: 12114

SEQ ID NO: 15179 - protein, 768 aa, Calditerrivibrio nitroreducens DSM 19672; identical to SEQ ID NO: 11783

SEQ ID NO: 15180 - protein, 758 aa, Thermococcus barophilus MP; identical to SEQ ID NO: 11784

SEQ ID NO: 15181 - protein, 814 aa, Ethanoligenens harbinense YUAN-3; identical to SEQ ID NO: 11786

SEQ ID NO: 15182 - protein, 1037 aa, Thermaerobacter marianensis DSM 12885; identical to SEQ ID NO: 11788

SEQ ID NO: 15183 - protein, 782 aa, Ruminococcus albus 7 = DSM 20455; identical to SEQ ID NO: 11785

SEQ ID NO: 15184 - protein, 772 aa, Rhodopseudomonas palustris DX-1; identical to SEQ ID NO: 11787

SEQ ID NO: 15185 - protein, 734 aa, Alicycliphilus denitrificans BC; identical to SEQ ID NO: 11791

SEQ ID NO: 15186 - protein, 747 aa, Thermovibrio ammonificans HB-1; identical to SEQ ID NO: 11790

SEQ ID NO: 15187 - protein, 715 aa, Bacteroides helcogenes P 36-108; identical to SEQ ID NO: 11792

SEQ ID NO: 15188 - protein, 725 aa, Nitratifractor salsuginis DSM 16511; identical to SEQ ID NO: 11793

SEQ ID NO: 15189 - protein, 1068 aa, Anaerolinea thermophila UNI-1; identical to SEQ ID NO: 12054

SEQ ID NO: 15190 - protein, 793 aa, Anaerolinea thermophila UNI-1; identical to SEQ ID NO: 12055

SEQ ID NO: 15191 - protein, 590 aa, Desulfurococcus mucosus DSM 2162; identical to SEQ ID NO: 11794

SEQ ID NO: 15192 - protein, 784 aa, Thermoanaerobacter brockii subsp. finnii Ako-1; identical to SEQ ID NO: 11627

SEQ ID NO: 15193 - protein, 738 aa, Desulfobulbus propionicus DSM 2032; identical to SEQ ID NO: 11796

SEQ ID NO: 15194 - protein, 927 aa, Thermus scotoductus SA-01; identical to SEQ ID NO: 11797

SEQ ID NO: 15195 - protein, 835 aa, Acidovorax avenae subsp. avenae ATCC 19860; identical to SEQ ID NO: 11798

SEQ ID NO: 15196 - protein, 540 aa, Vulcanisaeta moutnovskia 768-28; identical to SEQ ID NO: 11804

SEQ ID NO: 15197 - protein, 896 aa, Odoribacter splanchnicus DSM 20712; identical to SEQ ID NO: 11805

SEQ ID NO: 15198 - protein, 798 aa, Syntrophobotulus glycolicus DSM 8271; identical to SEQ ID NO: 11806

SEQ ID NO: 15199 - protein, 769 aa, Planctomyces brasiliensis DSM 5305; identical to SEQ ID NO: 11807

SEQ ID NO: 15200 - protein, 769 aa, Planctomyces brasiliensis DSM 5305; identical to SEQ ID NO: 11807

SEQ ID NO: 15201 - protein, 754 aa, Nitrosomonas sp. AL212; identical to SEQ ID NO: 11809

SEQ ID NO: 15202 - protein, 732 aa, Archaeoglobus veneficus SNP6; identical to SEQ ID NO: 11810

SEQ ID NO: 15203 - protein, 758 aa, Marinithermus hydrothermalis DSM 14884; identical to SEQ ID NO: 11813

SEQ ID NO: 15204 - protein, 601 aa, Desulfobacca acetoxidans DSM 11109; identical to SEQ ID NO: 11812

SEQ ID NO: 15205 - protein, 1046 aa, Coriobacterium glomerans PW2; identical to SEQ ID NO: 11811

SEQ ID NO: 15206 - protein, 822 aa, Methanosaeta concilii GP6; identical to SEQ ID NO: 11816

SEQ ID NO: 15207 - protein, 800 aa, Methanosaeta concilii GP6; identical to SEQ ID NO: 11817

SEQ ID NO: 15208 - protein, 672 aa, Clostridium botulinum BKT015925; identical to SEQ ID NO: 11818

SEQ ID NO: 15209 - protein, 916 aa, Verrucosispora maris AB-18-032; identical to SEQ ID NO: 11815

SEQ ID NO: 15210 - protein, 498 aa, Metallosphaera cuprina Ar-4; identical to SEQ ID NO: 11819

SEQ ID NO: 15211 - protein, 752 aa, Selenomonas sputigena ATCC 35185; identical to SEQ ID NO: 11820

SEQ ID NO: 15212 - protein, 641 aa, Pyrococcus sp. NA2; identical to SEQ ID NO: 11821

SEQ ID NO: 15213 - protein, 783 aa, Thermodesulfobium narugense DSM 14796; identical to SEQ ID NO: 11823

SEQ ID NO: 15214 - protein, 767 aa, Porphyromonas asaccharolytica DSM 20707; identical to SEQ ID NO: 11822

SEQ ID NO: 15215 - protein, 755 aa, Haliscomenobacter hydrossis DSM 1100; identical to SEQ ID NO: 11824

SEQ ID NO: 15216 - protein, 362 aa, Melissococcus plutonius ATCC 35311; identical to SEQ ID NO: 12057

SEQ ID NO: 15217 - protein, 485 aa, Acidianus hospitalis W1; identical to SEQ ID NO: 11826

SEQ ID NO: 15218 - protein, 1001 aa, Tepidanaerobacter acetatoxydans Re1; identical to SEQ ID NO: 11825

SEQ ID NO: 15219 - protein, 815 aa, Mahella australiensis 50-1 BON; identical to SEQ ID NO: 11827

SEQ ID NO: 15220 - protein, 787 aa, Thermoanaerobacterium xylanolyticum LX-11; identical to SEQ ID NO: 11828

SEQ ID NO: 15221 - protein, 728 aa, Desulfotomaculum carboxydivorans CO-1-SRB; identical to SEQ ID NO: 11832

SEQ ID NO: 15222 - protein, 781 aa, Desulfotomaculum carboxydivorans CO-1-SRB; identical to SEQ ID NO: 11833

SEQ ID NO: 15223 - protein, 767 aa, Porphyromonas gingivalis TDC60; identical to SEQ ID NO: 12058

SEQ ID NO: 15224 - protein, 754 aa, Methylomonas methanica MC09; identical to SEQ ID NO: 11834

SEQ ID NO: 15225 - protein, 902 aa, Desulfotomaculum kuznetsovii DSM 6115; identical to SEQ ID NO: 11835

SEQ ID NO: 15226 - protein, 836 aa, Desulfotomaculum kuznetsovii DSM 6115; identical to SEQ ID NO: 11836

SEQ ID NO: 15227 - protein, 724 aa, Novosphingobium sp. PP1Y; identical to SEQ ID NO: 12124

SEQ ID NO: 15228 - protein, 791 aa, Desulfotomaculum ruminis DSM 2154; identical to SEQ ID NO: 11841

SEQ ID NO: 15229 - protein, 322 aa, Bacillus coagulans 2-6; identical to SEQ ID NO: 11852

SEQ ID NO: 15230 - protein, 726 aa, Geobacillus thermoglucosidasius C56-YS93; identical to SEQ ID NO: 11848

SEQ ID NO: 15231 - protein, 827 aa, Geobacillus thermoglucosidasius C56-YS93; identical to SEQ ID NO: 11849

SEQ ID NO: 15232 - protein, 713 aa, Flexistipes sinusarabici DSM 4947; identical to SEQ ID NO: 11854

SEQ ID NO: 15233 - protein, 917 aa, Methanosalsum zhilinae DSM 4017; identical to SEQ ID NO: 11853

SEQ ID NO: 15234 - protein, 762 aa, Ramlibacter tataouinensis TTB310; identical to SEQ ID NO: 11843

SEQ ID NO: 15235 - protein, 725 aa, Pyrococcus yayanosii CH1; identical to SEQ ID NO: 11844

SEQ ID NO: 15236 - protein, 526 aa, Pyrococcus yayanosii CH1; identical to SEQ ID NO: 11845

SEQ ID NO: 15237 - protein, 692 aa, Pyrococcus yayanosii CH1; identical to SEQ ID NO: 11846

SEQ ID NO: 15238 - protein, 726 aa, Thermodesulfatator indicus DSM 15286; identical to SEQ ID NO: 11847

SEQ ID NO: 15239 - protein, 716 aa, Runella slithyformis DSM 19594; identical to SEQ ID NO: 11857

SEQ ID NO: 15240 - protein, 730 aa, Thermotoga thermarum DSM 5069; identical to SEQ ID NO: 11850

SEQ ID NO: 15241 - protein, 742 aa, Thermotoga thermarum DSM 5069; identical to SEQ ID NO: 11851

SEQ ID NO: 15242 - protein, 895 aa, Zymomonas mobilis subsp. pomaceae ATCC 29192; identical to SEQ ID NO: 11855

SEQ ID NO: 15243 - protein, 746 aa, Zymomonas mobilis subsp. pomaceae ATCC 29192; identical to SEQ ID NO: 11856

SEQ ID NO: 15244 - protein, 1080 aa, Treponema caldaria DSM 7334; identical to SEQ ID NO: 11858

SEQ ID NO: 15245 - protein, 788 aa, Sulfobacillus acidophilus TPY; identical to SEQ ID NO: 11859

SEQ ID NO: 15246 - protein, 926 aa, Streptococcus salivarius CCHSS3; identical to SEQ ID NO: 11860

SEQ ID NO: 15247 - protein, 765 aa, Methanococcus maripaludis X1; identical to SEQ ID NO: 11861

SEQ ID NO: 15248 - protein, 768 aa, Thermococcus sp. 4557; identical to SEQ ID NO: 11863

SEQ ID NO: 15249 - protein, 730 aa, Megasphaera elsdenii DSM 20460; identical to SEQ ID NO: 12127

SEQ ID NO: 15250 - protein, 743 aa, Candidatus Arthromitus sp. SFB-mouse-Japan; identical to SEQ ID NO: 12061

SEQ ID NO: 15251 - protein, 541 aa, Pyrolobus fumarii 1A; identical to SEQ ID NO: 11864

SEQ ID NO: 15252 - protein, 638 aa, Pyrolobus fumarii 1A; identical to SEQ ID NO: 11865

SEQ ID NO: 15253 - protein, 593 aa, Pyrolobus fumarii 1A; identical to SEQ ID NO: 11866

SEQ ID NO: 15254 - protein, 876 aa, Haloarcula hispanica ATCC 33960; identical to SEQ ID NO: 11867

SEQ ID NO: 15255 - protein, 822 aa, Caldicellulosiruptor lactoaceticus 6A; identical to SEQ ID NO: 11868

SEQ ID NO: 15256 - protein, 778 aa, Thermoanaerobacter wiegelii Rt8.B1; identical to SEQ ID NO: 11626

SEQ ID NO: 15257 - protein, 725 aa, Rhodothermus marinus SG0.5JP17-172; identical to SEQ ID NO: 11870

SEQ ID NO: 15258 - protein, 770 aa, Lactobacillus ruminis ATCC 27782; identical to SEQ ID NO: 11871

SEQ ID NO: 15259 - protein, 783 aa, Sphingobium sp. SYK-6; identical to SEQ ID NO: 12062

SEQ ID NO: 15260 - protein, 741 aa, Roseburia hominis A2-183; identical to SEQ ID NO: 11872

SEQ ID NO: 15261 - protein, 743 aa, Candidatus Arthromitus sp. SFB-rat-Yit; identical to SEQ ID NO: 12065

SEQ ID NO: 15262 - protein, 787 aa, Bacillus coagulans 36D1; identical to SEQ ID NO: 11876

SEQ ID NO: 15263 - protein, 827 aa, Candidatus Chloracidobacterium thermophilum B; identical to SEQ ID NO: 11877

SEQ ID NO: 15264 - protein, 470 aa, Tetragenococcus halophilus NBRC 12172; identical to SEQ ID NO: 12066

SEQ ID NO: 15265 - protein, 596 aa, Thermoproteus tenax Kra 1; identical to SEQ ID NO: 12128

SEQ ID NO: 15266 - protein, 566 aa, Thermoproteus tenax Kra 1; identical to SEQ ID NO: 14

SEQ ID NO: 15267 - protein, 767 aa, Methylomicrobium alcaliphilum 20Z; identical to SEQ ID NO: 12130

SEQ ID NO: 15268 - protein, 744 aa, Pseudoxanthomonas spadix BD-a59; identical to SEQ ID NO: 11879

SEQ ID NO: 15269 - protein, 739 aa, Thermovirga lienii DSM 17291; identical to SEQ ID NO: 11881

SEQ ID NO: 15270 - protein, 3070 aa, Keunjorong mosaic virus; identical to SEQ ID NO: 11880

SEQ ID NO: 15271 - protein, 475 aa, Vibrio phage SIO-2; identical to SEQ ID NO: 11883

SEQ ID NO: 15272 - protein, 923 aa, Niastella koreensis GR20-10; identical to SEQ ID NO: 11887

SEQ ID NO: 15273 - protein, 694 aa, Tannerella forsythia ATCC 43037; identical to SEQ ID NO: 11889

SEQ ID NO: 15274 - protein, 869 aa, Burkholderia sp. YI23; identical to SEQ ID NO: 11884

SEQ ID NO: 15275 - protein, 730 aa, Clostridium  clariflavum DSM 19732; identical to SEQ ID NO: 11886

SEQ ID NO: 15276 - protein, 490 aa, Pyrobaculum sp. 1860; identical to SEQ ID NO: 11882

SEQ ID NO: 15277 - protein, 783 aa, Marinitoga piezophila KA3; identical to SEQ ID NO: 11892

SEQ ID NO: 15278 - protein, 876 aa, Corynebacterium diphtheriae 241; identical to SEQ ID NO: 11890

SEQ ID NO: 15279 - protein, 876 aa, Corynebacterium diphtheriae HC01; identical to SEQ ID NO: 11890

SEQ ID NO: 15280 - protein, 803 aa, Clostridium sp. BNL1100; identical to SEQ ID NO: 11893

SEQ ID NO: 15281 - protein, 721 aa, Desulfovibrio desulfuricans ND132; identical to SEQ ID NO: 12476

SEQ ID NO: 15282 - protein, 788 aa, Sulfobacillus acidophilus DSM 10332; identical to SEQ ID NO: 11859

SEQ ID NO: 15283 - protein, 584 aa, Pyrobaculum oguniense TE7; identical to SEQ ID NO: 11895

SEQ ID NO: 15284 - protein, 2930 aa, Saprospira grandis str. Lewin; identical to SEQ ID NO: 11897

SEQ ID NO: 15285 - protein, 790 aa, Caldilinea aerophila DSM 14535 = NBRC 104270; identical to SEQ ID NO: 12070

SEQ ID NO: 15286 - protein, 768 aa, Hydrogenobacter thermophilus TK-6; identical to SEQ ID NO: 11770

SEQ ID NO: 15287 - protein, 759 aa, Amycolatopsis mediterranei S699; identical to SEQ ID NO: 11754

SEQ ID NO: 15288 - protein, 726 aa, Arcobacter sp. L; identical to SEQ ID NO: 12063

SEQ ID NO: 15289 - protein, 812 aa, Bifidobacterium breve ACS-071-V-Sch8b; identical to SEQ ID NO: 11831

SEQ ID NO: 15290 - protein, 817 aa, Thermus thermophilus SG0.5JP17-16; identical to SEQ ID NO: 11837

SEQ ID NO: 15291 - protein, 727 aa, Thermus thermophilus SG0.5JP17-16; identical to SEQ ID NO: 11838

SEQ ID NO: 15292 - protein, 548 aa, Sulfolobus solfataricus 98/2; identical to SEQ ID NO: 11711

SEQ ID NO: 15293 - protein, 501 aa, Sulfolobus islandicus HVE10/4; identical to SEQ ID NO: 11800

SEQ ID NO: 15294 - protein, 501 aa, Sulfolobus islandicus REY15A; identical to SEQ ID NO: 11801

SEQ ID NO: 15295 - protein, 745 aa, Thermus sp. CCB_US3_UF1; identical to SEQ ID NO: 11885

SEQ ID NO: 15296 - protein, 743 aa, Candidatus Arthromitus sp. SFB-mouse-Yit; identical to SEQ ID NO: 12061

SEQ ID NO: 15297 - protein, 750 aa, Ruminiclostridium thermocellum DSM 1313; identical to SEQ ID NO: 11589

SEQ ID NO: 15298 - protein, 745 aa, Desulfovibrio vulgaris RCH1; identical to SEQ ID NO: 11775

SEQ ID NO: 15299 - protein, 906 aa, Haloquadratum walsbyi C23; identical to SEQ ID NO: 12126

SEQ ID NO: 15300 - protein, 552 aa, Fervidicoccus fontis Kam940; identical to SEQ ID NO: 11901

SEQ ID NO: 15301 - protein, 844 aa, Lactobacillus helveticus H10; identical to SEQ ID NO: 11799

SEQ ID NO: 15302 - protein, 727 aa, Listeria monocytogenes J0161; identical to SEQ ID NO: 11873

SEQ ID NO: 15303 - protein, 752 aa, Leptospira interrogans serovar Lai str. IPAV; identical to SEQ ID NO: 11545

SEQ ID NO: 15304 - protein, 910 aa, Ralstonia solanacearum Po82; identical to SEQ ID NO: 11842

SEQ ID NO: 15305 - protein, 885 aa, Rhodospirillum rubrum F11; identical to SEQ ID NO: 11564

SEQ ID NO: 15306 - protein, 752 aa, Rhodospirillum rubrum F11; identical to SEQ ID NO: 11565

SEQ ID NO: 15307 - protein, 817 aa, Thermus thermophilus JL-18; identical to SEQ ID NO: 11900

SEQ ID NO: 15308 - protein, 926 aa, Streptococcus salivarius 57.I; identical to SEQ ID NO: 11860

SEQ ID NO: 15309 - protein, 786 aa, Thermus thermophilus HB27; identical to SEQ ID NO: 11552

SEQ ID NO: 15310 - protein, 841 aa, Clostridioides difficile BI1; identical to SEQ ID NO: 12185

SEQ ID NO: 15311 - protein, 802 aa, Clostridioides difficile BI1; identical to SEQ ID NO: 12097

SEQ ID NO: 15312 - protein, 773 aa, Clostridioides difficile BI1; identical to SEQ ID NO: 12098

SEQ ID NO: 15313 - protein, 661 aa, Clostridioides difficile BI1; identical to SEQ ID NO: 12099

SEQ ID NO: 15314 - protein, 967 aa, Streptomyces hygroscopicus subsp. jinggangensis 5008; identical to SEQ ID NO: 11894

SEQ ID NO: 15315 - protein, 844 aa, Deinococcus gobiensis I-0; identical to SEQ ID NO: 11898

SEQ ID NO: 15316 - protein, 984 aa, Deinococcus gobiensis I-0; identical to SEQ ID NO: 11899

SEQ ID NO: 15317 - protein, 823 aa, Borrelia crocidurae str. Achema; identical to SEQ ID NO: 11902

SEQ ID NO: 15318 - protein, 821 aa, Aggregatibacter actinomycetemcomitans D7S-1; identical to SEQ ID NO: 11904

SEQ ID NO: 15319 - protein, 749 aa, Aggregatibacter actinomycetemcomitans D7S-1; identical to SEQ ID NO: 11905

SEQ ID NO: 15320 - protein, 991 aa, Methylophaga nitratireducenticrescens; identical to SEQ ID NO: 11903

SEQ ID NO: 15321 - protein, 684 aa, Mesotoga prima MesG1.Ag.4.2; identical to SEQ ID NO: 11906

SEQ ID NO: 15322 - protein, 781 aa, Mesotoga prima MesG1.Ag.4.2; identical to SEQ ID NO: 11907

SEQ ID NO: 15323 - protein, 864 aa, Haloferax mediterranei ATCC 33500; identical to SEQ ID NO: 11908

SEQ ID NO: 15324 - protein, 524 aa, Pyrococcus sp. ST04; identical to SEQ ID NO: 11909

SEQ ID NO: 15325 - protein, 803 aa, Tistrella mobilis KA081020-065; identical to SEQ ID NO: 11910

SEQ ID NO: 15326 - protein, 787 aa, Thermoanaerobacterium saccharolyticum JW/SL-YS485; identical to SEQ ID NO: 11911

SEQ ID NO: 15327 - protein, 781 aa, Thermoanaerobacterium saccharolyticum JW/SL-YS485; identical to SEQ ID NO: 11912

SEQ ID NO: 15328 - protein, 622 aa, Desulfurococcus fermentans DSM 16532; identical to SEQ ID NO: 11913

SEQ ID NO: 15329 - protein, 609 aa, Desulfurococcus fermentans DSM 16532; identical to SEQ ID NO: 11914

SEQ ID NO: 15330 - protein, 861 aa, Sulfurospirillum barnesii SES-3; identical to SEQ ID NO: 11915

SEQ ID NO: 15331 - protein, 877 aa, Thiocystis violascens DSM 198; identical to SEQ ID NO: 11916

SEQ ID NO: 15332 - protein, 632 aa, Aequorivita sublithincola DSM 14238; identical to SEQ ID NO: 11917

SEQ ID NO: 15333 - protein, 725 aa, Thermococcus cleftensis; identical to SEQ ID NO: 11918

SEQ ID NO: 15334 - protein, 705 aa, Thermococcus cleftensis; identical to SEQ ID NO: 11919

SEQ ID NO: 15335 - protein, 763 aa, Anaerobaculum mobile DSM 13181; identical to SEQ ID NO: 11920

SEQ ID NO: 15336 - protein, 810 aa, Desulfosporosinus acidiphilus SJ4; identical to SEQ ID NO: 11921

SEQ ID NO: 15337 - protein, 658 aa, Pyrococcus furiosus COM1; identical to SEQ ID NO: 11540

SEQ ID NO: 15338 - protein, 776 aa, Taylorella equigenitalis ATCC 35865; identical to SEQ ID NO: 11923

SEQ ID NO: 15339 - protein, 875 aa, Melioribacter roseus P3M-2; identical to SEQ ID NO: 11924

SEQ ID NO: 15340 - protein, 759 aa, Amycolatopsis mediterranei S699; identical to SEQ ID NO: 11754

SEQ ID NO: 15341 - protein, 844 aa, Lactobacillus helveticus R0052; identical to SEQ ID NO: 11799

SEQ ID NO: 15342 - protein, 729 aa, Listeria monocytogenes SLCC2755; identical to SEQ ID NO: 12000

SEQ ID NO: 15343 - protein, 729 aa, Listeria monocytogenes serotype 7 str. SLCC2482; identical to SEQ ID NO: 12000

SEQ ID NO: 15344 - protein, 722 aa, Geobacter metallireducens GS-15; identical to SEQ ID NO: 11562

SEQ ID NO: 15345 - protein, 719 aa, Desulfobacula toluolica Tol2; identical to SEQ ID NO: 12155

SEQ ID NO: 15346 - protein, 800 aa, Desulfobacula toluolica Tol2; identical to SEQ ID NO: 12156

SEQ ID NO: 15347 - protein, 655 aa, Clostridium  acidurici 9a; identical to SEQ ID NO: 11928

SEQ ID NO: 15348 - protein, 374 aa, Bacillus thuringiensis MC28; identical to SEQ ID NO: 11929

SEQ ID NO: 15349 - protein, 436 aa, Amphibacillus xylanus NBRC 15112; identical to SEQ ID NO: 12071

SEQ ID NO: 15350 - protein, 696 aa, Candidatus Nitrososphaera gargensis Ga9.2; identical to SEQ ID NO: 11930

SEQ ID NO: 15351 - protein, 1055 aa, Bifidobacterium asteroides PRL2011; identical to SEQ ID NO: 11931

SEQ ID NO: 15352 - protein, 886 aa, Salmonella enterica subsp. enterica serovar Weltevreden str. 2007-60-3289-1; identical to SEQ ID NO: 12122

SEQ ID NO: 15353 - protein, 755 aa, Thermacetogenium phaeum DSM 12270; identical to SEQ ID NO: 11933

SEQ ID NO: 15354 - protein, 696 aa, Bacillus thuringiensis Bt407; identical to SEQ ID NO: 11934

SEQ ID NO: 15355 - protein, 969 aa, Gluconobacter oxydans H24; identical to SEQ ID NO: 11935

SEQ ID NO: 15356 - protein, 744 aa, Saccharothrix espanaensis DSM 44229; identical to SEQ ID NO: 12138

SEQ ID NO: 15357 - protein, 812 aa, Synechococcus sp. PCC 6312; identical to SEQ ID NO: 11936

SEQ ID NO: 15358 - protein, 893 aa, Chroococcidiopsis thermalis PCC 7203; identical to SEQ ID NO: 11938

SEQ ID NO: 15359 - protein, 728 aa, Chamaesiphon minutus PCC 6605; identical to SEQ ID NO: 11939

SEQ ID NO: 15360 - protein, 740 aa, Pseudanabaena sp. PCC 7367; identical to SEQ ID NO: 11937

SEQ ID NO: 15361 - protein, 796 aa, Gloeocapsa sp. PCC 7428; identical to SEQ ID NO: 11941

SEQ ID NO: 15362 - protein, 760 aa, Stanieria cyanosphaera PCC 7437; identical to SEQ ID NO: 11942

SEQ ID NO: 15363 - protein, 910 aa, Cyanobacterium aponinum PCC 10605; identical to SEQ ID NO: 11944

SEQ ID NO: 15364 - protein, 769 aa, Cyanobacterium stanieri PCC 7202; identical to SEQ ID NO: 11943

SEQ ID NO: 15365 - protein, 688 aa, Natronobacterium gregoryi SP2; identical to SEQ ID NO: 11945

SEQ ID NO: 15366 - protein, 875 aa, Natronobacterium gregoryi SP2; identical to SEQ ID NO: 11946

SEQ ID NO: 15367 - protein, 750 aa, Singulisphaera acidiphila DSM 18658; identical to SEQ ID NO: 11947

SEQ ID NO: 15368 - protein, 702 aa, Thermobacillus composti KWC4; identical to SEQ ID NO: 11948

SEQ ID NO: 15369 - protein, 796 aa, Thermobacillus composti KWC4; identical to SEQ ID NO: 11949

SEQ ID NO: 15370 - protein, 762 aa, Thermobacillus composti KWC4; identical to SEQ ID NO: 11950

SEQ ID NO: 15371 - protein, 733 aa, Aciduliprofundum sp. MAR08-339; identical to SEQ ID NO: 11954

SEQ ID NO: 15372 - protein, 714 aa, Methanoregula formicica SMSP; identical to SEQ ID NO: 11951

SEQ ID NO: 15373 - protein, 812 aa, Methanoregula formicica SMSP; identical to SEQ ID NO: 11952

SEQ ID NO: 15374 - protein, 728 aa, Methanoregula formicica SMSP; identical to SEQ ID NO: 11953

SEQ ID NO: 15375 - protein, 744 aa, Mycobacterium canettii CIPT 140070010; identical to SEQ ID NO: 12146

SEQ ID NO: 15376 - protein, 804 aa, Mycobacterium canettii CIPT 140070017; identical to SEQ ID NO: 12147

SEQ ID NO: 15377 - protein, 731 aa, Prevotella dentalis DSM 3688; identical to SEQ ID NO: 11956

SEQ ID NO: 15378 - protein, 787 aa, Thermoanaerobacterium thermosaccharolyticum M0795; identical to SEQ ID NO: 11955

SEQ ID NO: 15379 - protein, 780 aa, Halobacteroides halobius DSM 5150; identical to SEQ ID NO: 11957

SEQ ID NO: 15380 - protein, 716 aa, Chamaesiphon minutus PCC 6605; identical to SEQ ID NO: 11940

SEQ ID NO: 15381 - protein, 744 aa, Myxococcus stipitatus DSM 14675; identical to SEQ ID NO: 11958

SEQ ID NO: 15382 - protein, 770 aa, Myxococcus stipitatus DSM 14675; identical to SEQ ID NO: 11959

SEQ ID NO: 15383 - protein, 781 aa, Clostridium  stercorarium subsp. stercorarium DSM 8532; identical to SEQ ID NO: 11960

SEQ ID NO: 15384 - protein, 737 aa, Clostridium  stercorarium subsp. stercorarium DSM 8532; identical to SEQ ID NO: 11961

SEQ ID NO: 15385 - protein, 405 aa, Enterococcus faecium NRRL B-2354; identical to SEQ ID NO: 11962

SEQ ID NO: 15386 - protein, 738 aa, Clostridium saccharoperbutylacetonicum N1-4(HMT); identical to SEQ ID NO: 11963

SEQ ID NO: 15387 - protein, 892 aa, Dehalococcoides mccartyi DCMB5; identical to SEQ ID NO: 11966

SEQ ID NO: 15388 - protein, 763 aa, Hydrogenobaculum sp. HO; identical to SEQ ID NO: 11829

SEQ ID NO: 15389 - protein, 735 aa, Hydrogenobaculum sp. HO; identical to SEQ ID NO: 11830

SEQ ID NO: 15390 - protein, 787 aa, Bibersteinia trehalosi USDA-ARS-USMARC-192; identical to SEQ ID NO: 11970

SEQ ID NO: 15391 - protein, 812 aa, Bifidobacterium breve UCC2003; identical to SEQ ID NO: 11572

SEQ ID NO: 15392 - protein, 821 aa, Bifidobacterium thermophilum RBL67; identical to SEQ ID NO: 11971

SEQ ID NO: 15393 - protein, 881 aa, Edwardsiella piscicida C07-087; identical to SEQ ID NO: 11972

SEQ ID NO: 15394 - protein, 764 aa, Xanthomonas axonopodis Xac29-1; identical to SEQ ID NO: 11542

SEQ ID NO: 15395 - protein, 763 aa, Hydrogenobaculum sp. SN; identical to SEQ ID NO: 11829

SEQ ID NO: 15396 - protein, 735 aa, Hydrogenobaculum sp. SN; identical to SEQ ID NO: 11830

SEQ ID NO: 15397 - protein, 764 aa, Xanthomonas citri subsp. citri Aw12879; identical to SEQ ID NO: 11542

SEQ ID NO: 15398 - protein, 762 aa, Mannheimia haemolytica USDA-ARS-USMARC-183; identical to SEQ ID NO: 11977

SEQ ID NO: 15399 - protein, 762 aa, Mannheimia haemolytica USDA-ARS-USMARC-185; identical to SEQ ID NO: 11977

SEQ ID NO: 15400 - protein, 781 aa, Clostridium  stercorarium subsp. stercorarium DSM 8532; identical to SEQ ID NO: 11960

SEQ ID NO: 15401 - protein, 737 aa, Clostridium  stercorarium subsp. stercorarium DSM 8532; identical to SEQ ID NO: 11961

SEQ ID NO: 15402 - protein, 756 aa, Thalassolituus oleivorans MIL-1; identical to SEQ ID NO: 12228

SEQ ID NO: 15403 - protein, 967 aa, Streptomyces hygroscopicus subsp. jinggangensis TL01; identical to SEQ ID NO: 11894

SEQ ID NO: 15404 - protein, 704 aa, Eubacterium  rectale DSM 17629; identical to SEQ ID NO: 11686

SEQ ID NO: 15405 - protein, 904 aa, Faecalibacterium prausnitzii SL3/3; identical to SEQ ID NO: 12108

SEQ ID NO: 15406 - protein, 764 aa, Fretibacterium fastidiosum; identical to SEQ ID NO: 12109

SEQ ID NO: 15407 - protein, 719 aa, Faecalibacterium prausnitzii L2-6; identical to SEQ ID NO: 12107

SEQ ID NO: 15408 - protein, 884 aa, Eubacterium  siraeum V10Sc8a; identical to SEQ ID NO: 12110

SEQ ID NO: 15409 - protein, 704 aa, Eubacterium  rectale M104/1; identical to SEQ ID NO: 11686

SEQ ID NO: 15410 - protein, 501 aa, Sulfolobus islandicus LAL14/1; identical to SEQ ID NO: 11981

SEQ ID NO: 15411 - protein, 3137 aa, Sunflower mild mosaic virus; identical to SEQ ID NO: 11932

SEQ ID NO: 15412 - protein, 762 aa, Mannheimia haemolytica M42548; identical to SEQ ID NO: 11977

SEQ ID NO: 15413 - protein, 661 aa, Azotobacter vinelandii CA; identical to SEQ ID NO: 11675

SEQ ID NO: 15414 - protein, 661 aa, Azotobacter vinelandii CA6; identical to SEQ ID NO: 11675

SEQ ID NO: 15415 - protein, 761 aa, Archaeoglobus sulfaticallidus PM70-1; identical to SEQ ID NO: 11986

SEQ ID NO: 15416 - protein, 367 aa, Streptococcus oligofermentans AS 1.3089; identical to SEQ ID NO: 11987

SEQ ID NO: 15417 - protein, 782 aa, Desulfotomaculum gibsoniae DSM 7213; identical to SEQ ID NO: 11988

SEQ ID NO: 15418 - protein, 733 aa, Desulfotomaculum gibsoniae DSM 7213; identical to SEQ ID NO: 11989

SEQ ID NO: 15419 - protein, 845 aa, Fusobacterium nucleatum subsp. animalis 4_8; identical to SEQ ID NO: 11990

SEQ ID NO: 15420 - protein, 707 aa, Candidatus Methanomassiliicoccus intestinalis Issoire-Mx1; identical to SEQ ID NO: 11992

SEQ ID NO: 15421 - protein, 948 aa, Methanobrevibacter sp. AbM4; identical to SEQ ID NO: 11991

SEQ ID NO: 15422 - protein, 704 aa, Pseudomonas putida H8234; identical to SEQ ID NO: 11993

SEQ ID NO: 15423 - protein, 746 aa, Ferroplasma acidarmanus fer1; identical to SEQ ID NO: 11995

SEQ ID NO: 15424 - protein, 803 aa, Ferroplasma acidarmanus fer1; identical to SEQ ID NO: 11996

SEQ ID NO: 15425 - protein, 762 aa, Mannheimia haemolytica D171; identical to SEQ ID NO: 11998

SEQ ID NO: 15426 - protein, 762 aa, Mannheimia haemolytica D174; identical to SEQ ID NO: 11977

SEQ ID NO: 15427 - protein, 762 aa, Mannheimia haemolytica D153; identical to SEQ ID NO: 11977

SEQ ID NO: 15428 - protein, 729 aa, Listeria monocytogenes; identical to SEQ ID NO: 12000

SEQ ID NO: 15429 - protein, 729 aa, Listeria monocytogenes; identical to SEQ ID NO: 12000

SEQ ID NO: 15430 - protein, 762 aa, Mannheimia haemolytica USMARC_2286; identical to SEQ ID NO: 11977

SEQ ID NO: 15431 - protein, 492 aa, Thermococcus litoralis DSM 5473; identical to SEQ ID NO: 12604

SEQ ID NO: 15432 - protein, 759 aa, Amycolatopsis mediterranei RB; identical to SEQ ID NO: 11754

SEQ ID NO: 15433 - protein, 1001 aa, Tepidanaerobacter acetatoxydans Re1; identical to SEQ ID NO: 11825

SEQ ID NO: 15434 - protein, 858 aa, Clostridium saccharobutylicum DSM 13864; identical to SEQ ID NO: 12004

SEQ ID NO: 15435 - protein, 863 aa, Clostridium saccharobutylicum DSM 13864; identical to SEQ ID NO: 12005

SEQ ID NO: 15436 - protein, 855 aa, Clostridium autoethanogenum DSM 10061; identical to SEQ ID NO: 12007

SEQ ID NO: 15437 - protein, 759 aa, Clostridium tetani 12124569; identical to SEQ ID NO: 12300

SEQ ID NO: 15438 - protein, 537 aa, Candidatus Caldiarchaeum subterraneum; identical to SEQ ID NO: 12051

SEQ ID NO: 15439 - protein, 876 aa, Haloarcula hispanica N601; identical to SEQ ID NO: 11867

SEQ ID NO: 15440 - protein, 761 aa, Thermosynechococcus sp. NK55a; identical to SEQ ID NO: 12009

SEQ ID NO: 15441 - protein, 827 aa, Paenibacillus polymyxa CR1; identical to SEQ ID NO: 12011

SEQ ID NO: 15442 - protein, 809 aa, Methanobacterium sp. MB1; identical to SEQ ID NO: 12294

SEQ ID NO: 15443 - protein, 707 aa, Pseudomonas sp. TKP; identical to SEQ ID NO: 12012

SEQ ID NO: 15444 - protein, 589 aa, Sulfolobus acidocaldarius SUSAZ; identical to SEQ ID NO: 12013

SEQ ID NO: 15445 - protein, 702 aa, Desulfovibrio vulgaris str. Hildenborough; identical to SEQ ID NO: 11553

SEQ ID NO: 15446 - protein, 719 aa, Symbiobacterium thermophilum IAM 14863; identical to SEQ ID NO: 12034

SEQ ID NO: 15447 - protein, 936 aa, Symbiobacterium thermophilum IAM 14863; identical to SEQ ID NO: 12035

SEQ ID NO: 15448 - protein, 760 aa, Mannheimia succiniciproducens MBEL55E; identical to SEQ ID NO: 11554

SEQ ID NO: 15449 - protein, 719 aa, Bacteroides fragilis YCH46; identical to SEQ ID NO: 12036

SEQ ID NO: 15450 - protein, 881 aa, Methylococcus capsulatus str. Bath; identical to SEQ ID NO: 11555

SEQ ID NO: 15451 - protein, 914 aa, Nocardia farcinica IFM 10152; identical to SEQ ID NO: 12037

SEQ ID NO: 15452 - protein, 732 aa, Photobacterium profundum SS9; identical to SEQ ID NO: 12080

SEQ ID NO: 15453 - protein, 927 aa, Photobacterium profundum SS9; identical to SEQ ID NO: 12081

SEQ ID NO: 15454 - protein, 893 aa, Haloarcula marismortui ATCC 43049; identical to SEQ ID NO: 11556

SEQ ID NO: 15455 - protein, 817 aa, Thermus thermophilus HB8; identical to SEQ ID NO: 12038

SEQ ID NO: 15456 - protein, 828 aa, Aromatoleum aromaticum EbN1; identical to SEQ ID NO: 12083

SEQ ID NO: 15457 - protein, 533 aa, Thermococcus kodakarensis KOD1; identical to SEQ ID NO: 12039

SEQ ID NO: 15458 - protein, 900 aa, Thermococcus kodakarensis KOD1; identical to SEQ ID NO: 12040

SEQ ID NO: 15459 - protein, 763 aa, Xanthomonas oryzae pv. oryzae KACC 10331; identical to SEQ ID NO: 11557

SEQ ID NO: 15460 - protein, 950 aa, Corynebacterium jeikeium K411; identical to SEQ ID NO: 12084

SEQ ID NO: 15461 - protein, 944 aa, Thermobifida fusca YX; identical to SEQ ID NO: 11558

SEQ ID NO: 15462 - protein, 843 aa, Methanosarcina barkeri str. Fusaro; identical to SEQ ID NO: 11559

SEQ ID NO: 15463 - protein, 897 aa, Dehalococcoides mccartyi CBDB1; identical to SEQ ID NO: 12086

SEQ ID NO: 15464 - protein, 692 aa, Chlorobium luteolum DSM 273; identical to SEQ ID NO: 11561

SEQ ID NO: 15465 - protein, 445 aa, Lactobacillus sakei subsp. sakei 23K; identical to SEQ ID NO: 12085

SEQ ID NO: 15466 - protein, 885 aa, Rhodospirillum rubrum ATCC 11170; identical to SEQ ID NO: 11564

SEQ ID NO: 15467 - protein, 752 aa, Rhodospirillum rubrum ATCC 11170; identical to SEQ ID NO: 11565

SEQ ID NO: 15468 - protein, 724 aa, Moorella thermoacetica ATCC 39073; identical to SEQ ID NO: 11563

SEQ ID NO: 15469 - protein, 743 aa, Hahella chejuensis KCTC 2396; identical to SEQ ID NO: 11566

SEQ ID NO: 15470 - protein, 795 aa, Methanosphaera stadtmanae DSM 3091; identical to SEQ ID NO: 11567

SEQ ID NO: 15471 - protein, 917 aa, Methanosphaera stadtmanae DSM 3091; identical to SEQ ID NO: 11568

SEQ ID NO: 15472 - protein, 763 aa, Xanthomonas oryzae pv. oryzae MAFF 311018; identical to SEQ ID NO: 12041

SEQ ID NO: 15473 - protein, 962 aa, Frankia sp. CcI3; identical to SEQ ID NO: 11569

SEQ ID NO: 15474 - protein, 751 aa, Frankia sp. CcI3; identical to SEQ ID NO: 11570

SEQ ID NO: 15475 - protein, 807 aa, Desulfitobacterium hafniense Y51; identical to SEQ ID NO: 14022

SEQ ID NO: 15476 - protein, 745 aa, Methylobacillus flagellatus KT; identical to SEQ ID NO: 11571

SEQ ID NO: 15477 - protein, 971 aa, Deinococcus geothermalis DSM 11300; identical to SEQ ID NO: 11573

SEQ ID NO: 15478 - protein, 772 aa, Deinococcus geothermalis DSM 11300; identical to SEQ ID NO: 11574

SEQ ID NO: 15479 - protein, 767 aa, Myxococcus xanthus DK 1622; identical to SEQ ID NO: 11575

SEQ ID NO: 15480 - protein, 746 aa, Myxococcus xanthus DK 1622; identical to SEQ ID NO: 11576

SEQ ID NO: 15481 - protein, 1097 aa, Frankia alni ACN14a; identical to SEQ ID NO: 14028

SEQ ID NO: 15482 - protein, 832 aa, Granulibacter bethesdensis CGDNIH1
MQWKNWPGKSSVTPDGPEHPAAFHMLDVAAVAERLIEPFGVARPLRDALVVMTALHDIGKISESFRAMLREGVAQPGFRHWELSEVLFYVEDARIAARLGGTPLVRKMLYAAIAGHHGRPSEHMLGALPPEARLPRELVRALKCVGEGREPAARLMDVFFDLWPEASLEGLTLAEATTLSWWLAGFCAAADWVGSNLGWFPPKTEADSLAAYLQQTRAIAARAVVEAGIAGTMVRQGKLFDFVLRPMQVACSTIALPDGPTLAIVEDGTGTGKTEAALILVHRFCQAGKGRGLFDALPTMATTDAMFDRASRIVGRMFDNPSVTLAHGRAGLSVPFRELVQRSRTGGPGEITSSDWLAEGNRRALLADVGIGTIDQALLSVLPVRFQTLRIYGLSSKILLVDEVHEMGEAYIAEELTALLKMHRAAGGSAILLTATLPMSLRSKLLATYDGASDNPAYPALTIAGGEAITQFPAEDYPVKGPVKVERLDTAADAVTLLTGMAAQGAACVWVRNAVDDAIEAVEALRAAGVEARLIHARFALCDRKRIEAEILATVGKNGKGRAGFVLVGTQVLESSLDLDFDVMVSDIAPIAALIQRAGRLWRHMDIRPVSVRPVAGPVLYVLSPDPSLVEDERWLHGTLGKGAWVYALADVWRSARVLFTQGQIGTPDRQRALIEAVYGTDTEPVPEALLKAEQDKYGKDSADRGLAWHNIVKFTDGYRKAGRGDDDVNYPTRLGEEVRVLRLARRTRTGLVPWAEGEGEDAWALSDVSAHRKKLDALPLPDQSSPEIMKITKDWPEWKRAQIRLCPVDEDGSICEGLNYDEECGLVFVSV

SEQ ID NO: 15483 - protein, 717 aa, Syntrophomonas wolfei subsp. wolfei str. Goettingen G311; identical to SEQ ID NO: 11577

SEQ ID NO: 15484 - protein, 781 aa, Syntrophomonas wolfei subsp. wolfei str. Goettingen G311; identical to SEQ ID NO: 11578

SEQ ID NO: 15485 - protein, 931 aa, Leptospira borgpetersenii serovar Hardjo-bovis str. L550; identical to SEQ ID NO: 11580

SEQ ID NO: 15486 - protein, 931 aa, Leptospira borgpetersenii serovar Hardjo-bovis str. JB197; identical to SEQ ID NO: 11579

SEQ ID NO: 15487 - protein, 804 aa, Methanothrix thermoacetophila PT; identical to SEQ ID NO: 11581

SEQ ID NO: 15488 - protein, 873 aa, Clostridium novyi NT; identical to SEQ ID NO: 11582

SEQ ID NO: 15489 - protein, 805 aa, Bifidobacterium adolescentis ATCC 15703; identical to SEQ ID NO: 12042

SEQ ID NO: 15490 - protein, 667 aa, Chlorobium phaeobacteroides DSM 266; identical to SEQ ID NO: 11583

SEQ ID NO: 15491 - protein, 566 aa, Thermofilum pendens Hrk 5; identical to SEQ ID NO: 11584

SEQ ID NO: 15492 - protein, 745 aa, Desulfovibrio vulgaris DP4; identical to SEQ ID NO: 11585

SEQ ID NO: 15493 - protein, 792 aa, Acidovorax citrulli AAC00-1; identical to SEQ ID NO: 11586
